United States Patent 7,625,699 (GENETIC POLYMORPHISMS ASSOCIATED WITH CORONARY STENOSIS, METHODS OF DETECTION AND USES THEREOF) - sequence listing, part 3

SEQ ID NO: 12175 - DNA, 14194 bp, Homo sapiens
gaaggattattattgttggccttataaaatctcataatttaatatctaaattatattattttttaaatggaagtctactttatttaaattaagaggactaggctacttattttttttattttgttttggagagtacatgtgcaggttttttatattaatacattgagcaatgctgaggtttgggcttcccatggacccattaaccaaatagtaaacatagtacccaataagtagtttttcaacccttaccccctaccactgtacccccttttgggattcccagtatctattatttccatctctatgtctatgtgtacccattgtttagttttcacttgtaaagtgagaacatgcggtatttcattttctgtttctgacttatttcatttaggatgatggtctcaagctccatatatgttgctgcaaaagacagaatttcattcatttttatgcctgcatagtattccatggtatacatataccacatttctttttccagtcaaccagtaatagacccttaggttgattccatgattttgctattgtgaattgtgttgtgataaacatacaagtgcaggtgtctctttgatgaaacaatttcttttcttttggatagatactgaagagtgggattgctggattgaatggtagttctatatttatttctctgtgaaatctccatactgttttctataaaggttaaactaatttacattcccaccaacagtgtataaagtcttcccttttctccacatccttgccaatatctgttattttttgactttttaataatagccaatctgactggtctgaagtagtatctcattgtgattttaatctgcatttctctgatgattagttatgttgagcactttttaatatgtttgttgtcctcttgtatgtcttgttttgagaagtgtctgttcatgtcctttgcccacttcttaattggattatttgtttggtttttgttgatttgtttaagtccctcatagattctggatattagtctttgtcagatgcacagtttgcatttttttctcccattctgttggttgtctgtttattctgttgactatttttttatgtgcaaaagtttagtttaattagatctcatttgtccatttttattgttgcatttgcckttagccttagtcataaattctttgcctaggccaatatctagaagagttcttcttagattttcttctagcgattgcatagtttcaggtcttatatttacatcttcagtctatcttgagttaatatttgtatatggtgagaggtaggggtccagtttgacttcatatggctggccagctttcccaatgtcatttattgaatagggtacccatttcccattgtttacttttgtaaactttgccaacagtcggttggttgtaggtgtgtggctttatgtctgagttctctattctgttccattgatctatgtgtcttcttttgtaccaataccatgctgtttttgttactatagccttgtcatatagtttgaagtcaagtaatgtgttgcctctggctttgttctttttgctcaggattgctttgctactcaggctttcctttggtttcatatgaattttagaattgtttttataattgtgtgaaaatgacattggtaatttgataggaattgcattgtatctgtacattgttttgggctctaaactcattttaagaatattacttcttccaatccatgaatatgggataattttctatttgtttgtgacatctacagtttattcaatcagagttttgtagttctccttgtagcagttttcacttccttggtaaaatgtattcctagatattttatgttttgtgtgtgtggctattgcaaataggattgagttcttgatttggtttttaccttgagtattgttggtatacagaaaggcacctgattttcatacattaattttgtatcctgaaactttactaaagttatttgtcaggtcaaggagtcttttgaagaaaactttagggtcttttagatataagatcatgttgtcagcaaacagagacacttttatttcctctttttcaatttgggtgtcttttctttcttttcattatcagatttttctggctaagacttccagtattatggttaaataggagtggtgagagtagacatccttgggttgctcgagttctgaggaatgctttcagtgtttcaccattcagtttgatgttggctgcaggtttgtcttacagtatgttccttcaatgcctagttacttgagagtttttattatgaaaggctactgtattttatcaaatatttttcctgcatctgttgagatgatatgatttgtttttaactttgtttatgtggtgaatcacatttattgacttgcagatgttgaaccactcctatattcctgggatgaaacctacttgatcatgatgaattgtctttttttctatgctcttggattcagtttgctagtattttcttgaggatatttgtgtctatattcctcagggatattaacctgtggttttcttttttgttgtatccttgccaaactttggtaacagagtgatactagttttgtagagtgagttagttagaaaggaatccctacgccctgatttcctggaatactttcagtaagattggtacgggctcttctttacatgtctgatagaattcagctgagaatccatctgatcctcaactttttttggttggtagatttttcattattgatttgattttataaatcattattggttgcacaagatttcaatttcttcctgattcaatcttgggagttacatttcggttatttatcaatttcctctaggttttctagtttgtatacatagaggtgttcgtagcagtctctgagaatcttttatatttttgcaatatcagttgtcatgacacatttgtcatttctgttgtacttatttgattctttctctttttttcttggtttatctaactagcattctatttattttgtttaacctttcaaagaacaaactttcttgtttcattgagccttcattgattgttttataattttaaaaatcaatttaatttagttccactctgatcttttttatttcttttcttctgctagcttagtattttgtttgctcttgtttttctagttccttgaggtgaggcattagtttattaatttaagatatttctatctttttgttcaggcatttggcactatgagctatcgtcttaacactgcttttgctgtatgccagaggattttataggttgtgtctctacgttcatttgaaataattttttgatttctaccttaatttctttgattccctcaaagtcattcaggagcaagttgtttagtttccacgtacttgtgtgattttcatttaatcttccttttgaagtgaaccctatgtcattatataacaaccttctctgtgtgtgtgtgtgtgtgtgtgtgtgtgtatgtgtgttgttctgtttattgttgtgggtttaaaatctgttttatctattacaagaatggcaacctctgctctttttggtttttcatttatgtgatctgtctttctccacccctttactttgaacctctgggtctcagtacatgttaggtacatctcctgaaggcagcagatggttcagtctcattttttaaatttaatttgccaatctatataagtggagaatttaggtcagttatgctcaaaattaatatttatatgtgatatgtaaggctttgtttgtgtcatcatgtttttagctagttgctttgtagtgtaacttatttaattgctttgtagggttggtaaatttgtacttacatgttcttttatggtagcaagtattattcatttgttttcatgtttagaactcctttgaatatttcttgcagattcagtctagtggtgacaaacttttctagcatctgtcctctaccttgtctgggaaaggctgtttctccttcatttataaagctcagtttagcagcatataaactggtttgtaaggtttctcctgagaagtcttccgttagtctgacggaatttcctttataggagatttgcccttccatagctgtctttaagatcttttctttagcattgaccttggatagcttgatgactatgaatatgctttggtgatgttcatcttgtgtagtatctagcaggcgttctctaaatttcctgtatccagatttttacctttgtaactacgtttaaaaaaatacaaaattattctctcaaatatgttttccaagttttttttttttgcttctctcccaggaatgcctataagtcatagatttggttgctttacgtaatcccatatttctcaaaggctttgttctttcaaacaacttttttttttttgtctgactgtgttaatttgcaagaccagtttccaagttctgattttttttcttctgattgttctggtctatttttaaaactttctattgtgttttgcaattcttttagtgaatttttaaactccacagttctattatatatacatacatatccatacatatttatagccatttgatatatatatatggagatatatatgtatatatctatacgtatataaaaaattgctacaataatatatagccttctcatctctcatatcttgaataatttttctggtttcgttgtattggttttcaactttctcttgtatctcattgagtttccttggaacccatattttgaattctttgttatttcagaattttcattcctgttaggatctattgctagagagctactgtgatctttgaaggtgtcaaaacactgtttttgtactgcagaagatcttgcactgattcattctcatgtgaaagagctgttgcttcctatttttgaattcgctttcatttgtacgagacttttaaatgcttcattctttttttccttgagggtatgactgtggtgtatgttgcatatgatcttttggctttatttctggttgctttcagagggccaagtctctgtatgagttccttcattgtgggtagaatttgtgtggtggctttctcaaatgttgcttgttgttcaagtacttttagaaagacgctatgttaaacaagtgtaactgcagatgttagtagcacttttataatataatcacctataggtagaatgagaaagtttctggatttctagcacctaacattaaatttcatgctttctgaaagtaggccgtctaggaaacagttacttttgaattctctggacttttatatttttgaatgcaaaggaaatctgttagctgtttgactgtttttcagtttgctcgagacttaaattgagcacccagtgctatttactgattctcacttggaaagaacttggaaagaaaagttccacagaataaagacagagtaatttccattggttcaccatgaattctctgataatttctttacagaaaaaaacatagaaaatagatgtaattattattatattcccattatgaagtaataatttttgacacatattattttaaattatccagcaatttctttcccagtgaaagaattgaggaactgaaaattatcactttgccacattactcagaatcacaaaattggcttcaaaatggtgttaaaactacactccaagttgcctgaccccgaagcttgtgtttagaccatttttttttactagggtgtctaatagatgggcaactgaaaaggatcattactttttttttcaggacaatgggatgtcatttaaatacccagaaagaaacaacttgcccactgttatactgattccctgaaagacttcaaaggatgaagagtttacagctacagagtattcaatagaccttgggtcagtgtagaatcagagttacctttatgttttaaaataaatttgattttaattaaatttatgtatttgtttttttgttgtctgcttagaagaccaggcaaatcattgtaagtttgtgtcctccactcacttacccacttatctgtaagaattacctagccaggaacactagccgttcacgtgttcggtcctccttagctgactcgccgccctcgctgccgcaccatggacgccccgaggcacgtggtcaacttcgggcctggtcccgccaagctgyctcactcagtgttgttagagataaaaaaggaattattagactacaaaggagttggcattagtgttcttgaaatgagtcacaggccatcagattttgccaagattattaacgatacagagaatcttgtgcgggaattgcyagccrttccagacagctrtaaggtgatttttgtgcaaggaagtggrtctggccagttcggtgctgtccccttaaacctgattggcttgaaagcaggaagatgtgcggactatgtggtgacagggacttggtcagctaaggccgcagaagaagccaagaagtttgggactataaatatcattcaccctaaacttgrgagttatacaaaaattccagatccaagcacctggaacctcaacccggatgcctcctatgtgtattattgcgcaaatgaggtggtgcatggtgtggagtttgactttataccctatgtcaaggkagcagtactggtttgtgacatgtcctcaaacttcctgtccaagccagtggatgtccaagtttggtgtgatttttgctggtgcccagacgaatgttggctttgctggggtcactgtggtgattgtctgtgatgacctgctggggtttgccctctgagagtgccccttggtcctagaatacgaggtacaggctggaaacagctccttgtacaacacgcctccatgtttcagcatctatgtcatgggcttggtcctggagtggattaaaaacaatggaggtgccgcggccatggagaagcttagctccatcaaatctcaaatgatttatgagattattgataattctcaaggattctacgtatgtccggtggagccccaaaatagaagcaagatgaatattccattctgcatttgcaatgccaaaggagatgatgctttagaaaaaagactttttgataaagctcttgaacttaatatgttgcccttgaaagggtataggtctgtgggaggcatccgggcctctctgtataatgctgtcactattgaagatgttcagaagctggccgccttcatgaaaaattttttggagatgcatcagctatgaacacatcctaaccaggatatactctgttcttgaacaacatacaaagtttaaagtaacttgggtatggctacaaaaagttaacaaacacagtattttcctcaaatgaacatgtttattgtagattcttcttttttgaaagaacaacagcaaaacatctacagctctgtaaagctggtgggaactaatgttcaccttaattctgacttgaactggaagcattttaagaaatcttctcattgcttttctaacaaattcccgcttgtttagcctttgctgctactttttctagttagatttccaacttgcctgtggacttcatactgcaagttgcaattaattatttctagagtcatgggaacacacagcatagagggtaggtggggccctctaggtgctgaatctaaacatctgtggggtctcctgtgttcagaggctgttgattcaaggtcaacattgaccactggaggagtggtttaagagtaccaggcaaagggcaaactgaagattgatcattatactgttattacaagagaagtgtcatactttatatatgtttatattagcaaggtctgtttttaataccatatactttatatttctatacttttatatttctaataatacggttatcattgatacatgtagacacttttagaatttattaaatccttgaccttgtgcattatagcattccattagcaacagttgcaccccctccccagtcttcctcttcctctttttaagctgttttatgaaaaacatctcgaagttcttgattcatttttaccgttctttccataggtagaagagaaagttgattggttggttgtttttcaattatgccattaaactaaacatttctgttaaattaccttatcctttgttctcctgactgttttctttgtaatgtttgacgatgagagtgatactttgctcaaaagtctttcccctattgtttatctattgtcagtattttatgttgaatatgtgaagaacattaaagtcctaaaacatctaaaaaaaaaaaaaagaatcacctaggatggaataagatggaaatgatagcaatgaaaaataaagttgcagttacagagttttgagtttttctactttagattacattatgtacctactaatgaagactaagaagtttatttcaatattaaaaacgtctccataaataatgaaataggaatgcctgatagtatagctaatagttagcaggtaaggatatttttatatgtttacttttaaaaatcaaaatgaatatcttaactcagttttggtatcaaatggctcattgcagccatttagattcttgaaggtaaattttactctgtgctgatagaaattttatgcatgatttgctgatagtttaaaaaaaagctgattttttttcttgcatatgacaaaagcaaaaaatacaataaaatgtctttgcatttgttaaaaggctgagaagaatttagaatggcaatattactaagaatacagagtctataattatcacttgctagttccaaaatacaaatttttctagagttttatttgcaaattatatttctctggattcaagaaatatgcaagagaatagaaaagaagaatgagggagagaaaaaagagggagggagagagagtgagagaaaaagaaagagagagtggggaggagggggaggaggacgagtagggtggaggtagaggagatggtaaccagggaaagcacaatgtctcctaatgctacgctctgctgtggctaaaagataagaaagactaagcaaagaattattatgtagtcttaaagaattatttccaatgtactttgcatgtaacacataacatctaactactgttagttgaaggctcgtattccttcctcttcccctccctctctcgtatcactttctctttctcttggtttctctttctgttctttgaatatttccatttccttttttctaatagcatgcagtctattcacctgaattacaatgtcatgctgacttaagtctttttgtttctttatctttcagaaaaaaattcactgtactatagaaaatccaaattaaagtaagaaattcatgaggcattagtgattctgattcttatcaccaatatatagtggactctttttaagctatggaggatcttttgaaggacagtggaatatttatcttgcagacagattgatagtagaactgaaatagtaatgaggacagtttatatcagaacaagtacaattaaatttggttataaaatttgtaggttacatgggaaatatttctttcttgttaaaaggtatatagtatgttaagaacattaaaagtttcttattacagcatttcagatttgggagaagattaaagaatattgacatatctaactttgagaatctaactttcattttcttttgaaattctttcagtattacagcactcttatgtttattatttccctatgaaacatttctgaaacatctgctgagttttaaatattaagagattttaatattacaagaaatgtatggtatactcttgaggtaactttaagagctgcttcttattactaaatatttgtaactgttattatttgtagatattagttcaaatatacaaaatatatgtccccatgaataaaattaatactttctatgtatttgaaaattacattttaagttatttttatgtagcacatttgccaaatgcatttcacttactatgtgcagagaataattgaaagttgtttggtggtgtttttattcagacatgataagtacagagaataaatgtcattcaaattgtttgattcttccattttaactttgagtagaaattgaagttaaaatttttttcttgacaaactgcagctaaagttcttcaacttatgccttttgtttgcaaacattgagggaaattgcccataaatgttcaggtacctgaataaattaagacctaatgtgcttgaagaaagatgttttaagagtatccttttggggtgatgttctcaccaatttacatgcaagagtgaatttgtatcatttaaaccaattttcaaaatgtttgacaaagaccagcattatcttctgctcagaagcctcctctaaaactattcacattgttcacagaaatcaaactgctgagtttcctttagctccttttaagggcttttgatccttatatggatataagaacctgttttgcatatactggtagacaaaaaacatgaatattaagccattattttcacattagcaagttttcccaaggtgggtttttaacattttaaagacattttgttttgtgtgttactctctttttgtctaatcacctctaaaattatgaacactacaagaataatacatactgaataacaaaacagcttgaaatatttataactaagaaagcaactgttaaatgttcataaacaaagttgtttggagactcctttattaatttttaatttatcttcagtcaatttcttattacttccaaattcctgcaggggattctgttaattagtcttgtgtaaaatattcattaaaaccagctttctattttcttcttttattgcaaatttacatttctaatcttataaccaaaataaatgccactgggtagaggaaccatattaatttggatcagccaccaaaaatagaarctcatacagcaaaagatatggtaatataaaatagactaacattgaggtactttgttgattgatcaccattttgcaatagcagatggatatctagtccttgtttgaaaaaatatcaacactacgtaaaatagagtgtatttgaaatctagtaatctaagatgaagtaataatgaattggtacctgtatacttttgcacattaaaaacatttcagaaacaacatatagtttagttagggattcaaatttaatcaacagcgacaatgttgacattaaatttaaatcattgggtagcaaaagttttactgagttttttcagttgttatttgttttaaaatattttacttgtctttccttactatgcattatgtagttttgattctgtgctgcaaatagcaaagtagtataggaaatggaacatcaatgtgagtttagcattactaatatagctgttgactttccctctaacatagtgtatgttagtagaacattcatacaaacatctctaaaagaaatatatgtcagcattgtaagaaaagtttgcaatgccaggcataatattttcagagtgaaattcttggtttcgttgaaaactcttagacttctaagggtttggatacatcttagaaatatgagtttggctacatcttagaagtctaagagtttggatagaccttagaattatcttaacataactcatctcttcttaaagtctatgtccaaattttaagtcttcagtcattaattaaaatatgtaaaatataactaccagattagaaagtttactaaaataaaataatattatttactggaaaaagtggggaaaaatgtattttataggaagaaaaatgtaattacactcaaacaaatagagcacattttgtttactcttatgcggagtgataaatttattgccaaattaaagtcctcatgagtgacaacacatttacagcatagaaacatttagtaacagtaagcacaggtctcaaggttctaactctgtcttctgagattaagtcaaaaaggaggcaaagatttaggtagcacatactgcttcaataacaaaaccaactgaacaggatgtttagaattatacatatcaacattaaaaatatatttgtttaataaacagaaaacctaatagaagactgaattttgggaagacaaaatggcaatattgaaccagatctctaagtaatagatggaaatatattccaagaaatagttaattgtagtacccaatggccaatcattacagtccacgtgccaggttaattttacctatcagtcaacactcttttgaaatagttattctcctaaaatcccacctaacctgattattatctagcctgcattgacttctacatcttgaacacaaaaatattgtcattccatagtaacatacacatctaaagtaatctaacttatctaccagtctaacattgtaataattttttaaatgttgacttaacatgccttgctggcaaagaatttatacttgctctccacacgttggcagtcatgattgcacagctgcatgatttttgagtcttgaagcagtccaattatcaagtattccctaacttatataaagccctttaccatatcttagaatctcttctttgtttgagtctataatttcccttgatcatgtactctgtttctagtttgaaaatcatccttggccgcgcatggtggctcacacctgtaatcctagcattttggaaggccgaggcggatgaatcacgaggtcaggatatcgagaccatcctggctaacacagtgaaaccctgtctccactaacaaaaaattagctgggcatggtggcgggcgcctgtagtcccagctacttgggaggctgaggcaggagaatggcgttaacccaggaggcggagcttgcagtgaaccaagatcgtgtcactgcgctccagcctgggcaacagagggagactctgtttcaaaaaaaaaaaaaaaaaaaatcatcctcatgtcttagatggtggagtgagcagtaacaaaagaagatggaattcaatcctctcttttacaggtgaggactttgaggtcaagcacacgtatactcagtgaactgagggtcagctggacttggagccacttcacatgctcattctccattaaaaaataattgaaagtaaaaaaagaggttggacagtgtgtatgagtgagtgttctatgagaagaaaaataaaaacacgtgggtgtttaagttctacctcaacccttaccctgaggcaaatgtttaaagtttcctcatctgaaaaaggcaaaataatttcctgctttgtttccacagtgctgtgaggccccaataatacatacataagcatactctagtatatcaggataagttataataatatagtcaattacaccatctgtcccttgttctatgagtttttcaaaatagtcaacatagcccatcgtgttgctgaacttctcagttactgaaactcctcagatagttatttttctaaactttatttcagacaagatataatgagtttttgtataaccactaatgttttttccctaacatgtctttgttttacgctcagtatttaaaaagagttttttaaaaaacatgtgcatgtgtgttttacaggaatattgaccagtttagtttcatgtagaattgggatgatagctttcccaaagaatcaataacaacactgtctcagaaatgtaagaattattttttttttctgaaaatatcctcaactgtatctgaaaaacactttcaaattcaatctgtggttcctttttggatacatctccccacaaccagagagtttcccatttaaaatattgccatatgcagcaggctcttgctcctgaaaagattgtgtttcatctttaccaaaatatattcttcatttattttgaaacaaagaaactgtgagcaaaggcagtgtcttttaataaagaacatctaaattttacactattctaaaaatgttttctctcccatctttcaatagctaataggaagctgagtattttgaaaacaaaacaaaaccaaacaaaatggcacaatgtaacttggggaaatcataaaatatattttgttttactgtatgcactatgaaaatcaaagcaaactacagttattattatgaatatatctggttgttccaatagatttacatgaaatagttgctcataaagttatatctcaacagtttcaaaagtatctgctatcttaaatatttttaaggaaacgattagtgatcaaatgcatgtaaaaattattaaaagggcagtttttattaagatattattcatttgtttctgtttttatatttgtaaagaattagcaattatatacactacactaaaacatactc

SEQ ID NO: 12176 - DNA, 43922 bp, Homo sapiens
ggatagtaatactgatctttcagggtcttgggagaattcaatgctataggttacacgaacccacttggcatctgctgggcatgcatccatagagtattggcttttagaggcctccagagcaggaagggtagtccactgggtgggcttccatgaagattgaatgtccttccagcacagacagcttttccgtagctgttttcttcaccatgatgtgaacagaggaatcacagattcctgggcaaggcagaaaaaggggctctccaggatgaagatccctgctggggcaggaatctcatgtgtcccatgatgttgaaataatgaccccttgccaaaaaacaaaaaaaaaacaaaaccctagactaattaacagacagacaaaattcctcaaggcttggggtcctgtctggttctatctcccttccctatctctaccctcagcttggttcagattcctagaagtcaggggatcacactgggcaggctaggaaatgaacaatgttgcagcagaaagggtggcagggagctgcacttcctgaaacagatccatggtgaggactgtggaactcagctggggaggcttcttgacaatccgaagggtaccctctagctaagatggcactccaagagtagccttgaggtacccaatctgctccactgttaggagaaacaatgggtgaaatattaaaacaagtattgaaatagaaaagtataaagatgtagccagattttttaaatagtatgagtatctccaataaaccagaagtggagcagaagcataagaatgtgtgaggcaggcaagagatcctgtagccagagtcctaagaggatcccagaaaggcctggacatagcaggagaggctccatggaggagtatggacttgggagaaggctccatcttgatgggcccatggggatctactcctggctggttgctactccagcaggcttggttttatgaatttggggagaaatgggtctttactttcaaggtggccctgaggccccaggaactgaggacctcagagctagaggaaaccctgaagagcttctctctggggcaaggacagaaggtggggtgaagggtaggaagaggaagcacacagccctccccactctcaagtcttctcatctttccctggaaaatctgattaggtagttctgcatgggacctggaaatttgcattttaatgagagcccaattacgcttggtaagttccatacttctttaggctgcctctctgtgttttaccaactatgagtctctacaaaagtccctgggtgtggatgagccaatagtgcctggtcctcaggattcccaacatccctcccactttctccttcccatgcaatctgctacctctctattacttactgatcatagtcccgactctggaggatgcctcacaaagtccagactgtctaatcagggagaccgacatataagaagataaactgccctggtttgctccaggtgtttgtaaagggaggggcagactttctgtgggatctagagaagactttgtgcagtgggtgattttgagctggagctggcaggatgggaaggagtgtgtcaggcaaagagaatgagataggtagtccaagccaactgagatatgtgtgtaatcatagagagtagaggaagaaacagcagggtggcattcatttcaacttattgtattttgatttttatttaggtatagttcacataaagtacacaaatatttctgcccactatttcttcaaatttttctgttctccactgtccctcacttttttttgcctaggactccaattacacatatgttagaccattgatgttgtcccacaagtcactgggacttgttttttattattattattttccagcttgctgtcttcagtttgaatagttcctattgatatgttttcaagatcacagatcttttcttctatagtactaaatttgctgttaaacccagccagtgaatttttcatttcagatattaagtttttcatctctagaagtttgatttttcccacattacagtaacatttttattatttaagcatattttaagtaactgttttaaagtccttgtctacaaattccttaatctctattatgtctgagcctgtttatattgcttaatttttcttctggtcatgggtcacattttcctagtcctagaaggtctagcaatttttaattggatgctggacatcataatattacaattttgttgtcttcctttacagtgtttgacatttgttttaacaggcaatacgttacttacagatctgtttgagcttgtcaaggcatgtttttaaactttgttagggtgggtctagtgcagctttaattcaaagttagtttagccctaatgccaagatgtgacacttctgggtctctactgaatgttccaggtctctccactttgggtgcataaccttaatatatcctatgctttgtgaactctggaaattattttgcttataccttcacagtaggtttattttttcgtgtgtgtgtgtgtgtgtgtgtgtgtgtgtgtgtgtgtgtggaccagccatgtggaatttcactttatgcatgcagagcttagtacttagctttggacttaaagagacccctatgaacatttctaaagctctcctctagtacttcactgcacaaattatagcttcctcagttttctcaaactctaatgtctgtctcctaagctcagcaagcctcccatgccctccttgggttttcttccacacgtccagaaagtatccttaggcagaaaattgggacaattgtagagcttatctcattttttaccttccctgcctgttctctaatgtctgaattgttatatgtatttttcgagtatctcaatagtgtcataaattttgtctagttttctgtttacaacagtttgcaaccaatatcagttactttgttttggccaaaagtgtaagtcaactcaaactttacatatatacctgtgtaactttaccttaagtagctacaggactttccatcaccctgagttccccttgcttattaccagtcaggattactcttcaaagataaatggattatttcattttatttcaattcatttattcttttagcaaccacttactgaaccatgagtattggccaaagagtgggtgcacaagtagacaaaattaaggtagacaggatccctgattcatgaattgttcagtcacacaaataaatgtgaaactatgacagtgataagtgtttcactgagaagttgatggtactataaaaatagctgctgggagaaagttttcttatttcagtggtcaaagagagtttccttgaggaaatcacacaaactagggcctaaataatgaataaaaattaattaggggaaaagtcagatgaagagagttggaaggatattccaggagtaggaaacaacaaatatcacatgtgagcataaaaaaaaaatcagcagaatgggctaacatggatgtcaagggcaaggggcttcatgatctgtgatgaacttagaggagcccgcagaggccaggcaatgcaagttaagacttcagtgtttactttgggaaacgggaggcaattgagacattttaaatactaagtgacacagtcaggtttgagttttaaaagactattctagctgtcatgtgcagagtgaattggaggagcaggacagggtatgcagagagagctgttaggaagctctgtggtagcccaggcaagacacaatgacagcccaactagcctgctagagtggaggcagagaaaagtggatggacttgagcaacattcaggaggtaaagttgacaaaactgggcataagttgacatgaagaagaaggaagtgcaaggatgcccctcctaggctcaactaaccaggtgaatggtggacccagtgacagaaatgttgaaaagaggtttcggttgtggctgttgctgggagatggttcttgggaaggagtctgagttcactgtggttcatattgcatgtaaggtttatttgcaacatcaggaggagatatcaagtaggaagttagacatgtagagatcagaggaaaggattgagctggagaataaaaataatatatcatttgcatgtctagctggagaataaaaataatatatcatttgcatgtcttagtaatgaagtcatgggtgtcgtggcatgagatcagctggagggagaggagagattaaagtgaggagagagctacaaccaagtaagcaagtgtcagggctcaccaaccatgcaaggacagggcaggagaagaggaacctgcaaaggtgggtaaggaggaggtgcagagagatcgggaatgtggtgtcactgagccagagggaaggactggatcagagcatggtcttcagtgtcaaatgcagctgggaagtcaaataagatgagaacctagacacattagttggcttttagtagcatctgggtcacatttttgtggatacagaagccaggctggagtggaccagtgagtgagttggaggtaaggccacagagaccatgaatacacagctcttgaaaatttgggccacaaggggaggagtattgaaatagggcagctgctagaagcaaatgagagggtgaaaggagtgtttttgttgttgtgtcgttgttggtttctttgtcttaacgagcaagacttgaacagtttccaaactaacagcaaggatcagcttgagagggagtgtttaagtgcagaaaagagaggtggaagggtcctgagatggagagaagagatactttctaaggcccaggaagggggactggacctcaaaggagggccgatcctctgctttattggtggagtggaggtgtaggggagagagaggggcgactgggaaagtagggataggcagagaggatgccctttgagggaagttgagacaattccttttcataggatctctcttttatgtgagataggaggcaaggttgtctgctcagtgtgtgtgtgtgtgtgtgtgtgtgtatgtgtgtgtgtgtgtgcacatgtaggcacacatgcatatgtagcacacatgtagcagggtgggcatccattccaccctggaataaaaaggttaaggacatggaaaaggtgaagcttttccctgaaaatgggagagtgagctgatgagttacatgttgccgggtggataaaggctggtggttgggaacccacagtggacgaggctgccttgcagaacccctcttccagcagcacttggcagggaaggagcagacaggtaggttctaccacacatggagccttgccacagggctgggacatgaagacacaggcctgggggtgaagcacagtagattaaaatgaagcccttgacacccaagctggataaagaggcaaacgaagataggggatggggtggaattgaggaatgcaaacagctgggtcctcaaagatgcagctggggaggtgagtcagggcccaataaataaagctcttgaatgtcaggggcttgagcattttttctgagctcaatggggagccattgaggaattcgaggygaggtgagtgatacaccagatcagcatctggaaaggtcaccctgtctgcagggtggaggagcgcttggagatgggagtgagtgagagacaatggaaggtggaatgcaggctgtggtagctgggagggagaggtccagaagaggcaagccctggggacggcagagtgtccctgtcaccccaacgagcagtgccccctggccgaacgctcacataaacccgggccacagccaaaagaggggcaagggccttggcagggctgggagagagaaggggtggccacaggaggacaggagttcagggtggggagaagcaaagtggggagtgtggtggattttaagagctgactgaatgagctttggmcacggttttcccccaagagagcaatgacctgggggccctcagacatagatcccagactcagaagagagggccttttgagaccacctcttcctgaagtcttgtgaaaagcagagacttacctgaagtcacatggaggccagtaccatcgatgactcrggacayttactagccaactccccgacttcaggtgggtctcccytactcaacccaagcccaaaagaaacaagacttggggcgtggaggccgcgtctaataggccacctctgctgatgggaatgcrgattctttaggaggcacaacccagcrtcagtgggggccccctgagagccacctrccccactgccagcctccacagaaaggggcacagacccctggtgcttgtggcatcctggcgcctggcagcacccgcttcccctccatgtggctgatgtcctcttccttcaacctggtctcctctcccatggtcatgaatagccagggacaatcctattccttcaccctgattccaagggagggacacaaaatcataagagccacaagagagatgcagctttggtctcctgcccaccatgggctggatgccgcactgggcgttctgcagacgttgtctcgcccttcctcagaactgccctccttacagatcagggttgacgcaattcagaagatgaagcaattcgaggacaatgctgttctctaaacagaaagtactgctctgaggttaggaggggaaccatgatcttgcttaggctctgacttctgagtggccgtcaagatcaagtgctgccacttcaccattgaggctagagggcctgcagaccccaagttaacacagtagaccccagcttgtcacagggaagcctgcagatgccacactcttacacggcgtcctgaagagccccagtctgtcacagagctcatcaaataagagaaactcagggtttcagtcttatattccaggaggcctccttcatttcacctccctggttttttgttgttgttgctttttttttttttttttttttgagacagagtttcactcttgttgcccaggctggagtgcaatggcctgatctcgactcactgcaacttccgcctcccgggttcaagtgattctcctgtctcagcctccggagtagctgggactagaggtgcccgccaccaagcctggctaacttttgcatttttagtagagatggggttttgccacgttggccaggctggtctggaactcctgatctcaggtgatccacctgcctcgaaagtgctaggattacaggcgtgagccaccgcgcccagccaccaccccagttctgaggctggtgtwaatgcttctccatctcagggcagcmcaccaagtgtctactgagcccatacattgggcacttttccgtgctggtgggggaagggggaaggaggacaggaagcaggtgtgtagagcaatgaggaacacagacaggtgcagggatagtcttgagaattctctgctgctgaggttctctgcagccatcccccagtgggttccagggcacagaaccaagtccgcacatccctgcatggggccccctctctcggcagctggtctctcctgctccccagcccttcctgccggcttctgtggtgctgaaatctgtgtcagaaccttttctgttcctcaaagctgcctggctctggttccctctgggcccttgcacaggtggtcctcccagcctgaatctctctcttctctgcttttcccttttaccttgctaacatttttcaagtttcaatcagctgccacttccactggaagcctttcttgttatggaataggtgttcccaatgcctgtacttactcatcacacacacacacttcttgtgtctagtggtgtttgctaattgtctgtcttcccagtgggctccttaagaacaaggaccctgtctctctgtccctcattgtagccccaacacctcctatagtacctgcataataagcgtacatgttcaacccaatggaccaaatgcataaattacacattcaaagaacctagagattatctaaaggcaygcgtgtggtcagtgataatccatttggtaatagaagtcgagtaaatttcagaagtgccagaagagagaagggagagagtgatgaagtcacaacaggagaggggagccagggagggcctctcaagccggtaatagctaagtagagtcttccagagtgagaaacaagggcttttccattagcaaaggaaggtggcatccaggaggggcatttgtagcagagtatgctatgcctgagcaaggggtaggtgagtgggaagagaagggagggaggtggaccctgggctgttgctaytggtgttgactgcagaggctgcagataaattcactggccagcagtggggccgaagagaggggaagcagtcaactctcaaggccacatgtcatagggttcccagagaactctttaagagccaggaccctggctatctgtcccccattgtagccccaacacttctatctcccagtagatcgtctctgtgcagagtcaaattggtgaagtttcttaagaaaaacgttttgaggaagcatgaccagaggagggagatgagtccagaagccttcaggattgtccaggggagagataaggagggtttggaccaagggaaaagcaaagagatggagagaagctggggcttgcgatgtctcggggaggaagaacgatgtggggaaggagggtggccgaagagtgcagagtggccatcagtctcctgacttggaagatggcagcatgggtaaaatggccttcttggagaaagggagagatggggcactcagggtgggggcagctctggaggtcagttcagaacaggttggcaaagagtccagtaggtggatggatggatgcgaatgtaacttagaaagaaaattccactttagtcaaacaggcaaatacaaaactacacaacagaaatcgccaatcacataagtggaaatggagagaaatgaacagktttgcaaaagaattactcattcagtaaaagggttctttataaagttccatctaagttaaattatatctggtataataaaatgtgattcatttacatatttcatttccacagagaaattgttgggaatgtggctgtcacattatgcttggtctgacatagacaagtgactatgtgtggcaatatttttgtcgcttttggcaaaggttctcttatcttttccttctccatttctggcaaaataattgttcacttattgactgaattcttgttccagtgggtaaagtctttccttcacaatcaggagtaacacttcatgccggtgctcctaggagaagagttggtggcagccattcacactgtagtataaatgactaaagagcaaagtctgatgaagggcaagggggattatgaaggcactgtgcttgtgaaaaggatgatggggggaaggacatccaggtcatgggggggaaattataaaatttgtgagragagaaaagccttcagacggatgtgacctattggagcacacacctgctttgctttcccctctggctgagcacagacctcccctggccttgcattggattcatacaccttccttctctaaaatgaccacttactgttgtatctcagggtcaaygcacagggttggagctcctctgtaaagttgtgttaaaggaaatgaaatctttctgatgaaactgaacaggtgagggtgctgtaggcagggctggggagacctgtgagcagtacttgatagagttgctccaatcaaattctctctgacttcaacaaaacaacagtaaaagtaatgtattcagcgctcaccatgtgctgggtcccgtgctgcacaatttgtgccttatcacactcagtcctctgaacaactctgtaaggtaactatctctgttttacaaaggcraaacagagaagtccagagaggttacttgtccaccacgaatgtcagggttagattcaagcccagccctgttggggtttgaaattgctatcaggtcatttagtctgaagtctccttggggccaaagccatgtcagctgaggcttgaaggggaagcagacagatgtgactagaactgcarctcatcagcaactgactgccagtgctcagggcacctgamggagcacagcaaaaaggacagccttttgctccaggtttccactttttgagagatatgaacacattagtaaaatgcctgtgtctgggaacaggcagccagggtgagaaaataatcagatctacacaaaatggataaagaatgtgtggagggacctccaaagggtgagaaaccacttctggctgctaatgcaatctgggttcacatactcaattcttaaaaaataagtccatgaagcagaaacatcaaaaagcatgggatttggaatttgagacctgactttgaagcccacacagaacacagacaagtcaaycatgctatttggggtaagttgcacagactctctgtggcctgtttactcatttgcaagtaaaacagcaataataagatctacatcawgggaatattgtgaggctcagagattatgtgagagagctctgctaactggcctatctgtcctcattctgctgctgatggcgtgggggtgttaaagggtctctgattcagggcctggaccctcagtttaccmcctcaatggttcttacttctcttgcagacatattttgttccaaaatggcatcttacctttatggagtactctttgctgttggcctctgtgctccaatctactgtgtgtccccggycaatgcccccagtgcatacccccgcccttcctccacaaagagcayccctgcctcacaggtgtattccctcaacaccgactttgccttccgcctataccgcaggctggttttggagaccccgrgtcagaacatcttcttctcccctgtgagtgtctccacttccctggccatgctctcccttggggcccactcagtcaccaagaccsagattctccagggcctgggcttcaacctcacacacacaccagagtctgccatccaccagggcttccagcacctggttcactcactgactgttcycagcaaagacctgaccttgaagatgggaagtgccctcttcgtcmagaaggagctgcagctgcaggcaaatttcttgggcaatgtcaagaggctgtatgaagcagaagtcttttctacagatttctccaacccctccattgcccaggcraggatcaacagccatgtgaaaaagaagacccaagggaaggttgtagacataatccaaggccttgaccttctgacggccatggttctggtgaaycacattttctttaaaggtaaggatttgagaagttgatttttatttatttattttatgatgatgatgatgatttttgcttagtgaaatacacaagccagacaaaccctagactgcagggtggagaaatgggagggcctgagctctaattagctttgcaattagctggctgcaggacctaggatagctcatgtttaccagttacagtagggactcatttagttctctttgggtagacagattaagtgtcttgaggtgtgtttacatttgactcagtgggaaacccacaggaaaaatctggagactacttgagagaaaagatctcttgccaccagcagctgtcccactgccccttgaaagttttagaaagaaacatggaactctctgacaacccagtttaagaagcaaatccaagagtgtgaacactttcataggtgtagaaatgtagacaagctgatgtgcctgtcattcgtatcccttatatatatgaagtctccttcatatataactgcatatagatatagatatagatgtagatatatgttagagctttacagtttcactgtattgcagggaatgcacatcagctttaaagtcaaacaacttgaatttgaatttcacctctaccccatacttgctctatgatcctcagcatgtgtctctaaaagatttaccatgtgttgagtgcctgacctgtgccagtctctgtgctgactggatactctgatgataaagccaactttataggttgtgcttgagatagaagtgcctggcatctccaggcagagttttcatggatgccaccgtatcatccctcccttcctctgtccctctccttcccttccttcctccctcccttcatccacatgttcactcatttatccatgcactagtttatctgtccatccatccaggcatgcgcctaaccaaccagccagccatctatccattaacgtattcatctatccatctacccattcaccaagctatccatccatttgtccatccatcagttcatccatccatccatgcatccattcatccacctagctagccaaccacctgtccattaatctattcatgtatctatccaccctatatctgcccattcaccaaactatccacccatttatccatctgtcattcatccatgaatccatgcatacatccatctatccacccagacagccaaccatttatccattaacctgttcatccctccacccttcatctacccatccagcaaactatccacccatttatccatccatcagttcatccatctatccatccatccatccatccatccatccatgcrtccattcatccacctagctagccatctagctagccaaccacctatccactaatctattcatctatctatctctctatcggttcatccatccatccattcatccattaatccatctatccacccagccagccaaccatttatccattagctattcatctatccatccaccctccatctgccaggctatccacccatttatccatccatcctgcaaagaggaaagagaaggaaagaaaactggtatggtttgagcccttactaagttaccttcagtttatgttgttctatttaactaattctatttttaattgaaatayaattcacatgtcataaaattcaccattttattgctttttagtatattcacaagtttgggcaactactccgctgtgtaatatcagagcatttttttgtcacctcaaaaagaaacctcatacccactagaagtaattccccatttcagtttgctgtctttgcctcactaattgtactttgacataaagacttcttttctctctttgtgctagccaagtgggaraagccctttcaccytgaatatacaagaaagaacttcccattcctggtgggcgagcaggtcactgtgcawgtccccatgatgcaccagaaagagcagttcgcttttggggtggatacagagctgaactgctttgtgctgcagatggattacaagggagatgccgtggccttctttgtcctccctagcaagggcaagatgaggcaactggaacaggccttgtcagccagaacactgakaaagtggagccactcactccagaaaaggtgggcatctgtgtcaatctcctgggccctgaggcaggggatgcacacattcaaaratgagggagagawtgtgctaacagctgttggataatcacttctgcacagtgagcaccaactgyatgcaggacagagagcctggggctgtctatacatgttcacacttgaagttcactatcacctgatgaggagtcttagtaccactcattacacagatgaggaaatggaggctccaaggggtaagtgaattgcccaaggtcatgtagctgttatatgcttgcagagctggctctagaagcctatctgatattgaaatctatggaatgatcccataaaagctagcaaacaaaagcattggtggtcacatataagaaagaggataacaatattaccaaatccaaaggttggtgaaaaggtaaagtaacctgctacttacaaagtgcttagaagaattcctagaagatagtaagtgttcagtaaatgctagctaataatgttattattagttctgtaattagtatggtgagtayaaaaaatatggagaatagcaaaaagattaatcatgagataaaaaaggaatgtccamgttttatgttctgtctcttagcaatatatttttggcatcttagaatgattttagcagcgttccctggtgctcatagtctgggaagagagaaggaaggctgcagtgtaactggaattcaagaaagagattgrgcaatgccccacgggagggcaggaaaggtgctgaggagtttctgagcagagagagatcactttcagctgggactgagggacagcttcaaggaggcggtggggtttagctgcacatgtgggtagcatatgagcacacagaggcttggcaagggcagctttggtagaggacacagcactggcaaaaactcaaagttaaggatgaagagatgctgcagggtgtgtcagcgatttcttctcttctcaggctgcatctggggctggggataggaagaggaggtggcacagaatttcagggagggagggacagagtacagagcagcagatggagcacagagaaaacagggaaagaggacagtggcagggaaaagagagctgtccctggcatgaggggtcacaagacacctgtcagatgaggactgaaatgtgtccatccaatatttttgtgctttcgttgctgtgagtcactaagtacataaccttgggcaaagcactaaaagtaagctttaccgtctttaaaagggggaagtgttgttgaatgtgcctgggacaatgtctggcatataataaatgttcaggctggactcacgcctgtaatcctagcactttgggaagccgaggcgggtggattgcctgagctcaggagttcaagaccagcctgggcaacacggtgaaaccctgtctctactaaaatacaaaaaaattagccgggcatggccacgtacacctgtaatcccagctacttgggaggctgaggcaggagaaacacttgaacccacggggtggaggttgcagtgagcagagactgtgccattgcactccagcctgagcgacagagtgagactccatcttaaaaaaaagaagttcaacacatgtgggctgtttactcttggttcagggaaaccattgcagaggaaaaaaaatattgtgctaaattatcaggtggtgctgttcaatatagtagccgctaagccacctgcagtaatttacacttaagttaactgaaatgtagtaaaattaacattttagtttctcatttgcacaagccactgtttaagttgctcagtagccacacatggctaatggctaccgtactggagagtgcaggtctaggatcttcccagcatcacaggaagttctgctggactttgctgctctagggcattattagcagggcttgcatcaggaagtgctgctgaggaggtattccggacagtgagtgggtggttgatgagcttccattgctactggacgtctcctgttggtttctgccatagactcccttgctgactgctttttcacctctgcacccacttcactgggggctcgtctatctccttgcatgtttttagtgctggacctgctcagctgggaggcttatttcaagagcaacctgggtttcttggctaggatgtgttgacctttttagcagaaattagcagtggttggaggaagaacggagtctcccaaaatggcatctaggagcagagatgcagacaccatgggcttgtgacctcattgtttccttttccctactccacaggtggatagaggtgttcatccccagattttccatttctgcctcctacaatctggaaaccatcctcccgaagatgggcatccaaaatgyctttgacaaaaatgctgatttttctggaattgcaaagagagactccctgcaggtttctaaagtgagttgaatgaaaatatttgcaaaamagtccaagctggaagcacctgcagaattaatmacaygctcttatttcgttgataaggaarcagaggcctgaaaggtgaagtcagggtcttctgcggccagaagaaccgaatcttgcggcctatggccaccatccctctggcatgcagcattgttatccctcttcacacaaatgttccgaagccatcctcagcagtcaggtgctcccccatgcctgctgcaggagagcaagtgctccctcaggatctgacctcactttcttcctccctgaagtttaggccctcacacaagcatcacagtgtggctgcccataggtcatctgcaccctgtagatgtgttgtctggccttcagtgtgtaaggagagagagagggagagagagagagagagagagagagagagaggagttttaaagcatagtatattagatctaaaagtctagatttctgatcctcttgaaataaatcactaactctaattcccacatggcaacagtgagcctatgtgtccacatggcagccatcacaggagctgagctatgagtgccccttttaaccagacagtatcctccaggtaatgtgggcaccccatgctcttacaagaagtctccgtcagttaattggggttacctgcctagcccctgcacacatatgggttactgatccctgacctaaaattttattttgatagtggattataatagaagtgatcctggggccactgaaggggacctttgtcattggttttcagaaaatgttgagaggccccactggaatatgatgaacataatggacattttctygaggaaagtgtatctgtgagcctatgaaaaataatgcctgtagtcacaggagctcaagcctccctgaagcttagaaatccaggaactccaggttaagaatctcttccctagaagacaaagaagggatctaaccttagtcatatcaaacccatgtctgccatgcaagaactgcagcaattactactgctggcaagtccacaagcacttgctttgtatgatctctcttaatttacacaataaccttacggggcatatgcagttattattaccttttatagatcgggaacctgaagcacgcagcaycttaataattttgcaaccataagtggcagaactgagactcactccggtcttcctgctctgtgtttgtaaccatctcaatcccggtgtaaggaccaatgggccatagtcaacacccactgcaatgtattgagtaaacccaatgccaggcatttgaaccttgaatcctttcaaggtagacatcaccattccagggcaaaarcactcagtttagtttactcagttaagtaaaagtgtctccactagggcyactgatgtttgtttttcccttggcaggcaacccacaaggctgtgctggatgtcagtgaagagggcactgaggccacagcagctaccaccaccaagttcatagtccgatcgaaggatggyccctcttacttcactgtctccttcaataggaccttcctgatgatgattacaaataaagccacagacggtattctctttctagggaaagtggaaaatcccactaaatcctaggtgggaaatggcctgttaactgatggcacattgctaatgcacaagaaataacaaaccacatcmctctttctgttctgagggtgcatttgaccccagtggagctggattcgctggcagggatgccacttccaaggctcaatcaccaaaccatcaacagggaccccagtcacaagccaamacccattaaccccagtcagtgcccttttccacaaattctcccaggtaactagcttcatgggatgttgctgggttaccatatttccattccttggggctcccargaatggaaatacgccaacccaggttaggcacctctattgcagaattacaataacacattcaataaaactaaaatatgaattcatctgtcaacagagtcctaatctgaaaatgatttactagcgaactcgcgatggctgggctgtcatcccatgacatctcagaggctgcatgatttttttccttcatttattcagcaaaaatttattgaacacttaacatatgttaggagtaaatcagacagacaagattcctggcctgttaggcctaaatgggggagacagacccccctacagcaacaatgaaaccagacctataaacatgatcgtaagagcttatgataagtgccatgaaggcattgaacaggatgactgagagtgaggataggacaagggaggggtgtgagcatgaaggctgtgagtcaggaatgagtggcatgttggagagacagagcagggaccttgtggcatcatgtgtggcagatggaagaaatgagaacacagaggctcaaagaggtcggctggtggaggccattgttagccaaggagagagtctgggtttgtggggagcgccgggacaccggctgacgagggctaatgcgtgggctgtgaaggtctccccgggtgccgtggaccagtttcccatctcctcgcggctggctgccttcctgactccgatracgtcatgtgtgcacacacagccctccgggtgctcagccccttccctgcgggtttgtaacggcaatggtcccgcttccatactctgagtcctgagagcagcacaatgagcaatgggccacggttgcactacagcaaaggcagctcgtgtcctttgagtcmgacccaccgtccctccttccctcgttgcctgacaggctgtgctggcacctctatgtcacccycattaccgagggcatctctggcagcctcagtagagcccttgctcccatcagatccaaaggctcctcttctgggggccccggtgccccacacacctcggatgtgccagggrcctcatgtaggctttctcatgctattttataaggaaagaaacaaaacagaaaggagttatgctggagagctggcagaagtcccaggggaacctaaccccctggccctcacgctcccactttatttcacaaacagaacaagctgccactgcactccagcytgggcaacagagcaaggccctgtctcaaaacaacaaaaacaaacaaacaaacaaaaaacaaaaacagaagagctgacactcaaagagtaaaaacaactaacctaagccacagggccttcctgtgctgrcttagaacaaggaccaatggccagttatgaagggctcccgcaacgctgcctgaagcaaggtttgttttatacacaatgctcttccctcaggctctccattataaaggccacagtggagaagccaggcatccttcccaggaaggaacatacctgctcagacatggctccagcctcctgcagagtaggcaagaagatgtcctacagtagcacaaaggagatagtaggtgtgaagaagtgactaatgacacttgytgttcacaactagttttttccagaaactatgaggaaccccaagtagtcagcagtgggtgacggctgtcagcatccctccracagccttgcttccagtggcactttacagtgaaagcaagcttaggtggcaacctggtgcccactcagacttgcattggcaagcagatacaaaaacagccgtgggacattttctatcaacttgctgaggtcccagctctgttttttgaaatgccaatccttcgcatttgtttttaaatgtacctcacattttgttttgaaatcatttccactgggtatggtaaggtgacagacagagacatctgcctttgaaagaagagtttattactttgagcacccaagaggaaggggcctgccccaccacacagggccacacggggaagcaccggggctggtccagaggcacaggagcgagaggaacatgtggccagagactttagtactgcagtgtggggagtggttaggtgggacatccctattgggcaggaagtgaagtatagaggttgaggcttgtggttggagaatttgtaaaatgattcttgcatgcccatgaaaacacagagagggcatgaacataatcaactgtggccgttagtttgggccatcatttcaagatgcaaaatcatcagtcacagaatatcaagcatgagtattacagcatcgcatgaaagtttcactcaaggcaagagtggcaaatgcagacccatgggcacctgcacctccaccccatttagggaatcaggttcgacctcctaggagactttatgttttacaagtgccttgattggaaccactgtgccaacctcaatgaccttttattttaggatgagatttacttgtactattaaatcattctactttccaacaataatgttttattgtttttaattatgaataagatgcatgctctttgtaagaaatttggagaatacaaaaatctgcaaagaagaacttaaaagtcacttcaattttgtcatgaagagattctctcataaataaatactcatttaattctaagcttgttctacttacttgggagacatgggtgatcatgagccaatgatttcacttcacaggtttctcaaagtagtaagaagaaaggtctttctctgtttgtgaaatttccttccaattttcttttcgtcacctaagctggagtgcagtggcacaatcttggctcactgcaacctcttctgcttcccaggttcaagggattatccagcctcagcatcccaagtagctgaaattacaggcaccygccaccctgtcaggctaatttttatatttttagtagagacggggtttcaacatgttgtccaggctggtctagaactcctggcctcaagtgatccacctgccttggcctcccaaagtgctgggattacaggcatgagccaccgcacccagccccttccaatctttttattcatacacagatyatattttatttgaagcatcaacaaaatactggaatggtttggtgtggtagtgaaggcttggactgggggataggatccmagttctgagtgtggccccatccgtccacttaatgagcaagtgacttaacctcacagagcctcagtttcccatctacaaagtagggatgactgtgcctctctcacattcttgcggtgagggtgaccaataaagaacgtagcctaaaagaaaaaaaaaagagggggaaaagtggcagacggaaggcaagactagattgcagctcgcacttggacagagcactgtgtggacctttgaaaaaaatttcaaaggttcaacactcgcatcttcaccctttgcttcagaactaatgcaggaataaaccaggaaagccgagagaacccacaaaccctctgaaggaaggaggttgctcctgcagaacccaagagacagtccaaatattgtgagtgcccaagctgtgaaagtgggaaaggtggattktctgtcactgaacacacaccctcactggggcacctgaaggtctagatcatgggagaaggatctgaccttatctggagctgagtcaatttagagagccaagcaaaatataggggtagaggaagcagcaggaaaagcctgtgggttttccaccctcagaaagctatttcagagttgtctcatgggtgttcttggggagggctgccagaaatactgggaaaagaccacagggagaaggaaacccccagctgaaccttgtaacaattccaactgaacaggaagtctcctggccagaactcaagggagggcctgaatctggtgtgcagactccacaggcyrataggcgtgaaagccctacttgttctcataagtgggagkctggtagcctggggcaagttctcagcccttcctgcccactgcctataaacaaacttggtgctgtttggggggacatggtgggagtgagactggtcttttgggttgtgtgggagctgggtgaggcctgtaactgctggctttcccccacttccctgacaacttgcatgacacagcagaggcagccataattctcctgggaacagctccattgacctgggaaccacacccccattccccacagcagacatagcaagccctgcccaaagagagtctgagctcagacacacacagccctgcccccctccccccatggtccttccctacccattctggtagctgaagacaaagggcatatactcttgagagttctaaggccctacccacagcctggttcttcctatactaccacaactgatgctctctcaaaaagtgtcaccttctggcaggaggccaaccagcacaaaaatagtgcattaacaacaaaaactaaggatcttcacagaatccatttcacccccctgccatctccaccagaacaggtgctggtatccatggctgagagacctgcagatggttcacaccacaggactctatgcagacaatccccagtaccagcccagagcctggtagacctgctgggtgactagatccagataacaatcaccacagtttggctctcaggaagccacatccctaggaaaggggtgagagtactacatcaagggagcaccccatgggacaaacgaatctgaacagcagccttgagccctagatcttccctctgacataggctatccaaatgagaaggaagcagaaaaacagtgctggtaacatgacaaaacaaggttctttaacaccctcaaaaaatcacactagctcaccaccaaacaaaaaagaaatccctgatttacctgaaaaagaattcagaaggtcagttattaagctaatcaaggagccaccagagaaaggtgaagtccaatttaaggaaataaaaaaaatacataagaaatgaggggagaaatctttagtgaaggaatagcataaataaaaatcaaccctttaggaaataaaggagagcactgagagaaatgcaaaatgttctggaaagtttcaggaatagaatcaaagaagcagaagaaagaacttcagagctcaaagacaaagttttcaaaggaacccaatccaacaaagacaaagaaaaaagaataagaaaaaaagaacaaagcctccgagaagtttgagattatgttaagtgacaaaacctaagaataattggcattcctgaggaagaagagaaatctaaaagtttggaaaacatatttgggggaataattgtggaaaagttccctggtcttgctagagacctagacatccaaatacaagatgctcaaagaacacctgggaaattcatcacaaaaagatcatcatctgggcacactgtcttcaggttatctaaagccaagatgaaggaaagaatcttaagagctgtgaggcaaaatagtcaggtaagatatacaggaaaacctgtcagattaacagcagatttctcagtagaaaccctacagaacagactagaagggattggggctctgtcttcaacctccttaaacaaaacaattatcggctaagaattttgtatccagtgaaactaagcttcatacatgaaggaaagatacagtctttttcagacaaacaaatgctgaaagaattcaccactaccaagccagcactacaagaactgctaaaaggagctctaaatcttgaaacaaatcctggaaacacataaaaacagaccctctttaaaacataaatcctacaggacctataaaacaaaaatacaattaaaaaagcaaggtatacaggcagcaaatagcatgatgaatggaatactacctcacatctcaatactaatgttgaatggaaatggcctaaatgctcagcttaaaagatgcagaatggcagaatggataagaattcaccaaccaagtatctgctgccttcaagagactcacctagcacacaaggactcacataaatgtaaggtaaaggggtggaaatagacattctatgcaaatagacactaaaagcaaacagaagtggctatacttatatcagacaaaacaaacyttaaagcaacagcagttaaaaaagataaagagggacattatataatgataaaaggccttgtccaacacaaaaatattacagtcttaaatatatatgcacccaacactggagctcccaaatttataaaacaattactactagatctaagaaatgaggtagacagcaacacaataatagtgagggacttcaatattccactgacagcactacacaggtcaacaagacagaaagtcaacacagaaacaatgagtttaaaatatatcctggaacaaatggacttaacagatgtttacagaacattctacccaataaccacagaatatacattctatgcatcagcacatggaacattgtccaagataaaccatatgataggccacaaaacaagtatcaatgaatttaagaaaattgaaattatatcaattactttctcaaaccacagtggaatagaactggaaatcaactctaaaaggaaccttcaaaatcatgcaaatacatgaaaacaaaatgacctgctcctgaaggatcactgggtcaacaatgaaatcaagatggaaatttaaacattatttgaactgaactgtaatagtaacacaacttatcaaaacctctgggatacagcaaaggcagtgctaagaggaaagttcatgaccctaaatgcctacatcaaaaactctgaaagagcacaaataatctaaggtcacacctcaaggaactagggaaacaaggacaaaccaaacaaaaacccagtagaaaaaaaaggaaataaccaagatcagagcagaactgaatgaaattgaaacaacaacaacaaaatagcaaaagataaatgaaacaaaaagctggttcttggaaaaaataaaaaaagaagaccaygagcaagattaaccaagaagagagaaaatccaaataagctcaattagaaatgaaatgaaagattttaaaaccracaccacagaaatacaaaagatcattcaaggctactattaacacctttatgtgcataaactagaaaagctagaggagatggataatttcctggaaagatccaatcctcctagtttaaatcaggaaggattagataccctgaacagaccaataacaagcagtgagattgaaatggtaatttaaaaaattaccaaaaaaaaaaaaagtccaggaccagatggattcacagctgaattctaccagacatttaaggaaaaattggtaccaatcctgttgatactattcaacaagatagagaaagagggaatcctcactaaatcattctattaagccagtatcaccctaataccaaaaccaggaaaggacataacaacaacaacaacaaactacagaccaatatccctggtgaacatagatgcaaaaaatccttaacaaaatgctagctaacagaatccaacaacatattaaaaagataatccaatgatcaagtgggtttcataccaggcatgcagggatggttgtcaataaatgtaatacaccacataaagagagttaaaaacaaaaatcacatgatcatctcaatagatgcagaaaaagcatttgacaaaatccagcatcgctttatgattaaaaccctcagcaaaatcggcatataagggacacaccttaatgcaataaaaaccatctatgacaaacccacagctaacataatactgaatgggtgaaagttgaaagcattccctctgagaactggaacaagacaagaatgcccactctcaccacttctattcaacatagtactggaagtcctcgcaggagcaatcagacaagagaaagaaataaagggcatccaaatcagtaaagaggaagtcaaactgtcactgtttgttgatgaaatgatcatatacctagaaaaccctaaagactcctccaaaaatctcctggaactgataaattaattcagcaaagtttcaggatacaaaattaatgtacacaaatcaataagtctgctatacaccaacagtgaccaagctggggatcaaatcaagaaatcaacctcttttacaatagatgcaaaaaaataaaatatttaggaatatacctaaccaaggaggttaaagatctctacaaagaaaactacaaaacattgctgaaaaactcatagatgacacaaataaatagaaacacatcccgtgctcatagatgggtaggatcaatattgtgaaaatgaccataccacaaaaagcaatctacaaattcagagccaattcccatcaaaatcccaccatcattcttcacagaactggaaaaaaaatgctaaaattcatacggaaccaaaaaggagcctgcatagccaaagccagactaaaatgaggcatcacattacctaatttcaaactatactataaggccataatcaccaaaacagcatggtactggtataaaaataggcacatagaccaatggaacagaatagagaacccagaaataaacccaaatacttacagcccagttatcgtagacaaagcaaacaaaaacacaaagtgaggaaaagacaccccattcaacaaatggtgctgagataattgggaagccacatgtaggagaatgaaactggattctcatctctcaccttatacaaaaatcaactcaagatggatcaaggacttaaatctaagactggaaactataaaaattctagaagataacattggaaaaatccttctagacgttggcttaggcaaggatttcatgatcaagaactcaaaagcaaatggaataaaaacaaaggtaaacaggtgggacttaattaagctctttagagcttttgcacagcataaggaacagtcagcagagtaatcagacaacccacatagtgggagaaaatcttcacaatctatacatctgacaaaggactaatatccagagatattccaacaaattagcaagaaaaaacaaacaatcccatcaaaaagtgggctaaagatatgaatagacagttctcaaaagaaaacatacaaatggccaacaaatataagaaaaaatgctcaacattactaatgatcagggaaatgcaaatcaaaaccacagtgtgatatcaccttactcctgcaagaatggccataatmaaaaaataatagacgttggcgtggatgtggtgaaaagggaacatttctgcactgctggtgggaatgtaaactagtacaacccctatggaaaacggtgtgcagattccttaaagaactaaaagtagaactaccatttcatccagcaatcccagtactgggtatctacccagaggaaagaagtcattgtatgaaaaagatacttgcacacacatgtttacagcagcacaatctgcagttgcaagattgtggaaccaacccaaatacccatcaatcaatgagtggataaaaaaactgtggtgtatatatatatatgatggaatactactcagccataaaaaggaacgaattarttgcattcacakcagcctgggtggaccttgagactattattctaagtgaagtaactcaggaatggaaaaccaaacatcrtatgttctcactcataagtggagctaagctatgaggatgggaagacatgagaatgatacaatggacttcggggactcgagagaaagagtgggagcggggtaagggatgaaagactacatattgggttcagtgtatactgcttgggtgatgagtgcatcaaaatcttgcaaattaccactaaggaacttactcatgtaaccaaataccacctgttcccccaaaacctatggaaataaaaaagttagaaaaaaaaagaatacagcctggatcatacaaccacagacacaggcaacagccacaaccacaccaccacctgctgccagcatcagaatattctcaaagcgagcctgggcttaagtcacaatccaccatttgtttgtgggacaggcagtcagggcagatactttgaaaaaaaagagcccttcctgtttgctgtgcattgtcttcataccagttcccagaattgacctgacaaatattgaccaggttgctgtsatcttcaaacaccattttcctgtgggtagaggtgatgcagtgctgaagacctgggcccctgctcagtgcctttgctctgtaagtactttgcctgtgcccaaaatgagggcaggggcagaaactgcctcactcccttctctctctctctctctgtctctgtgtgtgtgtgtgtgtgtgtgtgtgtgtgtgtgtgtgtgtgtgtgtgtgtgtgtgtgtgttcctggctttgatggtaaggatgggagaagtaagtccctgaagaagaaatgcaaccatgtactccctctgagtcttaaaggagagacttcaggttttcaatctccttttatggaaaacttcaagaattttgagagaagaatcccaaatattcctgccagttagacaagaaaatgaaacaatacaacccaaagcacaatgacaatgatgctgcagcamatttactagaagctgtcctgtgaaaagggtgcttaggagctctggtctggaatctgagtcttgctcctgctctcaccaggcggcttgtcctaaccctgcatcagtcattccctgtgtacagtagggctaataatccctgtgctttgaggttctcataaggattaaattaaataagacaaagcaagtgtttctcaacaagggcactaccggtatttgggcaggaccactcttcattgaatgtgactattctgggtgyttcaagagctttcgggagcccagctgttccccaactaaactccagcagcatccctccaccaggcattgagctgatccaaaatgtcacctctatctcctttacacacagccctccccctgcctttgtcaggagccagtgttacaatgcatgtaatatcctatcacttcataaacccttaataagtgagaatattatacttcacgaatatagttcttaattttcctctgggatctttctggaagaggaattaagaaatgaattgggcatcattaccccaggcttgatagaaagggaaaaaaactgccattgagtactttcggcatgcctggagctttgtacwttgactgtcatataatcccgaaatggccccacacccaggaggtgggcaatatcatttgcattttgcaaagggagacactgagtttcagacagctgcttttgcacagtatgaggcagtgagttactgcacagccttgattccaaggtcccctcatttacaattgaatcccctttgggaaataggtcatttgcaagtcagggagtccctggggtgcagtggagtagaaaatggtgctgagttcaatgggataaaaagaataaaccagaaatagtttcattacaggcacttcattttacccaggggtagaacaatttttaaattgatttgcatcttccaaattttcgatcaaaagaaaatctgaagtgtatggaagctgtcattaagtgaacccacattgggagttcactggggctgtcattaagtgaacccacactgtgctggagaaagggaggacgtagccttgggggcgtgcccacagtactttgaccagcaaacgcatttcaacatagcagataatgagaccacattcgtccctcctgacacctggcctttgtcgtttggcaggctacttagggcaccaggggctacaaacccatttgcaaaaatataatctctctttcactgtcgcagcatttgcaattgatccagaagtcattggtttaggcaaaaaattattaaaggtgccagttaagacacaaatgttatcaggacaaactgatgaggagtgatagaggtggtcagcagtgcacagctgctgcgcaatgaatggaacggtggaagagttggatttgaagggagaagagaaggctgccttccttactgagaaaatcaagatttgggagggtcccagtagcaatgtggtcatgagtcttctgcaagaacctgaagatgggtgtagggtcgggggatgggactgaaagggaaaggagagcatggaacattgggcagggtgagtagagacaaccctgtttgcactgcagttccccctccagctcaggctgcattcccagccctaaaacaaggggtcttcctgctcctgtaccactttgatccctggaagtgraataaaggctcttctggcacattttgtaacttaaaataaagcacaaragatatcacattagtttgcaagggctatcttaataaatactacatgccaggcagcttaaacaacagaaatttttgactcacagttctggaggttagaagtccaagatcaaggggttgacagggttggtgccttctgaggctgtgaaggagaatctgctccaggctcctttcctagctttgcctctctcctagtttgctggccatctttcgctttcctcggcttgtagaagcatcaccctgatctctgccttcatcttcacatggcattctccctgtgtgttgtctgtgtccaaattgctccttcttgtaaggacatcagtcatattggattaggagcctgctctaatgacctcatcttaactgattacatctccaatgaccctatttccaaacaagatcatatctggagatactaggtgtctagacttcagcatatgaatttcgggcaggtacaattcagcacgtaacagacatcatccccacagccctgaggcaataaaaaaaatagagaggtttcagcctctgcttgtgacaagaggcatcccagatatcagaggctggacagagacatggagacagagttgctctctctcatcgctcctctaggctccatcagycctgctactttgctccccactcctgggctgtcttcatccacacatccagatggccgatcctcacatcgccactccagctaatgaacgactggaaagggggagggcactcttctttctcttggggcctgaccgaggctttgcacatcatcctttcctttccaatgggcaggatcatagtcaatagccatgctggatgtgagggaggcctaatatcactggcagtgtggccaggacatttgctccaagcatgttcttctcaatttgtcatcacatatatagctattgagtgtcacctaagctagtgtcaattaaacccttaactctaggaaatctgaaattttgtttacttctttccccactaaatactgaggacctagctacctcttggaccaggcagatacttgaaagttaatgaatgattgaaagaatgactggagagaagaaagaaaagggaaggaaggaagaaggagggaaggaaggaaggaaggaaggaaagaaagaaagaaagagaaagagaaagaaagaaagaaaaagaaagaaagaaagaaaaagaaagaaagagaaagaaagacagacagaaagaaagaaagaaagaaagaaagaaagaaagaaagaaagaaagaaagaaagaaagaaagaaagaaagagggagggaggctagactatggaagttgttttgctgttgtggtggtggttgtttttaaaacaggttctcactctgtcatccaggctggagtgcagtggtacaatcacagctcactgcagcctagaccccccaggcccaagcgattctcccacctcagcgactacaggaacatgccaccacacccagctaatttttaaaaacattttgtagagggggtctccctatgttgcccagcctggtctcaaactcctgggctcaagcgatcmtcccacctcagcctcccaaactgctgagattataggtgtgagccaacatgcctggccaggagttgccattgttgttgttgttattgctattgttttatagtccagagacttttactcaacaaaatgttagaaacctactatatgtaaagcagataaagggttgctaccttcactgaagcctcggaggaaagtgtccagaatcctaatcatccacagccttgtcttcttcagtgyccctcatggcagccctgtggggcacattgtgaaggtgggatttgtggtatgagcaayagagaatcatgacattatttatggagaaaagtgacatgttcaccctcttgttttcagagaatgggtccagcttggctttggctactgggaacagggatcctggcctctgtccactgtcagccccttcttgcccatggagataaaagtctgcaggggcctcaaccccccaggcatcagctctcagagccagcccccgcctaccacagaatcacacccaccattaccaattttgctttgcgtttgtataaagagctggcagcagacgcccccggaaacatcttcttctcgccagtgagcatctccaccaccctggccctgctctctcttggggcccaagctaacacctcagctctgatcctggagggcctgggattcaacctcacagaaacccctgaagccgacatccaccagggcttccggagcctcctccacaccctkgccctgcccagccccaaactcgaactaaaagtaggaaactccctgttcctagacaagcgactaaagyctcggcagcactatttggacagcatcaaggagctttatggagcttttgctttttctgccaacttcacagattctgttacaactgggaggcagattaatgactatttgagaaggcaaacatacgggcaagtcgtggactgcctcccggagttcagccaggacacgttcatggttcttgccaattacatcttcttcaaaggtgaggcttgctcwgacagaattattgccactgcctctgcaagtaaatgctcttacagcagagagccagctaataggttctttgctaaccacttggggaaatctatgaataagatagagctttcccacccttgcgtagccacagtccatgtgggttggaaataagtgcagaaaataactcagtgggatggtgatgctgtccttgcataggcattgggtgccacagagttcccaaaagagacacccatccagacttgagaagcttcctggtaaaacagccacccaagctaagacatgagagtgagtagtatccactcaggtgaagaagcttgggagaggtggggcaaagagggttcaggttgaaaaaactagcatatctaaaggtccagggaaaagagatatcattgcattttcaaagaactgaaacaaatttagttgggatagaacatcaaacacaatagcagaataataggaagaaaccaagagttgcaatgcagagggaaacarggccaggttgagggctcccagctttattcagggaaccttagaattgccgaagacttttaaatgtgaagtgacaggattacatatgttttaggaagctcaaactggctacaatttggaaggtggtttggaagggagaaagggtgagagaggagagacaagttgggaggttttcatagtggtccaaagtaagtagcacggtggccttgaataaagttgtggttttggaggtagaatcagcaatacttggtcattgattgggtgtgggtatgtaggacaggatgacccagttctcctgttatcaagaccagagtgcttgcaagaggtgtttgtggggacagatttataagaagtaagagagaagatactacatgtgtgaatgtaaccatgaccccaaaattctgcatttctaactacatcttaatgggcttttgcctaatgcatgacattttattaattgaattctttttcctttttcagtttgaagattagggagttggggtgggtgagtgaaggaaggagctcttgagcgtctctgtagaaggttgttgtctagaggcagtttggttgagaaggattaattcagtgtttgcaagcaatctgagctgctcagtcagtcatcccagctctgcaaattagtatgwttaaataaattcacaawgactcagtttgatcatccctgatatgggaataatacttatttcttattaatttttatgacaatttaaagagataatgtctaacacatggaaggtgcttagtagatggaaaaataccttttggcttgttagaagctaagttcctctgaaatggaacaaaatygtaggctgttagtgctcaaacactggtgacttgtcctagagactgagccaggcctaaattctggtctcctggctctgtaaccattccacattttttgccacatacttgcatagccaagaggaactgtggttttgtgtgtgtctacccagagttgctctcttgaaaagagttctcatggccttatgggttttgtgtcctaagccaagtggaagcaccctttcagtcgctaccagacccagaagcaggmaagtttctttgtggatgagaggacttctctccaggtccccatgatgcaccaaaaggaaatgcacagattcctctatgaccaggatttggcttgcaccgtcctccagatagaatacagaggaaatgccttggcgctgctggtcctccctgacccggggaaaatgaagcaggtggaggctgctctgcagccacagaccctgagaaaatggggccaattgctcctgcccaggtaagtgtcacagcagaaggatgctggctgaccttgctcaagaaccccagcaggtcttgatcaactccagctgcaaaagcccaacatccatctcgattaggctcaccatcttgtcctttactaactgtgtgatcttggcaattttctcacmttttttgggcctctactgtaaaactaagaacatgatacctgcctcattgggttgctcagtagattcattgagtttctacccatagagaatgtagaacttagactggtacgtggagcataagaagtgctcaccaggcattgactgttattatactttcctggtgtctgtctgatccccatctcctttcctcttgctttcctctctccccaccacaccctcccataacaattcactaacagaaggaacagaaggtggttaagtacagcaaaaaaaatcagatcagagacagtgaaaaataatcatggctgggtgcagcagctcagacctacaatcccagtgctttgggaggccaaggtgagaggattacttgaggccaggagtttragactagcttgggcaacatagcaagaccctgcctctatgcaaaatdaaaaaaaacatatatagctggacatgttgatgcatgcctatagtcccaactacmtgggaggatgaggaaagaggatcacctgagcccaggaatttgaggttacagtgagctatgattgtgccactgcactccagtctgggcaacaaagctagatcctatctctaataaaaaattattattatcatyatattgttaaagggtgcttctaytttaattaaaacatgtttaaaaaattaaatattaagaacattgtaaacattaaagttcctgttttatgtgatctctaaactatttcccatctcacttgctttatggtttgtagttttatcacagcaacttcagctttttctagtttccctagacccccttcaccagctaataccttcttgggggtgcatcttcttttatggggtactctgagatgaaatctggtacttagttctacttactgcttgctgcataacaasccaccccaaaaccgaatgacttaagacaatcacttccttggttctatgggttaactgggctcagctgggcagttttcatgtgttggagtaggtggcagctggagctgaagccactgaactctcttcacttatgtgtctggtgcctgtgctgggctggctggaagagattaaggctggcaggcatctctctctgcatgtagtgtctccatgaggctagctcaggttcagcagatcagcatagttaatactggtatatggcagctagggtctccaagacagaatatttcaaaggcaggaaatgaaagctaccagtctggtaaggcctaggcccggaaatcagcacagtggcacttctgccacattgtattggtggcagagccaatgggtggttggagagccaatggctgggtggtgcagagcccacccagattcaaggggagggtgcatagatgccaccttttgacggtcatcttgaatccaccacaacctgggaggcactagccaccccacatatccaaaagtgacttctctcagcaccccattcacactgaggtaccagggatagagaaggcattttgtgtttgggcagagattaaaacaccaaataagaggcacgggccaaggggagaggccaggatttaagagattattcctgttgtccatgaagctccayggctctagtcagttgctaatttcagccccatagtccctggctcctttggggtgagtcttctccttgcccccatcacagaagggagtgccatagactcttctagaccagtagattttccctcagggagggtttggtttgacttcttcccactttgacattctaaaagcaaaactgacccaagttactcctctaaatctcagatattccttgtgccagagagttacaatatcttagtatccatttttaggggcttttagatataagaacttcagactctgccatgtttcactccattcagatgtgaggcaggttagcttgccaaggggaactgcacttcctggcacaccattcgtgtatgtattcwttcacagttgttaaacatccactgtgttttgggctctctgtcagacccctgccccactagactctattccaccccccagccaactggcgcgggtcttgcttcccacccaagtgctgcctatgggaaacttgtcaaatagccctagatgtcctcctacttcaattaggcatccagaccctcatattgcccaggagtcaaaccagccacgattctctaacctgaattcgattttctgaggcagaagtgttcaagttggttatgaactagtcatgctttcaggtgcctgggtagctgtcaaaccataattataaagaagaataaccccagagagaaagggcagatttgctgtggatccaaagaaatttctgaacttaacccagggaaatgtggcaatcagatggtaaagatgctccaaacgcagaagcaggagttcatttgtgccctatgcccaacacacatgatctcccatcagatcctcacaacagccccaaggagggggcatcaccatgccatttaacactagaggaacctgaagtggagatgggtgagagacaatggctgcttgtattaggggatgccaggaggtggatttaggacctagttcagaagctgagccaacagaacttgctgatgcatcagatacggaagtgggaagatgttgacagtatttaccttatgtggtcatgatttggattccatcagttcagccttgaaaaaacatagccaatatctgacacctagaaagccctctataaatgtgatgaagatgacaaagacaggtagctgtgcctggagtcctctcagatccagccacaagatattccaggaggtccaaagagaagggagctgtgggtatgggtagtggcatggtccgccatagtgaacagtgtcatgggaagactggttgcttctcacgctgggaaatgcctctctcccatggctcaggctgccracagacagagcaggagtgrcacatattaacaagagagcaccatttctctgtctgtttctctctccagtctgttggatttgcacttgccaaggttttcaatttctggaacatataacctggaagacatacttccccaaattggtctcaccaacatactcaacttagaagctgacttctcaggagtcactgggcagctcaacaaaaccatctccaaggtaaagtggtgaacatggatgtttgtgggcaggtgggggtaggtaggaggtttctcctttggcatgtgggacatttaaaagtcaagttccttgttctttgtcctgtgcagactatttaataccacagtctttaaggcatctcttcatgggcttttccttctctacctccccttccttaggtcccttctattcttcatggcaggaatacagtgtcttccccttgaaggcccccaaactgatgctgtcttcatctcctcttgtcctctaggtgtcacacaaggcgatggtggacatgagtgagaaggggaccgaggccggggctgcttcaggcctcctctcccagcccccatctctgaacaccatgtcagacccacatgcccacttcaacaggcctttcctcttgctcctttgggaggtcaccacccagagcttactcttcctgggaaaagttgtcaacccagttgcagggtaaccatggtgggaggccaggagttatcttatctcatcctggaccaaacagataggccagaaccagcctgcatcctggggctgctatgtggttcagttaatcagtgtgccaagattctaataaagttgaccttgggttctgtgaacactaaggagcaatccttacaagggaggaacagcttctagccactcattcacaattgtcccatatctggtgttagttgtgcttagaaagttgaagatgagaacgaccctcatgttacagcctcccaggagatgtccaccgctgctgccaccattgtagatatttgttgagcatcctttgggtaagggtcatagtgaaaaacacagggggcatcagcaggagtaagccagtctttcccttcacagtggccaatatgggctgtacagacaagagaggttgtcctaaaatgtcattgcccagacatcaggggctagatcccctcaagaggaggttggacctgtgtcagggctccaaattacagcccatgtagaaaagcaggtgtgcagatgggccggcgtaatcacgggtcaacctggagggaggtcaagttcaagcagcaagaacagcgtgtcaaagcccagggcaacacgaagaccaaagaaagcaggaaggcaaacatggccgggagggatgatggacatagggcagggtcagtggggtgaattgagggccatattgaattgcgatgcagcctccattagagatcgaaaggctactcttccatgtgtgcctctccaagaggcattcatttgaaagtagtggggaagcagaaagagatgcccagctgcatgtgtgtaccacttggatgacaatacccatcactacaatgaactccgtgcccagacacgcagcagggtaggatataggtggtgcatgtctaggaaggagccatcccagaaagtgctacagtggtggaaacccctgaccctactccaaggaggtgaggctcagatcctgaagaccaggtaagctttaaataaagagaaaagggtaggatagtctgggagagggcaggggagagatgcgatcggcaaaagcaatgggtaaagagaggaaaaggtatgccccaataaaatgagagaaaaccagctttgcagccatggaaagttcaggtagggtcatggtggaaggtagtgctagagaggtgttcagagataaaaggctggaggctttgggtccccgtggagtgagtgtgagcatggccttgtagacagtggagagtagctgtaggcctgtgggcagatgtggatgtggacaaagtagtgatggggaagtcatctgtcaattgggcagagataagaaggagtagggtgcggccagggtaaggcccagccgggatggcaccatgaggtccatttgaccactgaccatgctgcatgcagggctatcggagcacatgcatccactgcttcaacacagacttattaaacacctcctatgccaagcattgggaatgcagcagtgaacaaaacagataataggtcctgcctacatggggcttacattatagcagacaaaacccggcagtaaacaaaacaagtaagtaaaatatgtgctgtttgacaatagcaaggacaaggtctttgtggtcaagaatatgcccaggaaagtccctacagtgtacatgaaggggcagctggcccctgatggtgacaaagtggattgctcagtggcaaagctggatttaagcccaaggctgcaatgtatccacattcatccttcttgataaaagaaaactgcaactgaaagttccctccctgtcatgtcttctaagaaagtggcacttgattgagaccaaagtagtcagtggtctgaagatattcattaactgtcatggaggtatggaccaacccttcaaggcttctgtcttctgcacccagtgctgcatagggaatacactgttgagacaagtcttgtgttcactccatgttagacaccattataagcagttgacagatgtcaataaactttctatttccaacagtcatgagagggaggcactgctacatctttatcttacaggtggggaaactgaagcaaaatgtgctagcatgtgcagagcctggatttgaacccaggctgttcatctccacagcccacatgtttcatctctatgccacacttcttttgtgagcacaactcaaaagcccttcagccacgcctcattggctgccataccacaaggatccaactcccagggtcataggaagtgggagagggaagaagccacatgagcagtagcatctggggaagactttctagggaaagacccagaagcatggatggaaagttggtggtttaagaagcactgattgaggacagggatgtgccctttgttgtttatttctgtattctagtacagagactggcataggataagtaaaaaaaccttttctaccttaatgctgtgaggggaagttgtgtcacatggcagaattccatgacaaagactcagaggcaggaaagaaagcaccctggtgaaggacatgatataaaggtgcactaagttttgggagaaaacttagtgggagaggccccgctctactccaagctgtgtagacagcactctctctctctttggcctcttcccttcctttctccttgggaagccagttgaggcaggctccctggactctagtaacatcttacacccttcagctggctggacaaccttggacacattgctcaacccctctgtgcctcaagttcttctgcaaaatggaacatgcaaaccttgctttaaagaattgtggaaatcaaatgaatacataaatgtgaaacattaagcacttgaaatccactaggtgctcaatgaagcttccttctggccccatcttttggctcctccaaccgtcaagggtgctcttcaagggtgctctttcctcccacagagcagagttccgtaccaggtaatgccaaaatccccccagtggtcactggccacataactacctcccagcgaaaccatgaaggctgcacatcaaaacacaaatgtgttgatggagaggcctcaggggccttatctgggcactaaaagtgacatctgcaaaacagaaccattcttgctgcaggaacattagctatgacactgtggcactaagtgggggaacgctggcccagggatcagggctgaaattgcagaggctcacgtgaaggagagccacatgattttctctagaaaagcatcattgttagattgttcactgggtttcttctcctttttctccctaagataactccttcagtcatctgtgaattaggtaagagtctccctaagcgtacatttcagatgtatttacactccaaaccaaccttttaaccacctagaagaatggaccattttcaagataagtcaacagccatctaaaatttatattttcagagatcttgcgatgctctctgtggtggaactgaaccatctttgtaacgccatagagtcccaggtatatttattttgaccctggaatggaggtaaatggctttcaatgttgggactaatgccctggccagttacagccgatatgaacacacaggtccaagtaatgaaaatatcactagggacactggtgtctgtcactccacctcaaggttccatgtgtatcatagagaccatgaaaatattcataaaatttctattccctttattctggccatgaacagagctgagacctttaaagttttctatgtatgggtgggtctgtttctagactgtcatttacaattctattgaatgatttgtctttccttgtgtcaatactacgctgtcttatttaacctagctttataagtcttgatattatgtcaagtcctccagctttgtttatagaagtattttatttgcttatgttgttttgttttgctttcaatgtttgttttttatcctgcccactccaccaattctggttacagtggctggtgactctgtttctccagctgccccaccccttctcttcccacacttatataagcctcaagtcctatgttaaaactttttatttcacgaagtatttggagtgtctctgttttcctaacccatatgaaaacatctttgttctgccttcatgcttgaaggatattttcactgggcacacaattttagatagccagatgttctctttcagtgttataaagatgtcacccattttgactttcattatctgagttaaaaagttatctataattactattattatcctttgcaagtaatccacttttccttttggctgctttaacatttttctctttgtttttgtctttcaattgttttcaaatgatattcctaggtatagttttccatgtatgaatcctaattaatcttaatcttaattaatcctaattaatattagggttcatacaccttcctgaatatgtgacttgatgtctgttttggaaaatagatactatctctttaaaaattgcttctattccattttctcttctttctctgggacaatcaaacatatatcagacgtcttcatcatgtgtcatgtctccttcacacttttctgcattttctattcttttttctttccgtgtgtaatctggatgctttctgcatgcctatcttaaacttctagtcttttctgctatgtttgatctgcttttaaataaatctatcaaattcttaatttcagttcttttgatttttagtgctcgggtttttattttactctttttatgcatttttgttctctatgaaattctttatattttgttccatcttattacacagaatgatcaaggttgttttaaaccctgtgtttgataactccaatatctggatcacctgtgaatctgtacattctattctatgtttttctcttggtgtttaatcagtttttctgttacctggaatgcctggtcattttcactgaatgccacaaagtgtgtatcaaaaattatgtggctttgggtaatactatcttcctcaagaggagaatttattttcttctcaggcagatagagtataaaaagactactttgattcagccaaggatggatttcagtcctttgggggtctggtttatttcttttgggccttacccctataatgttgtctttgggagatgtcaactaagagcctgggctatttgtgagggctcctccccgttaacatgtttatataccaatttttgtctcttcccttctgtgaggctgctaaaatctctgctcttctagcaggtggcttttgcatgattatttgctgtctcattccrcacacgcatcacttatgaggcagaaaattaccttgaagggaaatttcatgcaggacattgtatctgcttcatcatgattatcttttatctagaaacttgatcccttgaatcctaactacgtgttgactctgaattccaatttttgtttctccagcccattgacactattaaaggctctaagccagcaacccccgatctttttgacaccagggactggtttcatgaaagacaatctttccacagactggtgctgcagggaatagtttcaggatgattcaagtacattacattaattgtgtactttatttctcttattacattgtaatatataatgaaatccttaaacaactcaccataatgtagtagtactagtgggagccctgagcttaatttcctgtaagtagacggtcccatccaggggtgatgggagacagtggcagatcatcaggcattagattctcataaggagcacataacctagatccctcacatgtgcagttcacaatagggttcacggtcccatgagaatctaatgccactgctgatataacaggaggtggagctcaggcagtaatgcgagcagtggggagctgctgtaaatacagatgaagctttgcttgctagcccgccgctcatctcctgttgtgaggaccagttcctaacaggccacggactggtaccagtccatggcctggggaactggggactcctgctctaagcgactgtattctgttcacctttatgcctcagacttaaaaccagcaaaagtcctagagtaaaaaggcagcagcaaatgtaagcctcacctcagtgctgttctcctctctctggaatctcctcccaattcttaacttatcgcattcctcattgtgctccagtaccttcagccatctaaattttat

SEQ ID NO: 12177 - DNA, 12976 bp, Homo sapiens
gtaaacgattgaatccaaacaaccagaagggaaagataagatggatgtttggtgcccttgtcaatctctgtgcttcatagctggtctaatgtgggcccttagttctcaccatgtacactctttagagatgtgatttgtgtctgtgtgatgcaggctggtctgttctccagcttccttgccttcttctccctggtgaaggtaaaatacataataaagctgatcctaaggctgatatctgacttgacgtgtgctctcttttctccaccatcaaacccctcattgtccttgtgacaactgtcttctcctttggtgggggaggggagtaatctgaaacaggaataaaacacagacctcaccggtgcataaaacagcagttctgaaagaggcttcctgaaggtcactgagaccaccccacccacaacatatcctaggttcacccacttgtgcacttcacacatgagaaaatccagcaaggggctaggacctgcccacactcaaaacctcaggtccaggttctttctactacagcatctttcctctctgatccttgctttccaaagggaaaggctgaaatggaaaggaggggagatgtgtggaagagggatcccaaatcaattcataacacctacaaacatagcatctgtgtcaaaggagagagcgaagcatgcctctgagattaatgcagactcgaggaccaaaactgtctgccctgccatctggccaggtttcaggtaggcctggggcctgggtaaccggcctgctgccccccacccatggaggaaacacaggcagtggccactggggtttgtgaacgggtggagagggcactgtactgacatgaaataaccacaggctgctccctcggcagtgccccgagctccgacctgagcccaaaggaagctatgccaaggaccagcttcctaggggggatgtagcttcttacccattctacaggtgccccctcccttctcaatcctcatgaggaagaggtggagggccgggacagcccctccttgtagggcgtgtagagctctatgtctcagtcatttggctaaactgagggtcactgagtctgtgggtgacatggaccaggccctgaactccatgcacattctctatggggattctaacagcagccttggggagttcctgtgctgcccatttgcttaggaacttgtcctaaagccagtaagtggtgaagtcaggatgctaacccaagtccctctgactccagaatggagctctcacttttgtaatgaaagtgctatggcatacagaagagatttccagaaactcattcattcatttatccacctaaaacatgctccctgatacctaccaggtgtcaggcaccatgccaggtactggagagacagtggtgaaccaggcagtcagtatccctgtgcagagttacgagctgtctcttctgcaggccacatgcaccaaggatacctttctgaaaacctcctggatatctcaagtccctgaacatctccagatgcctgaatcacagttctcttgcctccttgcctagtcgaaataggttttctcatccattttccaaccttggaataaaccagctgctccccagggccagcagctcccagagctccatcctgcggagatgtgccagagaggccttcctatcagtgaagcttctgttcacagactcttctccagcttggctcaagtccaagaaacatctttgttctccagcatcaaaggcatgcacagattggagtccragatcagacacccaggcattaaaggaagcacgaggctaatgaacagggagagtccagacttatcagagagaggggaaatctgctgattacaggggaggcctctacggttaggaaggggacaagtctgcagattgcagataggagagcaaacgccaagcagccagcaggccttcatctagctctgtcataggaacctccacacctcctcatcctcacagaggtctgccccagccactgcctgggccactgctgctgcagcctggtctcttaagacacagaccaggtccacagccacagaggccacagggacagctaggacacagcattcagacttccccagctgccgcttctgtgctgagcctttcaggaagtagggaggggccttaccaaggaaagccctggatgttaggggttctagctaacagttaactcaacatgagacaatagtggatctgtgggccccatatgccaagaggaaaaaatacaaacagacaggaattcacaggaggagctgtggattcactcaatcactcaaaatatttatggagaaactactatgccaagccagactctggaaacctgcgacagtgccaggaggtgggcaagcagagcagtggcctgaaagactttcacatcaggaagagttgaaaaatatttagtctacaaaagaaaatacccaagggagtgggacagctgaactcaaatattttaagtgcttttatgagggaggagtgagatttttgtgaagtgccaaagaacaaagttaggacccatgggcagaaatcatgaaattgggctcagtttaagaactttcttataatgagatctattggactgcgacaggagctgcctttagatgcactgtgtcccatgaactggaggtttgcaagccagtagatgacaaccagctcctcccaatccatcaaatactgtgactcctctaactgtaacttgtacgtggaaatgggacccaggggcagggagcctcccacgaagggagattcagaagacctgaccgcaagctcaggagacaggaagtttccctggcttccagaacactgctgggaggctcttcggggggcccaaacttctggggaccagcagaatgtgtgaccatggcttgaaactaaaagaaaggaggaagacaggtaagtcatgggaagaggctcccccagatttggggttttcttaatgtttttggacccacaaatgcttcagccctgagaagcaccctacagtaattcctcactgctttctaatctcgttcttcccagctgggtttagtgtgctcgctcccttttacatctcatttatttaccatccagataccctttctcttctgtaccaaagtgatccgcctgttcttccacctgacaacccatcgcagattcctttctgccttcaccttcctctctcccacccaggactctcccctgtttgtctcagccaaaccaggggtttcaacctgacctccaggaagccctccatggtttcagcctagctcctaagtactgcagcttgggctctgtgctgcagtggccgcaggggtctgcagccctctaccagctgcctgtatttgaatgacacatgtctcctgtcagcatgagagcccagatgacagctcctggggctggctgtgttcttgcctgacttcacagggcccatcacagtgaggtctgagacacctgtacggctggccaccagcatgccccctgagcagagacaaagcggggtgctggcttctagaccacctggacaatctcttttattgatagggtaaccagctcatcttgatttgcctggaactgtcccaattttagcactgaaagttctgaatcctgggaactccctcagtccccgacaaactgggatggttggttgccctaagcacctgtgtgtataagacatgatgctttgttccaggtgggggagcacagagggaaagcagatgaggccctccatgctggaggaacttatagcccaagggatttttctggaaaactgtaaacccaggaggcctagttcccactgcctgccccctccatagccacattctccatgagcaggggtgggggcagcaggggctggtgaggggtgatcaaatactagatcaatgagcaggttcccagcctaggcctgtttcagcatgaactggcaggtcttgaccaggagaagtggtatcgtgggggccaccacccctattcgacagcagatctggacttgtccactcctgctctccttctctcctacggacacctgcctcacatctgaaaatggttgaaagaaaataagtggccagctggcagggccttctcaactcaacctccctcatcacccggttcccaagccagcctcataacctgtctttcctcctttagaagccgctggggaccgtttctcttctcttcccaacagcaccacctgctggccatagaggcacttggccttctactaatcacacccagtctggcctgagttggagatggccgcacacactccggccgtcagtgctccatgtggagaagacaagagtacagagatgcagcatctaacagagtcagaggaaggctatatgtgcaagacagagttacactatttatagggtgggagcaacacgaataatggttcaggacataggctcaggaatcagacttctggaattcaaatctagactccaccacttctattgttcccttaaaacaaatttctcctatgtgagagtaagtgacacagaatctcctatgagccaagcactggagttacagcagcgaaccagatacacagaatccctgcctcccagagctcacatgagaaggaagacagacaaaaagcaactcagcaaatgcataaataagaaagtgaaaatgaagaaaatgaaacaaagtggtgaggagagaccagagaagaggggtgctctttagctcgggtagcgtggaaaggccgatctgagatggggatgtcggagtagcgacatgaacaataggaggagccatccatgtgggatcggggtaagtatcagcgcaaagagaacagcaggtacagggagtactgcaggtcagactgcccctggagccttaactcggatgctgcatttgaaggtagaccctggccaacttttagttcatccaaattaatgtgagaaaaagagcgaggtctctgggcaccttgtcacatgagctgtggctgaaggaagggggcgtttcatccagagatgaggagacttagagacacacagtggctgtcttcaggcctgtcaaatgtcaaagagagaggcagtggatatattctttgtgatcccaaggagaatagcatggatcagtgagttctgggcacagaaaagcagattctgctcatatcaggaataaaatggcccagcaaatgaaatgagctgctcatgaagtagtgatcccaccatccatgaaatatgcaagcagagaccaaataagtagctgagattataggaagtgtggatgcaatgcttttaatctttaattatcacctactcttgcacttgaattgcttataggttaccacaagattttgcttctctctgaatacagtaaaatagcctttgtcagccagtccctgaagggatgtccgccccagggttggggaacatcacagcaaggcaggagaaaactggctgttgggtacagaacacgcttcttgtcaaacccggagcagactctggcaaagatgaaaagcggaggtcctcacctccctttcatatgctccccttttctgtcccagcaccagaagatggaacttccttttccttacaatggtctaagaaaaaactagtctaagcaattagagaaaatatcctacaattcccaagtcctaaaagtttttatgttgcacatcctggtaataaaaatatttcagcctcaccaataaacatataaaaacggtgttcaacctctcattattcatcagagaaatgcaaatgaaaacctcaaagagataccacaacacaccgactggaggggataaaagtaagaagacagaatcacagtgtgggtgaggttgtgggagtgcaaattggtacaaccactttggaaaactctttgacggtcatgactaaagtagaatgtatacacagccaatgactgaacaattcctctcctaggcatctgccccgcatacggtcaccaaaactcaaacattagaatgttcattctagctctcatcaggcatccttgtgaaagtggcatcacctttaaaccctgcatggcaacccctgacacactgccaggctgcccagggaatacagggcaacctggaagtccaactacttccttcagatcatccaatttttyaatcattatctgaaatgtttcattgtagaagcagcaatgtgggctccaagtagatgcagcagatccacatgtccctctgagggaaagccatggtgccaatrggcaagaacaccatgatgtgcaaggccatccaagggcacctggaaaacaacccagctctggaaaaaytgttgcctcatatccagggaaatgtgggctttgcgttcaccaaggaagacctcactaagttcagggacatgctgctgaatagtaaggtgccagctgccacccatgctggtgccattgccccatgtgaagtcactgtcccaggccagaacaccggtctggagcctaagaagacctcctttttccaggctttaagcatcaccactgaaatcctgagtgatgtgcagctratcaagactggtgacaaagtgggagccagtgaagccacactgctgaacatgctgaatgaacatctctcccttctcctttgggatgattatccagcagctgtttgacagtagcagtatctacaaccctgaagtgcttgacatcacataggaaactgcattctcacctcctggagggtgtcygcaatgttgccrgtgtttgcctgcagattggttacccaactgttgcatcagtacctcattctaccatcaatgggtacaagcaagtcctggctttgtctgtggaaactgattgcaccttcccacttgctgaaaaggtcaaggccttcttggccgatccatctgcctttgtggctgctgcccctggggccactgccaccactgctgctcctgctgcagctccagccaaggctgaagccaagaagagttggaggagttggatgagamtatgggatttggcctatttgactaatcaccaaaaggcaaccaactcagccagctttatttgcaaaacaaagaaatgaaggcttacttctttcaaaaaaaaatgtttattctagtgttattcataatatccaagtatcagaaagaatacaaatacccatcaatgaataaataaacggtggtatattcagacaatggaattccatacagcaatgtatacaaatgatctacagctacacacagcaataaggatgaatctcacaaacataaagtaagtggccaaaaaaaagacacataaaaaagcattaggatgaaacatatgaaattgccatttatggaggtcaaaaactgttcatagggttcaacataaaacacgctgtatagttccatttatatcatttatgtacagtacaaaagctggccaaataaatctctgttgtagacagtaagaacgtggttgtgtgtgtgttggttgtagtagcgtggtcattggatgggagaagaaggaaggtttctgtgttgctggtaacattctatttttttatctgggggctgcttatctggttgtgttcagtttgtgaaaattcattgaggtggacatttacaatatatgcacttttctgaatgcatattttaataaagagttgaaagttctattggggttcatcatataatacatacatattatttagaagcaatagatatgtactgtcattctaacatcatgaaagttaaaagacaaacacaaaatacagacaattttaaaagaaaagataaaaatacataaagaaaaaattcaaattttttctttctgctcccaatgaatagttttatgcaccctcagtgaacaatcagctcttctggagattttttataatgaagtcctggattacgtaaatgctgcatgatctttggcaaatctcccagcctcagtttctgcatctgtaaaattgcactgatgatcacccacccatcctagatggctgtcctcaggatcgaatgaggtatttgtggaagtatttagtaatttgtaaaatgtgaagggttaatatgattattactattagcagatagttactattaacatagatttacatgatagtgaagccaattctatagtaaatagtttggatttcattaaaagtagctagagatttcaagaggagtgttccccatcactaggatggcaaaactatctgccaaaggtattgtagagtgattcctgcaccaggaagagagtggaaataataatattaaaagtgataataatggtgaatactatgtggcagatattttctaagcactttatgtatattagctgctattataaccgttataacaagcaaaagaaggaggtcatattaatatgactattttatagacaaaaaactaaggctcaaagaaattaacctacgcgagatctcagagataacaattgagatagcctagtttggatgctcttcacattaccctccaaagctgatgcgagcattcaaaatctattcccattcggcaaagttcagtctaatatcaaggcaaacttcctttcattaatctactactcagcaagtatttttgagcccctattacatgccaagctctatactgggtattgggtatgcaatgataaataagcaaacacagtccctgcactcagagcatatgagctagtaaaagaggcaatcaatataagaaatacacaaaaataaatacataattctaaattttgttacattcaacaaaagaaagttctaggttatataaaataatgaattggagaacctaatttagattagagatcaggaaaatcttccatgggaaaataaaatttaatctgaaactggagagatagcaggagttgtccaggtgacaaaaagaaaaaaattatagtgaaaacaaaagatggttctgatataggaaaagcctgattgttgtctcagacacaaagatagagagtgagagggactgtgtccccagacagggacaggaggtgtgtgggcaggagcagaccccacaagcctctgagaccacgtgacaggttttgacttttgccctaagagtgaagcattaaagatttttaagcagagagtgacaagattcaatttgcagattgtaaatattgctctagttaaagtgtggagaatggattagaggaagcaagcaagaggtgaagcgggagccactggggacaccatggctatagccaagtctctgtgcagcagcagccaccatttccagaagcagctgggaaagactgaaggaggaacaggtttgggtgcagtccaggtaagaagaccaggggctcagttttgaacctgtcaattttgagacgcatacagaataaccaagcagagatacaaagtaagcacttacatctatgagtcrggagcgcgggaaaaattcaggaatggagatctacacttgggagccatcatcgtaggggtagcattctagctttggggtgtatagatcatccagtgacagaatatagattaagaaaagaagggaacttaagaccatgccctgagaaacctcaacagctaaaggttgagaagagagagagcccttggcaaaagattaagaaggagtcaatgatttaagagaaaagtcaggaaggagagagtgtgcaaaatgctgaatgccactgaggatcaggaagtgcccacactgagtgacaacatggagagcaggcatgggggtgggagggtccagccaggctggtcacccagggattgctcaaatactggaacctcttcccactcacttctcttcttctaaggcacagtggtttgccattagatcctggtacatgggaataagtgagtgaatgaatgataaatgatctgaggacccaaaaggtttaacagcttgaccaagattatccggccagtaagtatcaatgccagagctgaaacccagctcatctgattccaatgcccatattcttggtttaaaaatacaagctttaacccaggggaaatacctttgatgacacactctctgtcatgtttaatatcatactttaaggactattatacttatctctaaaactgaatctatggcttaggagttcatcaaaaactagggtagggagtgagaggcatcccctaaggtcgcctatccaggggataatgcatgaaggaataacctttacactaaatgaatgtatagtttgggttacatccttgagaccctgtctcaactgacgagcatgtgagagtctggccactcgccctgtagggccagctcagaggggagcttggtgttctggagttgtcggtcaggggtgatggtggtgactgtggtatcgtgggggccaccaccgccattcatggttgaaagaaaagaggtggtcagctggcagggccttctcaactcaacctccctcatcacccggttcccaagccagcctcataaccagtcctccctcctttagaagccgctggggaccccttttctcttctcttcccaacagcaccacctgctggccatagaggcacttggccttctactaatcacacccagtctggcctgagttggagatggccgcacacactcgggtccagtcaatgctccatgtggagaagacaagagtacagagatgcagcatctaacagagtcagaggaaggctatatgtgcaagacagagttacattacttatagggtgggagcaacacgaataatggttcaggacataggctcaggaatcagacttctggaattcaaatctagactccaccacttctattgttcccttaaaacaaatttctcctatgtgagagtaagtgacacagaatctcctatgagccaagcactggagttacagcagcgaaccagatacacagaatccctgcctcccagagctcacatgaggaggaagacagacaaaaagcaactcagcaaatgcataaataagmaattgaagaaaatgaaacaaaatgaccagggaagaggggtgctctttagctcgggtaatgtggaaaggccgatctgaggtgagagcaacagaaatgatgggttacatgatggtggcaatggcagcgtgctggaggtgagaggaaatctgagggaacattttcttgaatgtgaattgactgacaaaagtgtcactgaacacattacctttgattcctaaatagccagaawgacaaagcctatctgtagattactcattgtgttctcattcatttattttttcattcaacaaatctttgttgagtagctactgtatgccaagctttcctttaggtgctggagatgtagcagtaaacagaccaaaagtgctgtttttgtggagtttacacttagaggacaccaaaagctcatttattcattcactgagctcctgctgagcacctaatgccaagcatgatgccagacactgatgggtcccagaccctaaacaatagggctatcttggggtgggcacattgtggccagggtgaatatgcacctgcatctgtttaggtttgttcacaggcataaacacacacctgcctgagcatgtatcccatcaaacctcagacaacatgtatatactgttcagatgtttttcaaaatgcatcgggaagaccccgaaggggtctcagtagaggctttttatttgattcaaagcttcaaaagattattccatctgcaaaatgtataaaggctggatgttggaggaagcatgaaatagggagaggaaggacctgctactagagttatggctaaaggtggtagatggcagcagtggagacaaagacaagagggtgacgctaagtgttttggaggaataactaacaggagtagcagggggactcaatgtgtggggtaaaggaggagaaagaaggcagaaatactcccaagtttatggcttaggccactaggtggatgcagagaggtgaggactaggagatatgtgggtacatgtctgaagctcagagatatctgggccaaaaatgtacatatttgagagctgtcatcacatagaaggtatttaaagatatgtgagtggctgagatcacccaaggagaagaagagagggccctaccgagctgaggactccacaagatctcaaggttggacagcgcagaaggagcctgtacagccagctgacaaagagcggtcagtgaaggaagagaaactaggagggtggagactggaaagacaagagaagacaggtgtccaagaaaggaaggaaaatcaatggagtcaaccaatactaactggtcaagaaatgcagagtggctggtgaccttgatgaggacagcctgagtggggacacagaggccagaacagaacagagtggactgaggagcaaagggaggtaccaagcagggcrgtctgtggggttcctggatgcagctggattggtttgctgctcaaagaaaatcccagctcagacctactctaggacagaagaggccttcatgaaagatgcctggctgcaggtgtccaggtgtgggaaggtgagtgggaggaggcaggactgagcagcacttccccaaaccaggagggaagccaacaccgaagcccaggcttccatttatagagtttccacaagtggacccggactactccaccctgttcacaaagcaacctcgcctgaacctttgacaccagaggctgagtcaggcccagatggcaaacacactttaagccctaatcagactttgcatgggtttactcagcccatgcctgcttctctgcccctaccatgtcctcctagaagagggagcacctcttccccgtcaccccccagagactcacctgcatgaggttcacacactgcactctctcacaccatataccacacacacacacgcacacacatacatacacaaagtcagtgtgatgattccagatgctggaaccatgcctccccttgccctttgccaaatgcctgccatgctggccacagaggcagaaggaaaatgacaattctgcccttttgtaatgcatgctactatttttgtccatcacaggttcctcaatttgaggcctaagtgttcctagacttcatccggtgttggaggaagcccttgctgccagggaagccccagtgtgaagacaggacatagcaaacctcaggga

SEQ ID NO: 12178 - DNA, 14527 bp, Homo sapiens
  misc_feature (1)...(14527): n = A,T,C or G, or insertion/deletion polymorphism (see Tables 1-2)
ttctccacatcttcacccacacttgctatttttggcttttattttattttttaaaataacattctaatgggtgttaagtggtcagaaatggttcttttaggagtagagatagaggccagggggatggctcacacctgtaatcccagcactttgggaggcctaggtgggcggatcacttggggtcaggagtttgagatcagcctggccaacatggtgaaactccatctctattaaaaatacaaaaattcgctgggtgtggtggtgtgcactcccagctacttgggaggctgagggaagagaatcgcttgaacccgggaggcggtagttgcagtgagccgagatcacaccactgtatggcctggtgacagagcaaggctctgtctcaaaaaaaaaaaaaaaaaaaaaagagtagagatagaaaagcattgaaaacacagcctcagctcagctcagtctgccatggtgggaagccattaattcttcactcttgaaaccttttcgtccttggtgtggcagaggctgcaagtctcctctgcaactttattcttcccttctttctcagttataaaatccctgattttagaaatatctttattgagatataattcacataccataacattcactacaattgaatggtttttagtatattcacagatttgtacaactatcaccacaaactaagtttagaacttttttcatcatcccacaaagaaaccccacacccattagcagttattcactatttctccccaatcaacctcccctcccctcaatagccctaggcagccaccagtctactttctgtctctacctatttgtcttttctggacattttatacaaatgagattttacaacatgtagtcttttgtgactggcttttttcccctagcataatgttttccaggttcatctgtggtgtagcaggtatcagtacttcaaccctttttattgccaaataatattccactatatggataggtaacattttgtttatccattcatcaattgatggacatttgggttgtttccattttcttgactgttatgaataatgttgccatgaacattaatgcacaagtttttgtgcagatgtgtattttcatgtgtcttggttttatacctaggagtagaattgctgagtcataggagaactcctccatgtttaaccattaatgaactgccgaactgttttccaaagaaattgcaccattgtacaatcccaccagcaatgtatgagggtagaatccctgatttttaactgatcattgagctcaggcccattcaaaacaaagatgacatttcctaaccttccttacaagtagttctgaccagtgagatgggagaagaagttaggttttgtccttaaaagaaaggagagtggctgggtgcagtggctcacgcctgtaatcccagcactttgggaggccgaggtgggcggatcacctgaggccgggagttcaagactagcctgaccaacatggagaaacctcgtctctactaaaaatacaaaatragctgggcgtcgtggcgcatgcctgtaatcccagctactcaggaggctgaggcaggagaatcgcttgaacctgggaggtggaggttgtgatgagccgagattgtgccatcgcactctagcctgggcaagaagagcgaaactccatctcaaaaaaaaaaagaaagaaaggagagtacattctacactctcctctcctccaccctgccccctttccagtggctggatgtggacatggtggtaagctatcttagatcatgtggacaagggaaacacatagggatattagaacctccagacagaaggaacttaggaccctggacagctttgtggagcagtgctcccataccagcgtgaagttttgtatgggagaaaacatacatttccagcttttgtaagccactgttattttgggtctctctcagagcagccaaatatataatttaactaatatattttctttctgtgattcttctttattttgattatacttctacttctctgcccctcttttaggtgggaggtgctgctccaagcactaactcagaatatagaccctctccctcttgtaatagtgccagcttggagttctttgcttccactgtaggggaaggaaggaaaaaatatggagaactcacatccactcttcattgtcctcaaacagaagtaacccattttgttctgctcacagcccattggccagaactaactgtatggccccaatctaattgcaaaggagtctgggaagtacagcacagcacatggatctttggaaagcgttaattttctctgccaaaggcttcttttgttgttgttgttgtttgaaatggagtcccgctccgtcacccgggctggagtgcagtggccctatctcagctcactgcaacctccacctcccaggttcaagcactcctccagccttggcctcccaagtagctaggattacaggcgtgtgccatcatacctggctattttttttgtatttttagtagagacagggttttaccgtgttggccaggctggtctcaaactcttggcttcaagtgatccgcctgcttcggtctcccaaagtgttgggattacaggcgtgagccactgtacccggccaatactggtgttttctgacctcagcgtttttcttttctcctgccatgtactctccctagagatttcatctactcccaagtcttccactgctcctatctgctgatgactcccaaaactcagtctccagccgagacttctctcctgggcttgagacatatgtatccaactgccagaacatctccagtggacagcctttgggcacaaggccacactagcttgtgggtacaagtaatcacccaaagtcaatttcagtggctctccactcccacattttttcaacccctggaaatgttcccttcccaaatactctgagtctctcttctcttttgatgactgtggttttgtgactggatggtagctcctgttgctttttttcctttcaaatgaattttctcttaggaggcttcttagccattaagcaaatagacctcaactgggcttgccctatgcctatctgaaacccagcttaggttcgagttaggactcctgttaatctgagctctcacttcctgtcccaacctgcttattttttttggtgaaagaaaatatcatccccctagttgctcagaaacctgggaatcattgggattttttcctctccttcaccttcctcatccaatcagtcaccaagtgctatcaactctgctgccttagtagccctcaatatatacttacctatcaaccatcactgctatgccatacttcaggccttcatttctcacttggattattaaaatatccctaaatagttcctctgccttctctctggccaccctcctgagtgatctctccatcatgtacctttcagtgactgcttgcacaagcccctttgtgacttggtcatagtctgctctcttgaaccaccagagccaagcacctgggttctgattctggttgcaactcttactgcgtgatgatggacaggccacttgatctcctcaaacctcagttcctaaatcaaatgaatgattgaattcagtcacttaactttgtatgtagtaggtaggcactgtgcaaaacatactagtggatatagagatgaataagaaaaagcccctgcactcaaagagctctcggattcatcaacaaattattgtgcagttagatagtaagtgctataatccaggaatatacagtgttgtgtgaataatgtggaatcagtttatctccagagcagaaaaaggtgaaggccgaagaaggcattcagagtgatactggagctgtgtagcaggggctactactgttccctcaaatcctttcttctcttcttcctgagtaatagagtcctttttcagctaggcatacagccatccaaaataaaaactatatttcccagcctccttttcagctaagtgtagccatgtgactaagttgtggccaatgggatgtcagtacaagtggtaatggcaatatctgggatgtgtctttaaaaggaaggaacatgtccttctccttttcctccttcctgttccctgggaggtgaacttggtagctggaggtgaagcagctggaacttggatatgagcgtcttgttgatgataatagtgcaacaagataaaagcagcccgagctggcctacatttacatgagaaggaaataagactccattttgtttaagctattctcttgcatatatatatacacatatatatcagctaagtgtagccatgtgactaacttgtggccaatgggatgtcagtatgagtggtaagagcagtatcttgtatatatatatgtgtatatatacacacacacatatatatacatatatgtatgcaagaatataaaatatacatgtgtgtgtgtatatatatacacacatatatatgtcccttgcagccaagtctaattctaactaatacaaactaactctaaaaaatgaatatatattcaccaggggataggctatttcaagcagagggaagcctgtataaaggctcagggaatgctgtggttttatgtggcagcagatgagactggaaatgagtcaggatgagccacagtggaggatgaattaaatgggcaggagtgtggtagaaagacctgttggaggctatgaatgcaatcaaggtgacagacaactggtgcaatgatggtagtggaaatggaggagaggggattgattcaagatgcatttaggaccaagaatcgggagcttgtgaacgtgtgtatgagtactgtagacggagtgggtgtgtcatcagagaagatctgagcatttgggcttgctctcctcagaggccctgcgagtggagttcagcttttcctcatggggcaaatcttactttcgctccagttcctggggctcagagtccctggcccagatgcctcttgccatctcatcttcaccctgcctggcttcccttgcttgttccaggattgtttcataaagagggatgtggttggtctttaaccctatgaatgctggctgaggatgcctgcggaacctgtagtgaagctttcaggggctgctcgggttctggctggtaggtgaacactgtccatcttgccggctgggacacagtgactctgggtagttgtgtaagagaggggcccttggcagacaaacaggttcttctctgttggtgggccagccagcaggtcagtgggaaggttaaaggtcatggggtttgggagaaactgggtgaggagttcagccccatcccccgtaaagctcctgggaagcacttctctactggggcagcccctgataccagggcactcattaaccctctgggtgccagggaaagggcaggaggtgagtgctgggaggcagctgaggtcaacttcttttgaacttccacgtggtatttactcagagcaattggtgccagaggctcagggccctggagtataaagcagaatgtctgctctctgtgcccagacgtgagcaggtgagcagctggggcagagggatgggggtcacagtcctaagggagggcattgcaggtggcctcaggggagagcctggggtggcccctaagacgtcctcttggaacattttggcagagttgcctcttcgccctcattatggctcagtttttccaccatgaaatgggagggagggagacaggtgggcaggggagaggtggtagaagtggcctagagaactgttcctggggtctgggacctttgcgaaggggttagagcaccacgctccctgctatgtgactgaggtagcaagagcacgccctcttcccatgtctgaggaagacaccctagcctccttgactcacctaggtcagtcctcttgagccccaacagctctgtgctccccagcccaaggaaggggtaacaggatttcgggcagttgcccctgcagaggccccctgggcaagtcccctgcgccatgtcccttcgtctccttcttcccctaaccaggcctccctccacctgtcttctcagagcagrtaatggcaagcatggctgccgtgctcacctgggctctggctcttctttcaggtgggtctccgaccctgacttcaacgtgggggtgtgggtggaggctggccagagkgccctgtccaccctgggggaggagagcccaggccctgattacctagtccctctccacagcgttttsggccacccaggcacggaaaggcttctgggactacttcagccagaccagcggggamaaaggcagggtggagcagatmcatcagcagaagatggctcgcgagcccgcgtgagtgcccaggggaaggggtgtaggcgaagggaggagacagctgggccatgccatgatgacctgcctctgctgcctcaacctctgtggccgctgctgggacagaggaaaggagcggtgctagctctgtctgcagatcccggccatcctgggctctttagcgccctctgcctgcagcccccgccttgacaactccgtagctgttgcccccttgctcactgaggcgcgggacctgggatcaatcgggaggacgcccgctgcagtccccagaatcaaaggatgatgtggcgcatctatgtttctttggagagtgttgtaggtctggatttgtatggscaatgtgtttgtgcttcgtgcgtgagttgttactggccagggctaggacaagagccctcgaccctggggccaacgccctgcgtccttggttcccccagaggatcagtgcgcgatgacttggggacaaaggagatgatggrggctagcagtctgacggcctggatatctgtccccttctccaggaccctgaaagacagccttgagcaagacctcaacaatatgaacaagttcctggaaaagctgaggcctctgagtgggagcgaggctcctcggctcccacaggacccggtgggcatgcggcggcagctgcaggaggagttggaggaggtgaaggctcgcctccagccctacatggcagaggcgcacgagctggtgggctggaatttggagggcttgcggcagcaactgaagccctacacgatggatctgatggagcaggtggccctgcgcgtgcaggagctgcaggagcagttgcgcrtggtgggggaagacaccaaggcccagttgctggggggcgtggacgaggcttgggctttgctgcagggactgcagagccgcgtggtgcaccacacckgccgcttcaaagagctcttccacccatacgccgagagcctggtgagcggcatcgggcgccacgtgcaggagctgcaccgcagtgtggctccgcacgcccccgccagccccgcgcgcctcagtcgctgcgtgcaggtgctctcccggaagctcacgctcaaggccaaggccctgcacgcacgcatccagcagaacctggaccagctgcgcgaagagctcagcagagcctttgcaggcactgggactgaggaaggggccggcccggacccccagatgctctccgaggaggtgcgccagcgacttcaggctttccgccaggacayctacctgcagatagctgccttcactcgcgccatcgaccaggagactgaggaggtccagcagcagctggcgccacctccaccaggccacagtgccttcgccccagagtttcaacaaacagacagtrgcaaggttctgagcaagctgcasgcccgtctggatgacctgtgggaagacatcactcacagccttcatgaccagggccacagccatctgggggacccctgaggatctacctgcccaggcccattcccagctycttgtctggggagccttggctctgagcmtctagcatggttcagtccttgaaagtggcctgttgggtggagggtggaaggtcctgtgcaggacagggaggccaccaaaggggctgctgtctcctgcanatccagcctcctgygactccccaatctggatgcattacattcaccaggctttgcaaacccagcctcccagtgctcatttgggaatgctcatgagttactccattcaagggtgagggagtagggagggagaggcaccatgcatgtgggtgattatctgcaagcctgtttgccgtgatgctggaagcctgtgccactacatcctggagtttggctctagtcacttctggctgcctggyggccactgctacagctggtccacagagaggagcacttgtctccccagggctgccatggcagctatcaggggaatagaagggagaaagagaatatcatggggagaacatgtgatggtgtgtgaatatccctgctggctctgatgctggtgggtacgaaaggtgtgggctgtgataggagagggcagagcccatgtttcctgacatagctctacacctaaataagggactgaaccctcccaactgtgggagctccttaaaccctctggggagcatactgtgtgctctccccatctccagcccctccctctgggttcccaagttgaagcctagacttctggctcaaatgaaatagatgtttatgatagaagtttgcctggcgtgactctcatttggaccatgtctgaaagcagtggcctcaccactatccccaaagcacacccatcacccactccattcccttgctgctctttctcatccacccactcccagtccaggtctgtcaaagggggtctggctgggctctgcttcagggatcctggctagacaacggctgtctgtcacacctggcaggagggcctgggttacgggcccttcctctgcacctgcactgttcactagcctgctcccccacaggacactgtgcatggaatgcaggctgtgtctggaagagctgtggccctggtggacctaagattcctgaggtgggctgcctcctttgttcctgctgttctagagtttgaatggcctctttttatgccggactctcttctggggactcccctcactcaggggcaccaatgctccctatagatcccctgggaactgaaactggggtgtggtggaggacgtggaaagggtaaacacagctccttgtctttggacttccctgtccggccccctttcctcccagctcagcctactgtccccgggttctcagcacctgcctgctccccaaccccatagcacagaccccacacatatgtaggctcatcatgcctgcaggctggtcttccctgacaccgtggattttgacaatgttggcaacagaactgggttgtggacccagcacctggagagaggaagtgctagaaaggtagaaataataaaaggtgtttttgttgttgttaggaaactggaaaagcataggtcaagggctatgatggggatgaggaggtaggagtgaaaatgagggctgtgtacttgaggctgggattggggaaggtagtgatgaggacagaatagggagtgggaagaacagaaagggacagagggattcagggattgtgagagaggggaagaggctgagccacccggaggggcgacctagcacgcaagcagtatgtggcccaacactggaaccaagcagcccggctccgggcgcaccttctcagggattcctcagggacaagtccagccccttgtcgtcaaggctcttgtagaccgacgtagggaccaatagaaccccgtgcggtggagctattgtgaaggagcaaaaaagtgccctggttctaagaggacgtcttaggggaagtgacggctgagttgaggtggatccggctggcgatgtaaggttcgagccatataaacccgggaaccgggagcccttgacgacattgttccccgagtgcccggagtctgcggctttttttggggtggtggcagctggcggaagtgacgggagaggggtggggccgcgagagcggcggaagtaggaagccgaggtctgaattgcgcgtggtggccatggcggccagcggggctgtggaaccagggcccccgggggctgccgtcgccccgtcgcccgccccggccccgccgcctgcccctgatcacctgttccggcccatcagcgccgaggacgaggagcagcagcccaccgagatcgagtcgctatgcatgaactgttactgcaatgtgaggcgggggcgcggccgcgagcggcgggtgggtagggcttgtgccgggacgagccgggggtcagacccagccaggtgggcccggccggggaccccgaggagcgcccggagatagtagggcggggaaagggagtttcattgatttttttccttagctactttctacttcaccagggcatgacgcgcctcctgctcaccaagattcccttcttcagagaaataatagtgagctccttttcctgcgagcactgtggctggaacaacacggagatccagtcggcaggcaggatccaggaccagggagtgcgctacactttgtctgtcagggctctggaggtgagaggacctcagagcaggtacctcagtattctagagagagattcggtactggggtcagagctctggtccaggcggtcggatcttaaataaatccccctatgtctcctagccttagtttcttttgtaaaatggtactggtgttgtcatcagctcaagtgagataagatttgtgaaaatgctttgtaaatgttgtctgagggtatgaaatgagcagtagttgttatgaatagtattctcaccatttggacagcctggctcacaccacctgtactattcgaaaggagcagtctggaccctgtggagtggcgagagggagagacagctgggctgcggtctgatggaaggggacggtctggttattacttgaggagaagctgttctgcagtctctttgtactgaacgtattcttttcttcccaggacatgaacagagaagtggtgaagactgactctgctgccacaaggattcctgagctagattttgaaattcctgcctttagccagaaaggaggtaagtttaagatcagagtatttgggctgttcgcatgtagctagaatcttaccctctttcttgcaaaaccccctggtgccaggtctagtggtttgtgtatgggttctaccatgtaatcattgtaatcttcattagttaatcatgagtggaaagcttaggtaaaacagctcgagatggtagaaagtaatggtaataccatagtgtgtttattgtagaattttagcatcactattatcagacatgaatggaaccttgcacctggccttctcattttacagatgaggaaattaagacccagagagttcaagtgaattgcccagggtcatacagggacttgatagcagagctgaggctaagtcacacttgtcttttgttcttgttcacaagctctgaccactgttgaaggattgatcacccgtgctatctctggcctggagcaggaccagcctgcacgaagggtaagctggggttttctgattgtagcagctcaaggaataattgcttatatagagtgtcccatgtgtctgaagagtctctgactaagtgttggaaacttgctgggtaagcatatggtggtgctggagctgctagaatgttgcatatgttataattattgtcttttccacttccctccctcagtatatattcaggcctcatcagacaatataacattacctctgaagagcctttcctaatccccttgggttatctgtgtttcctgagtattccactgcatcttatatttattatgacagaagtaatatattatagctgcatctttagttatttgtctccttaattggttggggagtcccatgagaggactgatatatatactattatatctctaacgtggcatgagtgcctgggctaaatggttgaatgagtgagaaaaatgaggctcacctgtcaccacccgtcaacttcaggcttgtttgctacatctcattgtgaagcctgagtcactctgtttccactcacactgagataggtggtgacttcctaatggaagtaacatgggcatgacaaggggcagggcataaggtacaccaccagggctgatgctttactctctgttcatggcaggcaaacaaagatgctacagctgaaagaattgatgagttcattgtcaaactgaaggagctaaagcaagtagcctcccctttcactctggtgagtattgagaggctggagttgcccttgattaggggaggagggaccattaagactgctgggattttccactgtgatgcctgcgtggtctgatagtaggtgatgtaggattgtttatgattttcttttgcagtgactctctcttctcccatttgttagatcattgatgatccctcagggaacagttttgtggaaaacccacatgctcctcagaaagatgatgccctggtgatcacacactacaaccggacccgacagcaggaagagatgctggggcttcaagtaagtggactgaaggatccagaagaatgctctggaattatcgcgcactctggattgcttggagtcagtggaacttattttgctgctgctgctctgtgtgccctatctcagcttgtttgtgcttctcatcttgcttatgtccaggacttgggtaaacttcacagaaaggatggcagtggctgtgatcctatcttaagtcctgttcttcctttggttggggctttactttgtggtttctctaactgatgaggtggcacctgacataactgatgaggtggcacctgagcatttctcccactccagggcagggtgttggggacactgaggtatacctgccaacttgcgacctgcatctttgctattttaggaagaagcaccagcagagaagccagaagaggaagatctcagaaatgaagtgagtcacattggctactggtgaggaaggagcagagttgtgggctgagactgatgctgttcagcatctgtcttccttgtcaccaacatagatgaccactagcataccaactgagtgtctttagcctgaacatcccatctgggagggctcaccctttgtcctcatgttgtgttccaggtgctccagttcagcacaaactgcccagaatgcaatgcccccgctcagaccaacatgaagctagtacgtatcttttgccaagcagttgggttgctcttcatctgactcaggcatgaagattataatcaggctgggagcatccctttcaaggaaaacacatgctttatacccagtgataaggaagatattatctttgattagactgtgtaccttgggttttgtgttcaaagagaaaattaggccatggtcactaggctgtgtgtgtgtgacctgagccatgccttcaaatgtgtgaacagggattgccatgggttgggaacttgccctcttctggaggactctgtgggctgcctcttgtgaatatttcctgcagttctgggaccagcatatgtttgtgtggggtttggctttgtttttccccagatggtggtcttgttcgcctggaagtagatttccttaactccgttttccagaaatccctcactttaaggaggttatcatcatggctaccaactgcgagaactgtgggcatcggaccaatgaggtgggtgggcgccattatttgggaagaagactagcttaagggtaacccccttttaactatcattcttcctaagtacttcagtactcgggggcagggggtgtagagtagcttgggtctttttcttaggtctagtgcagggtgatgagcccttgaaggaatgggaattagcctagagaagaaaagttagagattctataacttgtttaagacatattaaaggttgatgatatggaagagagaagtcttttgacccactcctcagaggtgtggaagttcagggaggcagactttgacttcacaatgaagaactcaatagagctgtctgaaaatagaatgagctgccttagagaattataaattcccttcccctgagtgtatctgagtataagctaattaaattctttaaccagaatattataaaggagacccacacattggatgcagtggatgaaaggactgcaataaatgcttaaaagtctctttcaaccccaaaagtcttttttttttttttttttaaggtaaattcagagtttattggcaatttgggataagttttggcacgttaccagggttgggcactgttcctggccagctcttggtgtttttggtttgggcgactgctgtttagaaggctctttctttggtagctattaatggccctaactgattggatgtccaagcctacactccaggtctcctgggtaccaagtgaggctcaggtcttctctctgttgctcctgactgttatcgatgcaggtgaaatctggaggagcagtagaacccttgggcaccaggatcaccctccacatcacagatgcctcagatatgaccagagacctcctcaaggtaacagtctgcttgggaaagtcactgttgtcctcataagttagataaactgtctctatctaggggaagttgtcttttagaaataatgttcagggacatgaggtatctcctacttccctggctttgaggacccctgagcagagggagttaatctaagattggaa

SEQ ID NO: 12179 - DNA, 13428 bp, Homo sapiens
catagctaatggagtttctggcccctataatacatgggtggaagaaatatttttaggtccttacccaccctcattctgtacacccggatgatatccccaaccagaccttccagttagaaaatgakgatcagatgtctgcatgaggaaggagtgggttattcagtaaaaggttgtagcagacagaattgcttaccaactcaatagtcatctccctcttcctccttgtggaaagaatccccatttttaaggtaattcatcctcctccgcatgagtctgtgctcctctatgccagtcatggtcgttttatcccccttgccagtgatcagcctagttataggcatggtgaaattcaggccactgtgatgtgagaggaggtatgctggagagattctgggaaagttttcttgaatgataaaaataagcatacaggaagaggccttcctcttttaccattgaatattgccatgtctggaaacaatgcctgaccggcaatagccaccttgtgaccatgaaagttgctaaataacatgctgaggtttgcaaatcagaaagatggaaagaatcaggattttttaatgacattgttgaactgctgaattaatcagctccaaagccacccactactgaacttatatgcaagataatatatttccttttttaaaaacagtcatctaagttgggattttctgttattgcaactgaaaacatagcaaaagattcaagtgggatgtggatgaggcattagctcagtgggggaggacggaacggagatagatggattaaatcgcagaaacagatttcctgtgctgtcctaggtgctgaacaaactagtcctggtctccactctaaggttgttaacagccttgctggagataaagttggacatgtagaaagacaaaaagggcacactacagagaatacatatggacaaagttaacttgtgtacaactatgtgaagccagtcacttcccaatgattttattagtaagtttagacatccagggcttcagatcactactcctttccattgagattgagtgactttcgtgttccacttactctcagcaggtaattccatttgttcacttcataaagaaaattcagccaattggagtggacctcacaccttccaaatacacgtatactttaattctcaataacgacaatgagggcactctgctgggttccttacatgcattgcttcattgtcttctcacaacaagctaggtgctagcatcctcattctacatatgaggaaatggaggttcagaaagacttatccatagtcatagccggcaggcgatggagccagagttcaaccctaggtctgtctgactccaagcctgcattttttccactatatcacttaccttccctccctcattttcttccctctccctcccttcctacctttattcctcctttctcccctccctccctccttccctccttctctcccttccttcgttcctttcctcctaactcagataaagagattagaaatcatgcctcttccccctttccttcttaaagccccaaggaaacagcaaaccttgcaaagaaactgtcatcaagacaattacgaatattagatgtgaagggccaggagggagaggactggaacaaactggaggagtagggcaatggaagggtgtcagcaataatggtatttgtacatcttatttatctctgtcagggaaaaaatagtaaacttttcctgcatactaaattccagacatcaatgagatacccaagtgtgtgtgtcctatagcaaacaacatatatagggcttagattatagatgtgggaaccattcagttcaacaaattataattaagtcattcattcactcaacaactattattgaacatgtactatgtggaaggtacttgttttcttaactctgaattggaaggcattttttgggggacagcagagaatataatttgaaaggaaatatctagaacatatgttataataactttacctggaaggctatgggaaagacagaggtaaaatgaggtacatgttctcaaggagctctggttctggtatgggggtgggaggatcaggaggagatggccaaaaacacaaatgagtataattctaggctgcctgtggtatgtgccatctctgtagaaatcaaatgtgataagagtgtgagagaaggagagatgcattttgattagagagagatctgtatgctggagtctcttggccattacaatttttgataacctctgagtcatagttgaaatcatgagagtggatgttccaagagagaaggggaagagagggtgggggtagggggagagagatggtggagagggagagagaggagaggagaggagaggagagaggagaggagaggatctttgggggaaggctcacatgttggggaagtaggggaaaaaagagccagggaaggggccagaaggaacatccagaggaagaggagaaccggagtaaagcaaagtcacaggaaccaaagtaaagaagagtttcacagaagagagtgaggctgatctgctgcattccgttcctcttggccctgggtgaggacagtaaaagccaggcaggtgtgccggttggggagggttgggagaggtcttttcctgaaatagccactgggcggcagtggtggcagcagcagcagctgcagctgtgtcgggacatgcagaaacgtagcagagctaagtcaggagaaatgtagcagaggtaaaccagcctgaagcagtaggagcaggaagctggctcaggctggggcttctctagtgtagtgcttctccttgggtgtacaccaaacttcaaaacacgcttgtccacctctgcagaggccaggttcattcctgggagcaaagcagtaacaaaaaacaccttctaaacttgcagcattttatggttcacaaagtgctccacacctgttaaccaattcaatattcaggaaaccctaaaagattggtattattattattcccatttcactggtgaagaatggaagttacaaagaggcgcccaggctcacataactaataagtggaagagcaaggatttaaacaccagcccgtctggcttcaaaaacttgggcctcttatgtaatgtcacagtagtcagctgtccaggactcaggttatgactgtgtcctccactgctaccttttattccaccctttactctgccacagggcaaggatcttcagtttccccatccaggtttctgggctttccgagagatctagattctagattctagaagtccgcctcctcctctcactcccaggatccagctgggtgacattctcaggacctgaggatcaagtaagttcagagtccccattgcttctcagctccatgcagagtggattctgctccagcctgctcacccctccccaaaggcactgcttacctcatcctcagagtcctccagaccgggtttgcctctagtgcctaagatatacttacggaggcttagttggcttcaggagccccagatcctgagctgctggcaattccctacaccaggctctcaaacatctaggcttgctctctgcaccttctccactatattcagaccaagtctctgggagtgatcaagagagacgaggggtactgtatagaaaggggtagagtctgtatgggaaatgtattggctggtatccttaaggaggcatgaactgtctcctggccatcccctcttacatgtataataggcatctcaaaatttacaggctgaaaagtgaactcccaatctttcccctaaacccactcctgtctctgtcaacagtaactctattcttccagttgctcaggccggacattttggagtaatttttgactcttctttctcttataccccacatcagtaaatcttgctgtccctacttaaaaaagtctatccagaatttgaccacttctcatcatctccaccactgtgatccaagctaccatcatctctatcagcaatagcctcttgactggtcttccccctgtacctccagccctgcagtctattctcaatatagagctggccagtgagccttctaaaatgtaagtcagatgacacctctcttctctaaaccctaagtgccttcccgttcaccaaagagtcctttacaatggcctccaaggaccttcatgatctggtccctgccaaactctctgacctcattttttacttttccccttctcacaacacctggcctttattcaaaagtcacccttaatatttatttatttacttatagacagggtcttgctttgtcattcaggctggagtgcagaggtctgaccatagttcactgcaacctcaaactgctgggctcaagtgatcctcctatctccgactcccaaagcactgggattacaggtgtgagccactgtgcctggtttcattcctaatatttaaaacaacaaccctctctattacccttttccttccctctttattacccttttccttccctctttaatttttctccataatgatgatcacaatctacatattttacttattaattttattatcccccagtagtatgtaagcaccattagggtgggagtttttatctattttgtccactcctaaggaactaccagtaactagaactggaccaggcaaaagtaggctctcagtaaatattcgtggttttaaaaaaattatttatatttgagacagggtctcactttgtcacccagattggagtgcagtggcgcgatcacagctcactgcagcctcaacatcccaggttcaagcactcctcctgcctcagccccccatgtagctgggacatcaggtgcatgccaccacgcccgactaattttttgtagagacagggttttgccacgttgtccaggcttgtcttgaactcctgagctccagcgatctgcctgcctctgtctgccataaatatttgttgattctttcctggatcatagccagtggcttagagaggcaacttaagcatagcaattaagttatggatgctagagcctgatccaaaggcaggcctgtcttggttcaaatcttgactctaccactaactagcaagacacctaaactttctgtgccttcattttttcatcagcaaagcagagacaataatagtatctagctcatagagagcctatggggtcattaataagtataaagcacttagaaaaatgcctgtcacatagtaagtgctatataagcattctttgtaattatatgcatatgagatttatattaaatatcagtagtttagattttctaaaatctttcaatgtgttgtcttgcacttgcccatgtgaaaattcgtttcccatgtttctgctcacttacacaggcttgtatgatccccctgtaatctatctccagggacctggctcttcatcagtaaacttggatgtttcctcgtgttctccctcctgcagtcatttcaaagctgttaaatagtaatctcgctgggccccagtttcccaatctgtacaatgagtgggttggactaggtcatcgtaaagggcctttctaactcttttaatctcccaggtgggaggagggacaggccccacctccaactccacctccttggatatgccctctggctgccaaggggaagggtgacagagtcagctgagctcagcttcaaggggaccaggtaggagatgtgccaacgttcttgggcaagggtggcaatggggctcctgggctgtaggcaggcagtggggaaggtgtcataggtaaatgtcatctggagacactgtgaccagggcactaggagaggcgaaggcactgtggggagagacactcctcttccagggatatagctgtgatgacgagtcagaagacactttgggtctgggtatcttcccactttggatagtgctgggaggcctccaccctcttcagccagccaggctcttagggacagagtgagctgcagagtgagtacaacccaaatacacgggctgcctgcctgagccccagcactgcctgctgcccaccacttcccaagctggaccaagggagcttgggtaggggccaggctagcctgagtgcacccagatgcgcttctgtcagctctccctagtgcttcaaccactgctctccctgctctactttttttgctccagctcagggatgggggtgggcagggaaatcctgccaccctcacttctccccttcccatctccaggggggccatggccagtacagagtcctccctgttgagatccctaggcctcagcccaggtcctggcagcagtgaggtggagctggactgttggtttgatgaggatttcargttcatcctgctgcctgtgagctatgcagttgtctttgtgctgggcttgggccttaacgccccaaccctatggctcttcatcttccgcctccgaccctgggatgcaacggccacctacatgttccacctggcattgtcagacaccttgtatgtgctgtcgctgcccaccctcatctactattatgcagcccacaaccactggccctttggcactgagatctgcaagttcgtccgctttcttttctattggaacctctactgcagtgtccttttcctcacctgcatcagcgtgcaccgctacctgggcatctgccacccacttcgggcactacgctggggccgccctcgcctcgcaggccttctctgcctggcagtttggttggtcgtagccggctgcctcrtgcccaacctgttctttgtcacaaccagcamcaaagggaccaccgtcctgtgccatgacaccactcggcytgaagagtttgaccactatgtgcacttcagctcggcggtcatggggctgctctttggcgtgccctgcctggtcactcttgtttgctatggactcatggctcgtcgcctgtatcagcccttgccaggckctgcacagtcgtcttctcgcctccgmtctctccgcaccrtagctgtggtgctgactgtctttgctgtctgcttcgtgcctttccacatcacccgcaccatttactacctggccaggctgttggaagctgactgccgagtactgaacattgtcaacgtggtctataaagtgactcggcccctggccagtgccaacagctgcctggatcctgtgctctacttgctcactggggacaaatatcgacgtcagctccrtcagctctgtggtggtggcaagccccagccccgcacggctgcytcttccctggcactagtgtccctgcctgaggatagcagctgcaggtrggcggccaccccccrggacagtagctgctctactcctagggcagatagattgtaacacgggaagccgggaagtgagagaaaaggggatgagtgcagggcagaggtgagggaacccaatagtgatacctggtaaggtgcttcttcctcttttccaggctctggagagaagccctcaccctgagggttgcagggaggcagggatatcatgggtgacctcatctctcataaccccttcagttgccgactctttttagccaatgccaatcttctactcctttctcgttgtttctgttccttcctggggccattggtcctacaatcttcctgaaaatcttccccagtcctctttccctgtcccatttcccccacagcctcctatagcatgtgtttctctacccagaccagagcattcagctgaaggggtggatcaggcagagtcatctcaggattggcctgacgtatctgatggtgataaccagaatcaggaagtggaggcaacttccatatcacagatgccgaggatgtgccatatgtagcacccacactgacttcctggttctctctcaaagacagcatagtcttgcttaccaagatgctggaatagggtgtgatcccagggagcctgcatgccagggtccccgcatgtagctgggggcctgacactgttgaactggtgtgcagcatgaattaaagtcctgtgatagggtggggaccttagctgataacagcctttgggacaggaatgggactggaccttctttatgatgtttgctgagaacatgtatatgacagctctcctgtacttaacaaaaggacaagtggatggctcagactgagggggtggagctctcacgtctatggctgtaagttctagcattgaggagtagagcagatttgtgcagaggaaggtggtgacaagaattgacgcccagagctagtgtttcactgatctctccactttctctaggtcctgccccaaataaatgataaatctgtcaccagctctttcagatcaggcttcaggactttgaggccagggtggagcactaggactgggaaggttctttttaaagtttcccacccattcattgcttctctcttccagtgccatcttagcacttacaggcttattggatcaagttgcagaggggaggggggtgcattggaaattgagaagctaacccctaagccttgggaagtaagaatttcttggcaggcattcttgagaagggtgggctcacacttacaggccttctccctctgaaatcaccttccagcctgttggtctcctgagtcagaccccagccttgcctttctttttttcccacccttgctaacctgtctctgatctcttacttatctaatgatactaactcttattggcttctaagcgtctctctctgtagagtagggctggggctggactgaaggaaaaaaaaatgacttcagttcccctgaatttccctttttgttttttgaaaggctcccactttctccctagatatccaggaccttcttgctatgcaggactcctgccattaggagtaaatgaaccggcttttttctcctcttcttactagttctcccagtctcacagccactgttgcgtacactgttcctcatctgcactctcttccttttattcctatgaccatggcctctttgcccatcacctcccctaacctgctgtccccacccagtaaagctgctctttccatcccaactgactcagcctcctccatttcctcagtctatttaactcccatatgcttaatcgagatgaactttctggtctgttactttagggctgtcttcccttgcactttagctttaaacaccttgactttcaccttaggccaatctcctttcttctaggactggaggaaattgcagatgaagccagagaacaaggctggcttgacccactaagacttcacatcctggaactttgcctaagctctcattcctcttagcctggtgtgttcctagtgaacattccacagcagctgtttcctgtctttttcacctccacaagtccccaaattcatctccttcttgtgatctcttaagagagttaccttgcctcctgcgaaactgagaagctctaacgcttcaacttccagttatcattcacgataactactctatatttgccctgtctttctccctttcttccctgaagttccagaataagaggtggtcccctttcttattcctttgtttacctctcttcattatttcaagtctcttccatcacccattttatcccatcttaaaaacaaacaacaacaacaaaaaaaccaaagcattatcactgacaccttaaccctgctgccgtttgtcttttcttttttctttttttttgagacggagttgctctgtcgcccaggctgtagtgcagtggcacaattctcggctcactgcaaccttcacttcccaggttcaagtgattctcctgcctcagcctcccaagtagctgggattataggcacacatcaccacgcctggctaatttttgtatgtttagtagagacagggttgcatcatgttggccaggctggtctcgaacttctgacctcaagtgatccgcccacctcagcctcccaaagtgctgggattacaggcatgagctaccacgcctggcctagaaaccttttattgtaaatattctccctggttgctatagtctttcatatctattatttcagttgcctcataaaattacacctgtcagtagattacattttatttgactattcccctattattgaatatttagatatatttcaatttttctgtgctttgaacatcttaatgtgtatggctttttttcttctttgtaattctgtctctaggacaaattcccaggagtgggattaccagaccaaagagcatgaatgtttttatggattgtgactgccaaaaggactgcaaaaattttcaacaccacaatgacgtatgagttgttccagttcccttgcagcgctagcattggactttagaagaaatctctttagatgattaaacattattttgatattttttcatttctttgattactcatgtgattgaactctttcccatatgtttactctttgcatctttctttaattggcaccctagtggtattcttatatatctaaatgtattcttaatatacatgctatccctttgtcattatttgatgtaaatatttatcttatttattgtgatacttttaattttagttccttattttatcctcttgctttagaatttctctcctcatgcttttatctctctgattactttctatctcctttgctgacttctcttttgctccttaagtaaacagcattcctgagatcggtcacagagtcatagcatttggggattatttaatgccctttgttcatctgactattgattttgccatggagaaaacatacatgcaggtgactcatagtccttgagagtacctcagagatcatatagggtctgtgcaccccctcactttacggtgaaggaaacaggcccagagaggtggcttgcccgtgactcagtaagttagtggcagagaagaggcaaagtcccaggtctcctgactcccagggctccattatataccattataccaagccaactcaattctaggccttcccttctcccaacctccacctctacatcttcaattgcctactagacagtttcacttggaccttccattgttacttccaccccaagatgtcaaaagcaaaactccctgaaccagtttttctacctgtcttgctaatttctgttcatggcgtcttctttcttcaagtcagctaggcttgaaaactctcaggcaagttcaactcttgtctctccctatttcacaggttctgacatttctttcttcatcttgccaattacaattggccttccttttagtctcagcaccaccattttaatactggcttttgtcaccttatccctgactgtcataggctcctaactagtcttccttatctccagtctcttcccatcgaaaggcatcctctacaatgcatattgccagattagtctacccacacactgctttcagagtttcactgtcttactcaaaattttttcatggttcactattgtccacaagacaagtcaaaatccttttgtcagaagttcaagagggtctttgaatcttactttccattattccccagtaaaagtctctcttctctagctaaattggtcttttcattctctttccaaacaagacttggattttctcacctccgtctttattcttcctgtcccccacactggaatgccctccctttcttcttgggctgccctttttctattcagtttccaaggccaggcttaagtcctacttcctgtttgaggccttctctgctgactcttacccacagtgaccttccaggtcactcctagagtaattattgtctctatcagtcattgggcacttttattgtcttttaacattacttctactgttatcttgaattgttatttaactattcatgtatgtttgtcttgagttcccacctataaaccccttgagttactgcgatagaaaggaaagagcatagaacagaaaatcagaagacccaagtctgagctctgattcagaaaatggggctcaggtgtgtcatcttggatgagtcactcagactctctgaaccacaatttcatcatctgtaaaaagaagacaattatctcagctttaagtacctcttcagattctggtgaagctttaagtacctcttcagattctggtgcttaataaatattttctgaatgattatacgttagtaattcagttttttgtttcttcttctgggtatatttccactttgagaggccacaggaaccccaaggaattaaaggccaaggggactttaggaacaatggtggtgggagggcattggaaagatgttttgaggggaagtagacataaccagcatctttcacattccactctgtgggctactcactacttggcctgcctgtaaggctaacctggatgtagggaggaggggaaggtgacacattctgagctttcactttgcttacgttttctattccttcatccaacaatccccagctggttaagtgaaatgcttcactcaggagtctgctctccttcattgatgtgatgaaagccagcttttggtaaaggaagtgataaggagtagtagagagaacaaacaattttcatcagataactggacttgactttgaatccttgatctgatactcactagctgcatgatctcgacaagttacttgatctctctgaacttcaatttcctcgttgataaattgggataagaatacccatttgacaaagctgttgcaaagagtcaatggagtaatggatgacgaaacatcacttacaattcctgtgggcaggaacttcctttcaatggttttcaactttagcatagctggacgtggaataagagctcccattcaagtactaatcaggcccgaccctgcttagcttcggaaatcagatgagatcgggcacgttcatggtggtatggccatagatcatggaaccagaactcaatatttgaatctgctgcttagatgtgatagttaagatcatgacaaagaataaaccttcgagtgtgagaagcagagggctaagaactgatcaccgagggatggccatagtgatggattgggaggaaacagtttgggactctggcattgcatcgagggagaagagagtttcagaaacagggatttaggatagttatttaaaaaacaaaaaacctttgaataaaaaaagagaacgattaagaaagcaatcaacagtgtcaaatgcctaagagaattcaaggaggatgtgattctcagaaacactcaataaaaaatacttgattctctgccaaactgggtttatgcatacaatagataatagccagtggcattgactaaagaggccaattttaaatagcttttgtaatcaagaactttttacatgcattagttggtgaccacacctctttccaaagtttcctgttgaccacacctctttccaaagttttcagaataacccatttaatgggttacttgccataactacagagctgatatttcctatatgagatgagatgtggcttctcatcaaaaggaagagcagaaatatctgagtggaaccaaagagtgagtatgtctatgagggtaccttggtataggtttgattaccagag

SEQ ID NO: 12180 - DNA, 17928 bp, Homo sapiens
aacatctctgttttctctcccctaggctcatttccaagattcctctcatcagggtattattttatcatcttcctgtctcctaccactttcaaaattctcccctgctttcaagaaccattgatctctggagcccagaagtcaatctcactcataccccttagggtccttgtttaaccctcatctcaaaagcacaatacataaaatgtaggcaacccaaaattctctcagtcactcacaggattttataatgttatccaaagtgaaagatgttacagatcaagggatcagcgagttgcagaaaatgacaggtctgtcttacgggaaaaaactcaggtagaaaaccctgcaaagaccaggacagaaaccaacctgacatgaaaagatgagggtatgatttactcaataaaaatctaaagacttgtaaaaaccacataactaattttctctattttgaacatttcctaaactctacaaaaatggaagatataattcttttgaacagtttgccctggctataatcattttcctctctgcctcaacttatgcaatcactctgccaacaagcccaagattgtttattgttttttacatcaccactgccttatacattaatgtggctgtcaaagaaaattattttcacttctaaaacctctaaagcagagtcttgattatttaacttagcctcccacttaaaaaaaaaaagccactgaagaagaaatatttcccttttcaacttctgaagttgctccccattcataactgaattcagaataaatattggtcaaagcataccagtaaattagggcacagtcattttcaaatgaaatgaatttcaaatgacacattcaaacacattaagacttaacttctttcaaatgaaatcattcaaggagtgcagtgataaagttcagcgaaacactaggctaggactcaggataaaaaataaattagatgtagtacctacctaacaagcttagtctaggataatatgttatatgtatagaaacataaacaaataatatataaacataatttttagagattgagcaatattatttaaattttaccataggcattagagttggaaagtgtacctttcagcacaaaatcaattccaagttcaaaaattcaacttaatcatattcccgtattatgtgatcaaatcactgaggtacaattttgaacttggcacatttcttttgacattttatttgcttctgttttcatttctatggcagtaaaatggaatctctctgtcttgggggacacttgggagtgaataatagttaacaaccataacatcaagttcttgtgtggggagtgcaagtttaacttgtgctttataagatctctggagatgtagttacaggtcaaagctaaaatgaaaaccgcatttgcctgtgtgtttacagaatttcatgtgtcatgttgttgcttataagccatgaaaagtcattctctaggtctcagcccatacactgagaaattcaaggagaaagcttaaaagaaaagaaaaaaaaaagagcacctcctgttagatgtgcagggcagaagcctagtgtcaggtgtcatagctaggggatgtcagagtatcctctgccctttttattgtcaccgccagcagcaaggttgtggtatctatagaaggcactgcaggcccgaatcctatctctgcctcctcccagctgcatgggcgtaaataaatcacttaacatctggactctcagattgctcatctgtaaaataggataaaagtaccacctgaagctgggcgccttgaggtggctcatgcccgtaatcccagtgctttgggaggccaaggcagaaggatcacttgaggcctaaagttcaagaccagcttacgcgatataacaagactccatctctacaaaaaaattaaaaaaaaaaaatagccagtgttgtggtgcccacctgtagtcctagctacttgggaggctgaggcaggaggattgcttaagctcaggagttcaaggtttcagagagctatgatcacaccactgcactccagccggagtgagggcaaccaagcaagaccttgtttcaaacaaacaaacaaataaaaccagtaccactttaagagcttgccgtgaaggttaaaaaataatgtctgtaattcagctggcccagtgtccaaaaagtagtaagtacataataactgataattcaaacaagaccagctcagtcaaaatgcttataatatagatttaaggaatccttggtaaaaacctccatatggggctaaaatcactggcatttccactgaccagattttcattctctcaagaaattaaacaaatggatcatggcttctctcaagctgagactgccttaggttgctacattctttccacatctatagcaaatgtgtgatttctgcaaatctcttgcttaaaccccctttatttagaaatcccacttgcttgctctttgtgacgagtttaggttggggagaaatatgtcccttcacatttgtcccttatgtaataatataaaaggaagttgtaattggatttcaccacgggttcatcatttgtgtccctgggaaagtggcttttttttttttttttaataaaaagtcaaaacagtccttccatttgccagaattgatcccaggtattccttatggaggtttgccatgggcttcaggtgtgacccctcggcatctgtcccctaatccccagtgggcactgctagttctggctcaggactcttcacaatggaagaacctcagcttcggggaggctgtaatcagggagataatatctggatatgcaggtggacaggaggcagcagtaaactacggggaatctaggctacaggtctggaattcctcaggagtcagtctgtactctacaagrcaaaacaagtgctaaccattgagactaactccaatgagataaaggccagcgaaagaagcattctcaggagaaagggctcccagggaaggtggagcagcaggggctgcagaagatccctctgcagggagcacctgcacactggcaccaagcaaagacatctgagtgcatgtttctgggtgtgtgtgtgtgcatgcacgtgtacattagaatgagagtaacatctgaatgtgtctacattgtgaatccacgaatacttaaattattatactttgtagcttgcctttatattgatacactcttttttgattttggaaaaatttcctcatacataacacacattaatggcccagcagcttgatttatcaagagagaaatcaataagcatatattgaatgctgactttgtccaagacactgggcaaatggactagacattgaagaatggaggtaacagcagacctagtacttgaatactttcatgttggcttggttgaaattcttgatttaattttcaaaaagaccacatcattttgacataattcaagttgtgtaacagttacaggcttacttcacatattatctctgctattgaagtgtccaaaaaaatcaggttattgttttagtaagagaaacaaaaagtattgcatatgcttatggaaaaaccttaaacaatagccacatatttgctaatttttatggttgattgtttgtattaagtaagtaacatctctatgatctcacaggtatccaataattttgctgagaaattaatctttaccagatagattcaatctccactttaaaatgtatagaaagcctcctttttgggaattaaacattgggcactcatggacatatagaatgccaacaatagacactgggaattactgtggggagcaaaggttaaacaactattgggtactatgcttactacctgggtgatgagatgagtcgtaccccaaacctcagcatcatgaaatatacacacgtaacaaacctgcacatgtacctcctgaatctaaaattaaagttgaaattttttaaaaaaaatccagtagtggtaaataaataaaaataaaaatcttcctttttatgaaaggtatgtattattaaatcaaataagaattcaattttattttagaaatctagaatacttgtgatatttttaaaacttttccttagaataaaataaaacgcagaatccaaatataccaaattgaaaaggagttttagtggccatctataagcaaacagaggtccctgatggagaaatgaaggccctgtttcccacgaggtaggaaatgtatcattacaatgattttaatgtattttatttcaataaatccattctagtcaaaatacatatatgtctatagcacacacagtcagtgtataccttattaataaaattcagtataaacatctttgcaaaaaaactgttatttacacccagaaattttatttcctatcatcaaatacagagcaaactgaatttagaaatctgaatccaacaaaggatttcgaagaatccacaatccatgttctgtacccaattattaaagttcaagtgatagataagtatataatcttaagagaaaagcagattataaaatcttatattgaatcaattatgttcaaaaatgtatataaaatactcatatatacatacatcttctttatgttttctgcatcttctaaatttcctactataaatacatagagagctatatttaaaaaaaaactatagaactattttgcaatgagacatgtagagaattgggccatcatctcaaagaaaacatgtaaaagaaaaatccttattccttcttatccaatcaaaatgctcacaatttaaattcctaagggaattccaccaccctggaattgtactactcggtttccaggtatctacaactctctctgaaagcaggcttctttcaagttaatgcatttcctgtaagaacgttagttctcatgttcaatatataagccatatcaatttcaaagataaataatataccaaacaagaaagtataagaactttatgtcttaaaaattaaagatactggatataattccttgaagcacgctttgcaaagttttcacaacaaagtttaaaatataacatttaatttattctatattgtaaaatttatcctttttcatcatagcagtcaactgaaatggttcactagcctcttaaacttggggttttaatcatttcttaatttgaactgtgtttccactttctccttattgataatggcaacaaaatctgaagtgtttacacaatccattcaactagtcaacacatttattgagcaaccattacaggcaatatctgttgaaggaataaacatagtaaatgctgagtgtagagcagtgagcaatcagacaaggtaaaactgctaaaacaactataataaactctactataaacaactgtactcaaaaatagtacttttccaagttgaagaataagagggaaaagaaacatgcaacatcctaaagccaaggttttaaaatccttgaaaatgcaaattctagtatccatctggaaaatatatttattctccacctttcaccagtgcatttcacagctgcttctgaagctgtattccactaaaaggtatacttgatcatgactggattttacattggattggtttttccaaaggaaacaaatggtttacactggattttccaaagggaacaaacagaaaagatcagggaagaacttaaaaaagcataaggtttaggaagaagtatttaacgtatccattcagcaatcgctcattatcttcctactgtgaacaagacgctaggcagtgctgggaatacaggcaacagactaatttggagaagaaaaattccttatgacaagcagactctactccacccagctttctttttcatataacaaatatttaatgraaaygattattcgattatttctgtatcaatgaattttcattatacataaatcattcacttgttgagctggccaaaaacctggggggaggatccaattttgagtggagaaagtgaacttttcaactgcgacacccatcttgcagcctatataagtttagctttctggcttgctggcacaacttcctctccagttgtggccaccttccccaggccatggatctctccaacaacaccatgtcactctcagtgcgcaccyccggactgtcccggyggctctcctcgcagagtgtgataggcagacccaggggcatgtctgcttccagtgttggaagtggttatgggggaagtgcctttggctttggagccagctgtgggggaggcttttctgctgcttccatgtttggttctagttccggctttgggggtggctccggaagttccatggcaggaggactgggtgctggttatgggagagccctgggtggaggtagctttggagggctggggatgggatttgggggcagcccaggaggtggctctctaggtattctctcgggcaatgatggaggccttctttctggatcagaaaaagaaactaygcmaaatcttaakgatrbattagcttcctacckggataagstgcgagctctagaagaggctaatactgagctagaaaataaaattcgagaatggtatgaaacacgaggaactgggactgcagatgcttcacagagcgattacagcaaatattatccactgattgaagacctcaggaataaggtaagatctcttttggaggcgctttgggaattttttttttcctttttaccattacaatgttttacagtgataatcacctacaactttgatattttccaatttagctgtacttgcagcaattttctcatcccaggttgtttcactccactttatcatttactaagaaatgattgtatttccattatctttctgtaggaaatctgcatttctttacttctcaatattattttatacagatatygtcttagaaaaatgaaactgtcttaaactctaaataaaacagcatttaatatcaccattttcacctttgtgycaaaaatatatttgtataatactagtcttttagggcttcaatcttgtgtgtgtccctctcttttgccagatcatttcagccagcattggaaatgcccagctcctcttgcagattgacaatgcgagactagctgctgaggacttcaggatgaagtgagtcgaataaactgaagatcatgggcgtgtcccaccatgtcttctgtcctactgtcctgccttcattgatataaaatcttctgaagttcacatactccatatatttactgttttggtaaattcacatagggtgttctagaaagtaattagaatctaatgcaattcagattaaatgtccttaaattataagttacttaaacccagggctatggatcacgatatttgtagtgtgctattgactcaactcatgatgtgactgacaccataatcctaccagtgtcctaaacctcaattttctttttttgttttttgttttttgtttttgagatggagtctcgctctgtcacccaggctggagtgcagtgacgcgatctcggctcactgcaacccctgcctcccaggttcaagtgattctcctgcctcagcctcccgagtagctgggattacaggcggctgccaccgtgcccagctaattattgtatttttagtagagacggggtttcactatcttggccaggctggtctcaaactcctgacctcatgatccacccgcctctaaacctcaattttcaatgtatcaaccattgttttcctgatgacacatacaatggaaagattaaccatgtactaatttttatattccttcctccttttccatgctcaactctcccagatataggtaagaaatactaatttcctttttgcttcacaaaatttctacacaggaagttgcaatggccatggttctgaacctgtaaaatcttagtcaaagccactaaagaagtatcagtgttttaagttaaatcatgaagaacgttaagcaaaaagagtaacttattttcaacggcttttagaaattccacttagagaggggctgctgctatttacagccacggcagccagccaaagggaaaattattccctgggatgctgtggtattgggattcatcgctggtaggaaagtattgccttataatttattcacttttcttctcctccccaactgaacagtaaacaatggtgggaaaaaaggaaaggaaaaacacaacagcaaaaactgcatcatacactacaatgctgccattattaagtaggtgcacagatttaagcaagaaatagccctgaagatcagtggccttgttcaaatggttgtgttgattccctcaactgctttgcacttggttttcaggtatgagaatgaactggccctgcgccagggcgtagaggccgacatcaatggcctgcgccgggtgctggacgagctgaycctgaccaggacygacctggagatgcagatcgagagcctgaacgaggagctggcctacatgaagaagaaccacgaggatgtgagtcagacagggcagcctcactcagctactttttttttttctcccagacccaaaaattacaatttcaaatttagaaatctggagtcaggacaagtatggagaatacattgtctccctgttaaaatggccrtttgttttagatttctgtgtgatgtgtgtggtatgtgtstgtgtgatgtgtgtgtgktggtagtrgtgatggtggttcctgctaaggctcaacaaatttgaggcactttctgattttgtcattttcattataaggcaatgacaataggaatgctaacagtcctaattcagtgattttaaaaagactgagtattttaaaagttaaaacaaaagtctaccaataatatataatgttttatatgtcagagaaactggttatacttagcataatgcacaccagaaaactctgaggtgccatggtgcatattggaggctaggtagggaagggatgctggcaataggaagtttctactagattttcgatgattgtggcacaaacagcgtgcaagcccaggtactgtctgcagccctcggtttggcagctgtaggtgaaaaccccagtgagtgtacgccaggcctcctttcacgtgaaggtcgtggtccctcaagaagcagagccaacttacccattaggcacagcaggcactgctcccagggtctgtggtaatttcagggacccatgaatatgtcttaagttcttgtaatatcagaagaaaaatatgaattttgaggttaaaaaagttttaatgtattacattaatatatttgtctttataccaacagtcataagatagaatttttaagtgtgtgtgtgtgtgtgtgtgtgtgtgtgtgtgtgtgtgtgtgtaggaaggggcccaagaggacaaaagtatccagggcccacgaaagtcacaatggacccctgtgcccctctctctcacatgctgtccccaggagctccaaagcttccgggtgggcggcccaggcgaggtcagcgtagaaatggacgctgcccccggagtggacctcaccaggctcctcaatgatatgcgggcgcagtatgaaaccatcgctgagcagaatcggaaggacgctgaagcctggttcattgaaaaggtaacacaaacaacaaaggctttgatacattcacagaaaggcctgcgaacgagctcagcgctcgagccccctggctgtctttgctgttgcagagcggggagctccgtaaggagattagcaccaacaccgagcagcttcagtccagcaagagcgaggtcaccgacctgcgtcgcgcctttcagaacctggagatcgagctacagtcccagctcgccatggtaggctcgtgcgcaaacagacgtagcatcctttggacttccaaagaaaatgctgcatccaaattacattagccgttggctaccctcctcttttcggtcccctccatcgttatttctatgccatttccctcccacgtgcagaagaaatccctggaggactccttggccgaagccgagggcgattactgcgcgcagctgtcccaggtgcagcagctcatcagcaacctggaggcacagctgctccaggtgcgcgcggacgcagagcgccagaacgtggaccaccagcggctgctgaatgtcaaggcccgcctggagctggagrttgagacctaccgccgcctgctggacggggaggcccaagggtgagcagacaacggaggctgtaaacaccttcaggggctgaccaagagtgggcagcagaaatagaaggaatggggttttagttgacagaaaagcaaacaaacaaacacaagtctagtaaagatatgcctgggatttactaaatgctctacactttgcaaagtgttttcacccattatcttacttgataattcataaaatgctgcaaagaacaaaggcaccacggtcagaaacagtttgtaaatgagtactccctgtactataaaagtcacttactcaatttctgatatcaaagacctgatgataagaaggacacatagtagccacctgaaccacctactctaacaagctttccaaaagtgatcagagtctgcactagttggaagaactcaggcctacaaattgggaaatctaayttctcagaccagatcttccattaaaagccaggttgtttcactttttgaggtcatctcctttgttttcttacagtgatggtttggaggaaagtttatttgtgacagactccaaatcacaagcacagtcaactgattcctctaaaggtatgcagaaaccctagaatcacttagaataagtcggaatcacatttattaatgcaaaacctgtaagacctcattgactactgcattattattaattttaatttaaagcatatttatattctgagccaaggaaaaacatttatgcattcctgcacaaaatgagtagtctataccatattaaaacttttgggggcctgggcatggtggctcatgcctgtaacctcatagcttcgggaacctgaggtgggaggatcgcttgaggccaggagttcgtgacccacctgggcaaatagcgagaccccatctctacaaaaaacttaagaaaaaaaatagctgggtgtggtggtgtatacctgtgatctcggctactctggaggctgaggcaggaggaccgcttgagcccgggagttagaggttatagtgagctatgatcatgccactgcattcctacctgggcaacagagccagaccctgtctttaagaaaattaaaattaaaattaaaaaataaaaaaaatggcaaagcagaagggaaaaaacctactctgctgcaaggtattatgatcaccataaccacctttgaaatgttttcttaaaaaaagttttcatatatgtacaaggcaacactgaatacatttcattgtcattggctaaaacacatttttgagaagtaaaatttacttttgaaagtttaattagatggattgtatcaaccaatgcttaatttagaagcctacattaaacaaccagtgttggattaatatttgaaacactaactcttgcccccttattccatttttatctttagacccaaccaaaacccgaaaaatcaagacagttgtgcaggagatggtgaatggtgaggtggtctcatctcaagttcaggaaattgaagaactaatgtaaaatttcacaagatctgccccatgattggttccttaggaacaagaaatttacaagtagaaattattcctttcagagtaacatgctgtattacttcaatccctatttttgtctgttccattttctttggattccytattcacattgaatcctttttgcccttctgaaacaatattcagtcacaagtcattttggtcatgttggtctttgtaacaaatcaaaattaccttatatccttctggacctggagtagtcttttaacgaactttcttctggtaacccggaatattttttaatcatagagctttaatcaagtagtattgttttaatagagttaattgtaataaaagatgaatggtaataatgtgaaatgtatgccttgattccaacaagaatgtcaagagcatagagagaagtttttgaaatactactaataaaatagaggctgggagtaatgactcacacctataatcccagcactttgggaggctgagaggcaagatgattgcttgaggcccggagttcaagaccagcctggacaacatagagagacccccatctctacaaaacattaataatgataatgtagataaaactgggatgaagatgtcagggtttgaggattaagctaaaagaagattcttttagaagttctggcctttttatgtaagctcatcaaggttgtagcaaaattatattgtctactacagcagttgagagttgtcctgttcattttctagcaccatcattcatgcagtcaagaaacgctgagcccctacagtgtgccaggttggaggctcagtgatgaatatgatatggtccttgccttgaggagctcatggttgagggcagagataaacacctaccaagaatgttgatacagtgagatctgttgaatagaagttcaaagggctgggcaccatggctcacgcccgtaatcccagcactttgggaggctgaggcgggcagatcatgagctcaagagatcaagaccatcctggccaacatggtgaaaccccatcttaactaaaaatacaaaaattagccgggtgcagttgcaggtggctgtaatcccagctactcaggaggctgaggcaggcgaatcacttgaacccgggaggcgaaggttgcagtgagccaagattgcaccactgcactccagcatggcaatagagtgagactctgtctcaaaaaaaaaaaaagcaaaaaaaagaaaacaaacagaacttcgaaggacacatggaagaagtgaacaattttccaggaggggcaatgaaatgctacataaagaaatcatccaggtagacgagggagaaaggcaacagggcaaatacatgtgaaaagacagagggtgtgaacaaacatggttctgctctcctttctcctagctggcagcagtgaggcccagggtggggtccccactggggcaggtcagacccacaagtcagtaacaaaaatcatgttctgcattagggaaaaaggcagccaaagtctcagcctgagtagatggtggttcaacatgggttgccaaattcaaaaccctaaaaggaaaatgggcaaaattcaatgattaagagcctggcctctaacatcacactgggttcaatttccggctctgctacttaataacaagtaatttaacctctgtgttcctcagtttcttaaagtggaaatgatagcaatgactgcacctgcttcatggcacgggttttgtgaagatgaaatgaggtcgtgtacctaaagcactaggaacctggaaactattggcacctagaaagtactcaatatttgtgtcttattattatttactgtatgaaaccaaagtgggatgaagaaacaaggagacacggtgaataaggagtgtcaaagaagcagaagggagagggaggagttgtgttagacaagaggaattccagagctgagtccaaaggccaatggctagtcagccaacttaagctgatttgcttcagtatgcagcttttccttttaatatcatttatatggccagatgcagtggctcacgtctgtaatcccagcactttgggaggccaatatgggcagattgcttgggcccaggaattcaagaccagcctggacaacatggtaaaactctgtctctacaaaaaaaatttaaaaaataaaaaaaaaattagtcgggtgtgggggtgcacacctgtagtcccagctacttgggaggctgaggtggaaggattacctgagcctgggaaggtcaagaatgcagtgagctgttatcgtgccactgcactccagcctgggcaacagagtaagaccctgtctcaaaaaaaagaaaagaaaaaaatatttttaatggtttcagatcctccactcatctcactttattatacgctcagctctctttgtctagccttcaccttccagcacacatcctagggtaacctttacctttcagactcaaaaggattttatcaaggcctctgaacaaggtccacagcccccaagtaataaataaaggattctacttccctggtgctcaaaagtgtctgcaaatagttactgctttaaataacatctgttttccttacaactacataagaatggtgtgagactcaaaggggaaaggattttgcacaagtataaatgcaagggtcatttattagctagtaccatagtttctcagcattcccttctcttggaaattttttaccacaaagctcccagagccatcactctgtaggcagctttttctcagacttctgtgactgaatgttggctcaatcctcttgtcttttctctatactccctccccaggtaacctcatctgatccctccccagcctctcctccctgatcttatcccatgggttttgtttgtttgtttgagagggagtctcgctctgttgcccaggctggagtacaatggtgtaatcttggctcactgcaacctccacctcccaggttcaagcgattcttctgcctcagcctcctgagtagctggggctataggcatacaccaccacgcccagctaatttttgtaattttggtagagacagggttttgccatgttggccaggatggtctccatctcttgacctcatgatctgcccgcctcggcctcccaaagtgctgggattacaggtgtgagccaccgcacccagccaatcccatggttttaaatagcacccacatattggtgacttgtggcagcctccaggttggtgccagtgatccctgcctcctggtcttcattcccttgtgtagttccttctcacaatgaacgaggagcagatttattgaagaagtgacagtatatgacctccaaagatagatcacaaaggcctttcagttcttccttggtctcctggactatatgctcttggggaagtcagctaccggcagggttatatcgtgggggaaaaaactatctgaaaaaaattcgtgatttcacaaaatttcccattgaagttccaatggctaggatttcatggcacagccagcaagacccaaataatagtccttttctgatactatcttggccaaaatatcctataagtcttcacttggcaaaggaagcattacatttcttattatgtaacttcactttgccctgttctcactgacaagaaatgcaactagcacagcatctatcagtcccttcgggcggctagaacaaaatacctcggaccgcgtggcttaaaaatgagagaaacttatttctcacagttctggaggcagcttcactgtctgataaggacccgctttctggatcatacacagcttctcgatatatcctcacatggcagaagggacaaagcaatgccccagggcctcatttataaggacaataatccccttcgccagggctccaccctcatgacctaatccactctcgaaaaccccacctcctaatactgggtcattggtgattaggtctcaacatacaaatatggggggacaaaaactttcagaccatagcagcatacttatcatgagagtctatccctcattcactaggccacaagccctaattcaacacagatgtgagaggtccctttggactcggcaagtaatgaattgcagaagtggaaggtctgtctttaaagaaaagaactcctaagaaaaaaaaactgaataaagaatcctatagcaaaagacaagtacattgtttatgattatcctaaaatctaaaattttacaaatttaaatttttactttgatatgcatatgttgtgtgtaaaagctagtggaaggtctggaaaatactgtatatatactgaactgttatagtagttatctcttggggattagcaaggggtttgaagaatacctttattaaaatgtttaacaaacagcatatatgactctgataatcagaaaaaaaaataaatgttattctcccaaacaaatggctttgcaaatgggtcacagcaggaaggaaccacctagaaaaacaaccacgtagaaaaacaaagccaaagctttatttctttaggctttgtaagagtgccatcttctggagtctcaagaaatgaactttaaaataaactaaccctggctgggcgcggtggctcatgcctgtaatcccagcactttgggaggccaaggcaggtgggtcacttgaggtcaggagttcgagaccagcctggctaacatggcgaaaccctatctctactaaaaatacaaaaattagccaggagtggtggcgtgcgcctgtagtcccagctactagggaggctgaggcaggagaatagcttgaacccaggaggcggaggttgcagtgagccaagatcacaccactgcactccagcctgggcaacagagcaagattccgtctcaaaaaataaaataaaataaaataaaaataagctaagcctgtgtgttcaagccacttgagatgtattgatactagaaggtttatcttttaaaacaagaaagaagaaaaaaagcaaaccttttacaacgatcaacttagcaaattaaaattgtcttatttaactaataattagtttccaaaaagttcaccagtaaggaggcagttctacaaggcataaagtgaaaaagaaagttagcaattatttagagttaagaaaaccagccaatcaataactactcaggctttaaaaacatactcaaatatcaaatgaaaatgaaattcttaatcatatagctgagtaaatgatttttttatggggtagtaaatgtttcttaaatcttggaactgaatccaagattgtgctgagctaaagaaaccagacacaaaagaatacatactgtatgattccatttatatgaaactttcagaaagataaaatctcatctatagtgacagaaataagctcagtggtcacctgagctgaaaggtgtgggaggagtgagaattaactggttaacctggaaggggcacctgagaacctttgggaccgatggaagtgttccgtatcttgactgtggtgatgggtccatttagcaaggctcttcaaactgcacatttaaaacgaatatatttcattgtaagtaaatattaactcaatagtcaattttaaaataataattgaatattctttcttcagatgatactgtccacaggcgcagagaggccatgtaggatcgtcaaaggtgtcctagggcaagctggctcttaatcactgatcagtaaatattcaggaattttccaagctggctattaaaccatgggcagcttgaaattggccatgatgggagtatttacacaaatggaacttgggcttttaaaatgtatttcccagaaaactgttttacaccagtacaccactgagcatagaggttaaaagcacagttcaaaggcctgagtttgggtcccagctctggcactttctaatggttttacttacctctctgttccatagttctctgttccctaaaatcaaggcaaaaaaggatacctgcttcacgccctattatgagaattctatgggtcaattcacacttggcatatagtaagcactaaatattacctgctattattatgcaaagaaaaaaagtctctctacaactaaagaaatgaactggtttacatatttcccccagacatatttattctttttcttcccttcatgcacaatcctaaattattccacttttgtaaaaaaaaaaagtgcacttttctcacccaacatatggggaggggggaataatatttatcttccctctatcacaagttgtgagcatcaaataagccaacttctgtgaaggagcttaacaagccataaagcactttgaaactataagatgtgctttcttcagagatggggtcgctctctgtcacccaggctgtagtgcaatggtgtgctcatagctcactgcagcctcaaattcctgggctcaagtgatcctcccacctcagactactgccatt

SEQ ID NO: 12181 - DNA, 31956 bp, Homo sapiens
tgtggaagctgaggaaaggccggtgacaggaagatgggtggcgtgacctgtggatgctgaggaagtgtcggtgacaggaagaggggtggtgtcacctgtggatgctgaggaagtgctggtgacaggaagagcggtggcctgacctgtggatgctgaggaagtgtcggtgacaggaagaggggtggtgtgacctgtggatgctgaggaagggctagtgacaggaagaggcgtggtgtcacctgtggatactgaggaaaggctggtgacaggaagaggggtggcgtgacctgtggatgctgaggaagtgtcggtgacaggaagaggggtggcgtgaccggtggatgctgaggaagggctggtgacatgaagagggttggcgtgacctgtggatgctgaggaagtgtcggtgacaggaagcggggtggcgtgaccggtggatgctgaggaagggctggtgacatgaagaggggtggcgtgacctgtggatattgaggaagtgtcggtgacaggaagaggggtggcgtgacctatggatgctgaggaagtgtcggtgacaggaagaagggtggcgtgacctgtggatgctgaggaagtgtcggtgacaggaagaggggtggcgtgacctgtggatgctgaggaagtgtcggtgtcaggaagaggggtggcgtgacctgtggatgctgaggaagtgtcggtgacaggaagagaggtggcgtgacctgtggatgctgaggaagtgtcggtgacaggaagaggggtggtgtcacctgttgatactgaggaaaggctggtgacaggaagaggggtggcctgacctgtggatgccgaggaagcgtcggtgacaggaagaggggtggtgtcacctgtggatactgaggaaaggctggtgacaggaagaggcgtggcgtgaccggtggatactgaggaagtgtcggtgacaggaagaggggtggcgtgaccggtggatgccgaggaagcgtcggtgacaggaagaggggtggtgtcacctgtggatactgaggaaaagctggtgacaggaagaggggtggcgtgacctgtggatactgaggaagtgtcggtgacaggaagagggatggcgtgacctgtggatgctgaggaagggctggtgagaggaagaggggtggcctgacctgtggatgctgaggaagtgtcggtgacaggaagaggggtggcgtgacctgtggatactgaggaagcgtcggtgacaggaagaggggtggtgtgacctgtggatgctgaggaagggctagtgacaggaagaggsgtggtgtcacctgtggatgctgaggaaaggctggtgacaggaagagaggtggcgtgacctgtggatactgaggaagcgtyggtgacatgaagaggggtggtgtcacctgtggatgctgagkwagtgtcggtgacaggaagaggggtggtgtcacctgtggatactgaggaagcgtcggtgacaagaagagaggtggcgtgacctgtggacactgaggaagcgtcggtgacaggaagagaggtggtgtgacctgaagatgctgaggaagggatggtgacaggaagagaggtggtgtcacctgtggatgctgaggaagcgtcggtgacaggaagaggggtggtgtcacctgtggatgctgaggaagggctggtgacaggaagagggatggcctgacctgtggatgccgaggaaacgtcggtgacaggaagacgggtggtgtcatctgtggaagctgaagaaaggccggtgacaggaagtggggtggcgtgagctgtggatactgaggaagtgtcggtgacaggaagagaggtggcgtgacctgtggatgctgaggaagtgtcggtgacaggaagaggggtggtgtgacctgtggatactgaggaagtgtcggtgacaggaagagaggtggcgtgacctgtggatgctgaggaagtgtcagtgacaggaagaggggtggtgtcacctgtggatgctgaggaaaggctggtgacaggaagaggggtgacgtgacctgtggatgctgaggaagtgtcagtgacaggaagaggggtgctgtcacctgtggatgctgaggaaaggctggtgacaggaagatgggtgacatgacctgtggattctgaggaagtgtcggtgacaggaagaggggtggtgtgacctgtggatactgaggaagggcggtgacaggaagagggtggcgtgacctgtggatactgaggaagcatcggtgacatgaagagggtggtgtgacctgtggatgccgaggaagcgtaggtgacaggaagaggggtggcgttgctgatgagggccgtggtgaaggttttaccagaccctgaaggtgacagagtgtgggtctgggtttgtggagatgtaagcccastggatgtgatcgatggaggtgtgggtgggactgttgagaaggtgtcggttgcctgggacgccaggctgatagtgtcagaccctctgctggttcttgtcctctgagtctgggccatccgggaaatggcggctgtctcctgaggagaggcactgggagaagttgggcttgactgtcctgtcggtctccctgcagtggaggcctcagagagggtgggatgaaaggtgccggggacgatcgaagacgccattcctgtgcttactgggatggcaccatgactggctgaggcggacagcaattcggttgttgactgggttgtgtgactgtccctggaggggtttgatgaaaaccttgtcgtctctcctgaggtggatattccttcgcttcctgaaggtgttgtgccactcgccccggatgaggaaggggtagctgtgcccgctgaggtggttcgtgaccctgaggaggccggttcgctggtctgtgtttgtccagaggcctctgtgctctcagcctggtgggtatgggtcatggctgctgctgtgtcaggtgaggtgctggcagaggctgatgtccattgtccttctgggccccctggtgttgacactacagagttggccagagtaagggcacctgttttggaaagtgacgtgcctcctgagggccccagggtggcatcatggctgctgggtgytgcctgcagtgctgtggtcggggcctgggttgtgtgaccatccccggtgggagctggggcaaaggttgttgctgcacttatggtgggtgcgtcctgaggaacaatttctgagggcgagtgcccactggctgtgaaggaagaacctggggtggtgactgtcttggtgtcagtcatggggkagacggacctcgtggtttgtgattcttgtgtggtctgcggggcttgagtgtgacccctttgggaaacagctggtgattcctgaggagaggtgcttgtggaatgtattgttgaatgatttgttgatggtgccgttgtaatttgttgkgatgtgtgtctatccagcataggtgaagaagatggggatgtggccgtttttatcatctgagtcacactgtagcttgggctgctgagaagagcctctccagtggtccccgtttcttgtgtccattgtgtctgggcgcctgcccctgttgtttttgggagagttgtgctgtgggaggagtatgtggtgggctctcctggttcccctattgctgagaccttagaggggacccttggaatagtgccagctgyccctgtagatggatttcctgtgacaagcctagtggcagcacctgttgatgttgagggcagttctgtttgtgaccaagttgtgtggcctttgctggagaatgaggaaggccatgttgttgtttcatgtagagtaaatatttcttgagacacacctggagagaatgagctcctctcatgaggcygtcctgtggtctctgcaccttcactctgctgggtgtggaaagctgtggatatttttggaggtaragaactgggggagagtgctgttgacagagtgtctgaccaccatatggttgaaactttggaagtgattgcagaaatggttccacttacagatagtgatgtctcctctgtgtttccaagagtagagtctctggagrttggcattctgaacacctttgatgttaccaggaatgtattgctgacactggaaggggatgagrtggttgtttcaccagaagggaatgtctcctgagaaactgttccacttgggttgaatccacttggtgaggataaaacagttgatgttgtaaccggtgtgagggtgttgagggtgttgatttgagatactctggtggtctccacgctctgagtctggtggttcttagaaaaagctgttgtgtcctgagkagaagtccttgagaaagttgctggtgattgtccttctggatcaamtgttactaaggctgctgaggtgactggcataagacttccagtaacaggtactgatgatgtctcccctgggtttccaagagtggagcctgtggaggttgtcactgttatcttctctgatgtcatcatggatgtgtttgtgacactacagagggatgaggtagctgtttcacctgaaggagatgtcttctgagaaacagtccctgtcacattgtgtacacttggagagaaagaaggagttgaagtggttctgtgtgttagggtgctggtttgagattccctggtggtctgcgtgctccgagtccagtggttctgagaagaagctgatgtgtcttggatagaggtcctccaggaagttkttcgtgattgtccttcctgtccagctgttattgagactgctgaggtcactggggtagaactttcagttcctgctgttgatgtctcttctgtgtttccaagagtggagtctgtggaggttgtcattgttatagtctttgatgtcatcatgagtgtgttggtgacactggagggaaatgatgtggtcatttcatctggaggagctgtctcctgcgtaacagtctccatcacattgtgtacacttggggaagaaaaaagagttgatgtcatcatctgcgtgagggtgtcggtttgagctttgctggtggtctccgtgctcttagtctggtggttctgagatgaagctgatatgtcctgattagaggtccttgaagaagctgcagttgattgtccctctagtgtcgctgttgttgagcctgttgaggtgactggggcagsagttttacttccagttattaatgtgtcctctgtggttcctggagtgaaccaaaataggcaagcagagagctaaatcatgaatgaactcctattcacaattgctacaaatagaataaaatacctaggaatacagctaacaaaggatgtgaaaactaccattcttcacagaatgagaacaaactactttaaaattcatatggaatcaaaaaagaacccaaatagccaagacaatcctaagcaaaaagaacaaagtgggaggctacctgacttcaaactatactacaaggctacagtaaccaaaacagcatggtactggtaccaaaactgacrtataaaccaatggaacagaatagataccttggaaataagaccacacatctacaaccatctgatctttgacaaacctgacaaaagcaggcaatggkgaaaggattctctattcaataaatggtgctgggaaaactggttagccatatgcagaaaactgaaactggaccccttccttacaccttatacaaaaattaactcaaggcaggttaaagacttacatgtaaaaccccaaaccatgaaaaccctagaagaaaacctaggcaataccattcaggacatagacataggcaaagattttatgatgaaatctccaaaagcacttgcaacaaaagctaaaattgacaaatgggatctaattaaactaaagagctctgcacagcaaaagaaactatcatcagagcaaacaggcaacctacaaaatgagaaaatttttgcaatctaaccatctgacagaggtctaatatccagaatttacaaggaacttaaatttacaagaaaaaaataaacaaccccatcaaaaagcaggcaaaggatatgaacagacacttatcaaaagaaggcatttatgccaccaacaaacatatgaaaaaaggctcatcatcatggatcattagagaaatgcaaatcaaaactacaaagggatatcatctcacaccactcagaatggcaattattaaaaagtcaagaaacagcagatgctggcaaggctgtggtgaaataggaacgcttttacactgttggtgggagtgtaaatcagttcaaccattgtggaagacagtgtggcgattcctcaaggatctagaaccagaaataccatttgacccagcaatcccattactgggtatatgcccaaaggaatakaaatcattctgttataaagatacatgcacacgtatgtttactgcagcactatttacaatagtaaagacatgaaaccaacccaaatgtccatcagtgatagactggataaagaaaatgtggtacatatgcagcacggaatactatgcagccatgaaaaaggaatgggatcacgtcctttgcaggtacatggatgaagctgaaagccatcatcctcaacaaactaacaggggaacagaaaaccaaacactgcatgttttcactcataagttggagttgaacaatgagaacacatggacacagagaggggaacaacacacactggcgcctgtcagggaygggacaaggggaggaagagcgtcaggataaatagctaatacatgcaggtgatgggttgataggtgcagtaaaccaccatggcacatatatacctgtgtaacaaacctgcacgttctgcacatgtatcctgaaacttaaagtaaaaaatgaaaagaaataaaaagaaaaaatgaaaaattaatatatcacaactgtacatatttgggggataaaaaaataataagagatggggccgggcatggtagccccacctgcaatcccagcactttgggaggctgagatgggtggatcacttgaggtcaggagtgcgagaccagcctgggcaatatggcaaaaccccgtctctactagaaaaaaaaatacagaaatagctgggcgtggtggtgggtgcctgtaatcccagttactcaaaaggctgaggcaggagaattgcttgaacccaggaggtggaggttgcagtgagcagacatcatgccacttcactgcagcctgggcgacagagcaagattctgtctcaaaaaaaaaataaataaataaaataaaaaaggagagagagatgggggtgcaggattcccacagaggaaggcccctgataagcactgcttcaaatcgcctagaaaaagcacagttgcaggaatatagccaatggtcttctccagctcccgcctgtcttccttgtgaggaggaaggtgaggttagactagaatggtgaattaactgtgttaaactccatgggaagargcaaacagtacccctgctataagccgggttaactctctcaacttgaattatagcattatctttcttaaaaataaattaaatttctacttttctttttcgttgttaacatctgtgccaatctggtaaaaaacccaaggggtaaatgcatatactcttgccctggtcacagactaccaagaagctaatattattgaccataaccactttttwaaaaaaaattatttcccaggcagaggccaggcatggtggctcatgtctgtaatcccagcattttgggaggccaaggtgggaggatcactcgaggccaggagtttgagaccagcctgggcaagatagcgagaccctgtgtcttaaaaaataaaaataataataataataataaaaatagatattwaataaagaaaaatatttcccaggcagaatgtttaaatattggctttttttgtttaaaatatttcacagcacctgcactagccacataccatcttcgtgaatattaccttagcctctgagtctctgaaccaagaagaaaccaagaaaacttgcctttttttttctcttagaaactgactcttttgggttttcattagttccctagctgttctcaaacttctttcttttttctttttaaacatatatatatagagagagagagagagagaagaaagagagagagagagaaagaaagagagagagagaaagagagacagggtcttctgtcacccaggctgaagttcagcggtgtaattggccttctgagtagctgggactacaggcacacacaaccatgcctgggtaatttttttatttctgtagaggtggaatcttgctatgttgcctaggctggtgtcgaactcccggcctcaagcgatcctcctgcttcagactctcaaagtactgggattaaaggtgtgagccaccgctcccacyctttttttcaacctcagtgctcctagatagttggcaagatgatactcagagagacaaagtctcagggaagaattcagcttcaagtccactttctggaattgactgtaattcgccaccttctcttcttcagacagtaacttagactctcaagtgagtgataatggttatgaaccagctctaattgttaaaaaagtgactcacgtgcaagcttctgcacttcattaatagtaactgcttactggtgacacacttgtaaaccgacgtggacaaaggcacgggctgaaccgcagagccctctgggaggtccctgggcccctggcttaatccaaaatgactccacttcaactttaaacggaaacttcctttagttggaattaggttgagatttgttgataggactctaaactcgatgcctgctttctcctagagaaaatttgcaaaacttggtttctccaaataaggtttaaatttaaaaacattctctatgcagttatttttaaccttatttcatttccctgataacataattaagagcatttgtctatcatcaggctttgagtagacaggagctatctaggggccaaactttctgaatgtgtaaattcttggcaattaacatcttttcagagcctgcatcacctctgctaaaatcagtgtcagcagcagaagtttcatgacagcaccgtccttttttttaaagtaaagatttttgtagttctttataaaagtggcacagctccatttcagcaatatggaagaagagataagcctctaatagcaaaaccagccratgccagataaatacaggttataaatgtaataaatgttttctaatgcagaggtgagatgagaagaaagaaagggaaacactcaggagtgaagaagttaacaactaagatggtgagtcaatgcccttggaaatgtgctgactgaaaggctgaaaaaggaaaggaagcaagaccctcggtcacgacactgaactgagtttccctgcaaaaagctggaaccgccagcaaaaaaggtrgactagaaagaccaggaagaaaaaagaaaaaggaagcagaatgaaggatatagtaacagaccagaactcactatagaaacaattaaaaatggaataaatgaagccaaagattagttctttgaaaataaaacaaayacctggcaagagaaagaaagtgggggggggtgtgggaggagggagagagagagacagaaaagacacagatatcaagattattagaaacaaaaaagggtacataacttcagaaaaaaaatttaagagacagtgctctgatgaatttataccaaaaagtatgaaaacttagataaattggatatactgtccttaaaaatataatttatcaaaaatgaattaagaaaaaaacctggctaaaaactattttattttatttatttaattttatttatttatttttttgaaacagagtcttgctttgttgcccaggctggagtgcaatggcatgatctcagctcactgcaacctctgcctcccaggttcaagattctcctgcttcagcctcccaagtagctgggattacaggcgcatgccaccacgcccggctaatttttgtatttttagtagagactgggtttcaccatgtcgtcctggctggtctcaaactcctgacctcaggtgatctacccacctcggcatcccaaagtgctgggattacaggcatgagccacctcgcccggccactataaactattttaaattgaatcagcagtttaaaaaatataatctaggccgggtgcggtggctcacgcctgtaatcctaacacgttgggagggtgaggcaggcggatcatgaggtcaggagattgagaccatcctggctaacacggtgaaaaaaaaattagctgggcatggtggcaggcgcctgtagtcccagctactctggaggctgaggcaggagaacggcgtgaacctgggaggcagaggttgcagtgagcggagatcatgccattgcactccagcctgggtgacaaggtgagactccgtctcaaaaaaaaatatgtatatataatctatccaccccacaaaaaaatgcaggctaagatgagtttacaggcaaatcagacattcaaggaacaggtaatttcaattctatacaaacatattcagagtttggaacaggaggaaatgatctactaataattttataaggttggaaaccaaagataggataagaaagacaaactatagattaataagtcccagtaataatacatggaagcatcgtaaataaaatattagcaagccaaagtgcatcatggccgggcgcggcggctcacgcctgtaaccccaacactttggcaggccgaggcaggcggatcacttgaggccgggagttccagaccagcctggccaacctagagaaaccccgtctctggtaaaaatacaaaaaatttgtatttttttggattacaggtgtgtgctgggcttggtggcacacacctgtaatcccagctactcaggaggctgaggcacgagaattgcttgaacccaggaggcagagattgcagtgagccgagattgtgccactgcactccagcctggtgacagagcaggactctatcttaaataaataaataaataaataaatattttaaaagtacatcatgatcaagctgagtttaaatcagaaatgcaagataaagacaatgctttcttaatgtaaatcaccatataaacagaatggaggggagacacaatcaccacagcagatacaggaaagttatttgataaaagtcaacacttactcctgttaaaactcctagcaaactaaaaagagacgttaactcttttaacctgataaacaatgtcaattataaccccgtgtaaacattatacttaaaacaatagaaacgtttctgtaaaatcaggaataaaaacaagatgccaacaatcactgcttctaatcaacattaggttgaaggttttagctggtgaaataagacgagaaaattaaacaaaaagtatgagagtacagaaatgtgattttgggtatggaagggatgaaacaagcctatggttatttgcagataacataattgtttacatagaaacttcccraacatatacattattagcaaagttctatatccataatcaaaattttaaaaataattgcattccagctgggtgtggtgattcatgcctgaatcccagtgctttgagaggctgaggcaggaggaacacttgaggccaggagttcaagaccagcctgggtaacatagcaagatcctgtctctacagaaataaaaaataaaaaaataaaaaattagctgggcatagtagcacacacatatagttccagctactcagaagttgaggggggaggatcacttgagcccaagagttcgaggctgcagtgagctatgatcaccccactgtactccagcctgcatgacagagggagactctgtctcaaaaagagatttaaaaacaaaataaaactgcattcctatatatcagtgaaagagaaaatatttttaagactatagtgtttatgatggtgaccaaaaaaagtacataaaaataaatctaacaaaagatgtgcttaatctttatggacaaaattgtacaactgcattgaaatatgccaaagaaaacacacatactggttacgtgcatttgggaacatttatagttgaaagatcaaaacccataatcttgctaccagacaatgcttccttccaggatgtttttatgctttaaaaaatatatagtttaggccaggmgtggtggctcacacctgtaatcccagcgctttgtgaggctgaggtgggcggatcatgaggtcaggagatcgagaccatcctggctaacagggygaacccccgtctctactaaaaatacaaaaaaattagccgggcgtggtggcgggcgcctgtagtcccagctactcgggaggctgaggcaggagaatggcgtgaacccggggaggcggagcttgcagtgagccgagattgcaccactgcactcctgcctgggtgacagagtgagactccgtctcaaaaaaaaaattaaaaattaaaaaatatatatgtatagtttaacttattcagtatacataattttgtatcctgcctttttagccatacctgatatgagcatttcttcaagatactagcttcgtaaacatagcctgagaagacgcacatcttttatgtcttggatggcagttccttgcttcccccttttggagtcctacaagagctggctcagggggactgggagagctcagctccatagtaaaatctagggtgctgtataaaaactccccctgctgagctctggtggcctccttcctaacaaagccactcccccaactggaagcgttgttacccttcccattttctgttaaacaggagcaggtctctctcctgtaccacatcctgctgtgtgtccaccatacccacctctctgtgcaatgagagctcgggggtcatgtggactccactgctccctgctcgcaatttctccttaatacatcttactttatgcccgttctgtgtgttgctagtatgtatgtgtgacactgtgtgtgtgtgtgtgtgtgtgtgtgtgtgtgtgtgtgtgtgwgagacactgtgtgtgtgtgtccctgcccttatagaacattggacatagcctttaaacatttttttttccagatggagtttcacttcttgttgcccaggctggagtgcaacggcacgatttcggcccactgcaacctccacctccgtgattctcctgcttcagcctcccaagtagctgggattacaggcatgtgccaccatgccaggctaattttttgtatttttagtggagactgggtttcaccatgttggccaggctggtctcaaactcttgacctcaggtgatccactcacctcagcctcccaaagtgctgggattacaggcgtgagccaccgcgcccggcctaaacactaaataataagccatcatagagaaagctcatattgttaacttactgttggacaattaggatatttccaatgtattgcttattttaaataaagccctgatgactatcttcgtgtctaatgttttgtttacattatttcagctcatctccttaacataaatttctatcagtggaattgctggtttatgcygttataaaatttttcatgttattaatacagactgccaaatttctttgcagaaagcttatgccaatttacagacctgttggcagtgtgcaagagtgtgcctgtttccccatatccctagcctgtgaacaaaggggcatgatccaggacaggccccatccctcacctgctgctctttgcttcacagcatcgactgaaaatcggccaggtgcggtgcctcacacctgtaatcccagcactttgggaggtcgaagcgggtggatcatttgaggtcaggagttcaagaccagcctggccaacatgatgaaaccccatctctactaaaaatacaaaaattacccaggcatggtggcrtgcacctgtaatcccagctactcaggaggctgaggcaggagaatctctcaaacctgggaggtggaggttgcagtgagccgagatcgcgccactgcactccagcctgggcgacagagcgggactccatctcaaaaaaaaaaaaaattcttgctaaacagggctgtgtcctggtagtcctccttttaaatctttatttagagaacttgctcatcttgagccaagttgattagagtttcctgctgccgcaaataggagggcaagtgagtcactgcatgtggaggacatagttttattgtctaggggagaaggcgctgtcaaaatctctcaatctgttgggcttgtgaggaggaagagattagcattcgttacgacaaaactacagttattgcatttgtctttcaccatcatttaaacaatacctctgaagccactcctgcaatagattgattattyagctgtttaggaaaacaatttgcagataactcaatctactaagcttgagtaggttatttgtaggtaagaaatcctgtgttcaagtatgacctatctttacaaagaagaaaaagaaagaaatcctagtggatggagagactatggagaatgatttttggtaagaaaatggttctcagctgggcatggtagctcatgcctaaaatcccagcacggacaggcagaggcgggaggattccttgaggccaggagtttgagaccagcctgggcaatagctcaagrccccttctctgaaaaaaaaaaaaaaaaaaaaagtggttctcaaaaggcagagggtgcatcagcattttaacacatgtccagagtgattctgatgcaggtggtccgtggaccccacgttcagaaacacttcccttaaaataaaatgatagtatccactcttaacaatgtttgtaagccaaaaccatctcgctgaagttgtcaggcagagaaatttgaagccttgatcaagttttattctaaaaaatactcatagccttgttcttgctgctcaagtgttggccagaatgaactgaccttggctctcaccaggatgcaagtcaggcccttcagrttccgtsagattgtcagacaactgaaacttgttctcactctggccaaacgcataaacttggggagcagagagctgggagatttgcgcctaaagagttgatattggagagaaacaggtctctcctctctcttctctccccgtgacmctccattttctacttcactgaaagaaccaaagccgtgcccttcatctccttcaatgcccagagccttctccgcaccctccccggggccccggggctccctcctgcccggatggctcactgctctgcctctgtgtctccgacgttctttctgcctttctccttctctcctgcctgtgagcatgttcaggtgtctgttggcctaaaacaagtctgtcatccgtctgtgtcctcctcgtccctccagcagcatgaaagccgggcttcccctgccgcctcttctttaccacgcactgctcgctctgcccccacctcactcacttcgctcaagccgttttcctcagagctaccagaatctccttcccaacagcaaaaacgattttctccagtcctcacgcgtctcatcagttcggccccatccattcattcattcatgaatctgacagatgtgtattgcgccccccsctccacgtgctctccctggccggcggccccgtgccaccacccagcctcaccctcattgaagctgacgggtcctgctccaccgtccacgctcccgggccctccactccactccccttgccacctctctcccccgctccacgcccagatgacatgtctccagccctttccctctcctgctgcccctccctctctggccaccctgcgtctactctcacgccttacaaatctgtacttctccctgacttcccacccatatgctggcctcaccctcccagggatttcctgcctagctcatgcaatgcaacaggtccaggtcaatctttccttgcaagctttcttccttccttctgttcatgctaacaacagtcccccagacatccagcccagaaagctgtgggtcctctggatttctttctcttccttgtccccygtgtcctagtcagtactcgttgatcttcctcccaagtgttcaccccatcgcgtcctcttgtttgctttgccacatcctccccgtcgctttgactactgcggcagcctcctcactgcccctgctgactcgggttccgcacccctgctctcagcctccaccrcacccctgctctcagcctccaccrcacccctgtgggttgatcctcagctctgagggccaggagggagggttgctgctgctgtctccttagctcgaattgctttggaaaatggcctgccctgcctgccctggaaggtgtctggtaggtcctggggtcacagactggtgactggcattggtcctgggtgtctgcgtaggtcccgggggcgtgggtctagtggtcagagactggtgactggcattgccattgtgacacggatgtcagaaaccagaatcctcagagggaggccactgggcaagaatgaccttcgtctggttgtgactgaggaaagatacttccagcgcgtctgtgtgcgtggcagggtggcttctgtaataagaaatggccacgccaagggatttctcgtttctgcgggagacattgttcagttttgtagccggcagcttaaattcaaaatgcattttaaacatgttttcccctttctcttgggtttccaaatacaaccttgaggcarctgcaaaggccgttttcctcagcctaaaaatagacttcacgcccctcccttttctcacgatctgtacacactccctccctcttctcaccgtctgtacacactccctcccttttcttgtcatctgtatacactccctcccttttcttactgtctgtatatactcccttccatttctctgcgtgcgaggatcgaattatatgtcttcctaaaagttgcaggggctaaaaccttgagagagacaaaccacatctgaaaatccagctgcaaaatcccagaaattacttcaagacagctcttgttaaaataatgtcagccagaggtccggacggactgggacccagaagagccaccagaacaagacatgcggacacaggactcagcccgattcttgcgtgccttccttatcaaggctttcccctctgaaaattaaagcagctactttaagtagaaatctggctgcttcccctttactagttttggttaataaattcacgttcttcctaccagaccttatgaattaaactatccgtttaatataatataaactctctgcaagcagcgagagcctccgcatctgcgctgggtcgagtgactgagggtcagctgacttgtgatgaacacaccagggaggtggggcttctttttacttctctcgtaggcacgttatgactctatgaataatacaaatgttcacagctcatgttcatgtggtgctttatagcttatcttgttaatagcggccccatttcacaggcggggaaatcgagattcagcggccccatttcacaggcagggaaattgagatttgaagagaccgagtgatattatatgccttggaagtagcagggccgggggctcggggtaagagccattgctcggaagctgcgagctkytcagctctgggactgccaccgagtggatggagagctgaggcaaagatggagaaatggtcactgacctgccccaagttcttggactgccacatgcagagggctctgagcctgaggccgagccaggcacattctcggggtggacgctgtgacactggggtgtttttgcaatgttcctggtgtctcttttctgggatgatgttagagtgagtgtgaaggctgttgacaccttaaggtgacaagatcactgtgagaagacacacgtgtgtcattgagtaaaacggatagtttttaagacattctctcagaggargagtctccatccagggacgaggagggcactggcgttggcactgaggtagagacgttccccacatctgagtccttgaaggctctgtcaagcctctgccatcacgtcagccagagatctcccatcaaggtagttcttttctctccttgaaccacgtcaggtgggagacggcccacagctgcctcacgtctgttagggctccaggatgtgaaggccgagtggcagtaggcatcgttttccccagatggcccctctggtgactccacaggtgtgccgaggtgacaggtgtgctgttggctcgggagaaggagtggcagcagtatgagtgacgctggcagaagacagattccaagaagggtgaagccactccctgaagacacacaaagcctgcggctttctaagtgctgtgggttgaggcttattcctagcatctggtctgtttgtcttgggtttttcctggaactggaggtgaggaacccgtaagccgtatcgccacagtgtttcactttcctggaggggaattacttcctgacgggtggggccccttgccaggctgcctcgggcagggcagtgtaagcccaagggaagtgcccaacggtaaggatggccttgaggagaacattcagccccacacaggcagcaggcggcccggaaggcgcgcagacgctgaaccgctggccccaccgcctttggcagggagctaatgctatttgtgtatcagcccagaatcaactgtgaccagggttgtgtccactgggtayttccctagaattcaagatgaggaaagacactaactcaagatacccttggaataacwgayctcttgtgatctccagmgcctgaaacgagacttggcatacagcagtgacttcrtacacatctgtggaatacatcccaggccctgtggcctttgttgccttcagccgaggctggagagagggtgacgttgcctgtttctttatctttatcttttttttttttttgagatggagtctcgctctgtcgcccaggcaggagtgcagtggtgcgatctcagctcactgtaacctccacctcccaggttcaagtcccttcacagtggactccaaggcgagaactttacccgttctttccaacgatccccgccgaagtcacaccccaacccatggatcccaccaccggtcatttgacctcatttctgtcagcatctggtgtggcagcacccagccactctggtgatcgccacagaagctccagcaccaaaccaagaagcaccaaaatccggctgtgagcacagcacgccggccagctcaactctcttttccccaacgcctccttctcggaggtgccatctccagtctccaccatcttggtgttgccacccatctctcctggctcccactggggcaggcacatcctcctagcctagcgctgtcctcaggagcctggctgcctctccacagtggttagcctcgggctgtcctggtgtggtggtgtgtgcctgtgatcccagttggaatcaagtgcttctcctgcctcagcctcctgagtagctgggattacaggtgcccaccaccatctcctgctaatttttgtatttttagtagagacggggttttgccatgttggccagtctggtctcaaactcctgacctcaagtgatctgcccgcttcagcttcccagagtgctgggatgacagccatgagtcactgtgcctggccttgtctgtcattttaattactcaaaatccataatctgggccgggcgcagtggctcacactggtaatcccagcactttgggaggccaaggtaagcagatcacttgaggtcaggagttcgagactagcctgaccaacatggcaaaaccccatttctactaaaaatacaaaaatcagcagagcatggtggcatgtgcctgtgatcccagctactcggcacgagtatcccttgaaccctggaggcagaggttgcagtgagccgagataacgccacagcacttcagcctgggtgacacagtgagactctgtctcaaaaatataaataaataaaataacataaaattcataatctattccacagcttgcaaagccctgcgcgatctaacacctgccttctctttcaagtcctccaaggggccaagctctttcctgcctctccatgagctccgcctctgcctgctcaggcctggcaccttctccacctggctgtcctcagcctcaggcctcagctccccgcagaacggttcctcacagggcccttcctgacttgtcagtcagatgcacctcccctactctctggccattcgaaatgcagctctcagcacaccctgtacttttccacactgcatttaccacatgtgcagttgagaacatttcygtaattatttgatgtctgtctgcaccaagattttagtgccaagagactgggccacgtctgtttcactcttcactgtgtgcatccagtgctgtgtcctagaacaatgtcaggaacttaaggcaggcgtttcctaaatggtggtttaattaacaaatgaatgaatgaatggctgtctcagcagggtgtgtgaatgcttctgttcttccctccgtcggtgggctgggctggtttggagattgccgaaaggctgtgtgctgcagtgagtcaggagacctgggttctagtcccagctgcctcacttatgggttctatgatcttaaacaagtcacttaacttagagagctttgaaaagcaggaactgtgacgcattcatcttcctgtccagagcagctggcatgagtagaaattctgcaagtgaatgaacaactccaaagtctaggctgtttcttattccaaattcccccaaaatccactggccactggacttttggaacctaaactgcaacctgggcggggcggcatctctacagagagtcgatgtctgtcctctgtggtccctaaacacatacacggggagtggagctgcgggcaacccaggccagtgcccttyctccaagcagggccgccattgcaaggcctcacgtgcaacacaaatgcccagttcctgagacttcttcagartctccaggaaaagggtgaaaaggcatttaaacctctatgaagtagggccaggcacagtagctcacgcctataatcccagcactttgggagccgaggcragcggatcacctgaggtcaggagttcgagaccagcctggccaacatggtgaaaccccatctctactaaaaatacaaacattagccgctgtggtgttgggcgtctataatcccagctactcgggaggctgaggcaggagaatctcttgaacccgggaggcagaggctgcactgagctgagaccacgccactgcactgcagcctgggggacagagagaaactctgtctcaaaaaacaaacaaacaaacccaaaaaaccaacaacaacagcaacaataaaaaaaccgtctatgaagaaatcgtckatgaggtgccaacagactcagttattttgactcaatttctcagaacatgctggggcgggaactcagcctagcagtaagaaagacgtatatttaaggtaaaaggctgaaactagggggagagagagcctataaggtctctgtcctggccttcagagaagtggctctgtgagctacacgatgtgcatattttaagcacttaacagcaccgtgaaatcagagaaaagacacagagtagcaaaaccacccgttgagcgtacaaaaggccaaccacttcttgtcctctcattgcctcttgtccttagcaatgaagacacaaatcacttgcgtgtcaagcactgccaggccagcctctgccaggccagcctctgcctccacggctgagcccagaaaccaagggcgtggcgggactcacaggcagggagcggtgaggcagagctgtccgctggagcgagcccctgctctagggccatggccctcggggtccgttcatgcagcaagccacattctgaatacaccaagccagcccttgcaaacccacaggaagcacggggtggctttttagaggcacgaggatccttagatgaagggatatgaccctgggccgacacaagtgccattccgggttcaatcaccctccttcccccgtcttcccaggcctctttctcaaacacgtctttatggcttttcttttttttttagacagagtcttgctctgtcacccaagctagagtgctgccatttcggctccctgcaacctctgcctcccaggttcaagccattctcctacctcagcctcccgagtagctggaattacaggcgctcgccaccacgcccggcaaaattttttatttttagtggagacagggttggccaagctggtcttgaactcctgacctcaggtgatccacccrcctgggcctccaaaagtgctgggattacagcgtgagccaccgcgcccggccctttatgccttttctactttacaccagatgctgtctcgtttcatcctcatgacaaccctacrtagtagccccttccccctgggctcagttygccgatgaagagcctaagactccagagccaaaaggcgttgcctgtgttccctgggctgccaagggcgtcgctgatgctggacctctgagtttcagcccctgctcttccctgtgcaccttgctggtcgttggccaaaatttggctgatkttcctggcaggacctcttgtccagggatcctttccttttgagtgtcctggagcacagtggggtttcccagaggggcagaggggtctgtggagagttttggtgtcctcggtggcaagttgaggtggcctgtcccagactgacagatagaccgggggttctccgaggaggggcccataaagacccttccccgtggagtgcgctgtggccggcgtcccctcccctgcctgccctgcacttgctccagcctgtcacctccctggggtcactgatagtgctggagaccaaggcctatttcgacccagttgcctttccctgtggcatggaaccaggacggccaggcttccttctgagtcattcctgcctggggcgaccagtagacaccaaatttccatctgtccttgtctagcccacctctgtctgctgtgycttatcctttaacccttgagagccagggctgttccttaaggaaaccctcattgcggcagctcctttgtggaaaccctgtgtttttcctctggcctgggcttcagtgtgacccagcctgggtgagggtcctgccggcaagtgtgcaaacagaccctagactcaagtataggcaggtcatctgtaaaccccttcagggagccaaaaggaacggggctggctggctgccagtcctccagcagctgccctgtgggggtgggggctgcccacccgcccttggtgactgcttttcctgccaaggccctggtcatgcccggtcagatgtgtgggtgccatctcccagccacgaccatctcctctcctggcccagctccacttggtccccttagcgacgcaaaggactcagcgctccacgacatgcctagcttcttcgggtcgtcayggagacgcccttgcacaccaacagtccttcactccttctccgggtcacgcccccgtgcttttccacgcccaccccaggtcttgcccctctgcgctcctctccacagaccccacttcctggctccacatggagctgagtgtccagctggtacccagcacatttgggctcagctttaaatcacagatttggaaactcaagaacttgggcgtcaggaggtccaaccgttcaccactgctttttacacaggggaccggggccctggggagacacggggcagggcctggtcacaggggccagaacagttcacggcaaagacttggcmctggggctcctaaatccaagctgcctccccggcgccccaagccccagcctcgctctgggagtcatgattcccgtggagactccttcaaccacatctgcagggcagggccgtgtggcggctccttccggcctccacgtcctcacggtgggatgagcactggagcggggttgtgtggccagggtggggtgggggtgctggagggtggggaggtgtagggaggtggtggcagtttcctttgccctcagcctagtcctgaaacatcccgaggtggaagggtccgcttcaccagcatggcttctcttgcagcctttaaacggcaytcgccttctgactcactcccaggaagctcctcaaatatgcgcccaagaaatattttccctcggcgactgttcttagcctgctgagaggcagggcaggagctgagactctaaccccagcttgaactctggaccccagactctcccccaaagactcagacacccagaaacacagaataaaacttggtcctgaagccagagggacagcctggaaagtgtggggaagaggacgggggcccccgagggaacatctcccacaggcctggcatccctcccctcccrgctctgtacacggaggagcccaaggccaatgccggggctacgagccccaggcaaggccgtgacccaaatggaggcttttaaacccgagctcagaggtaagaagcccacggccagcacctcccggccctctgcgccctggccgcctcctccgcaccaccctcccggccggcctgcccctctcctccttgtcgcttcccttgcttgctgctgtctcccgatcttctcctctctccattcccagggtcctcagtttgtctgcgtctcacctgtctcgtcctctcaccctgcagctttacatgagttttcttccgtctccatcacccagctttcctggcatcccctctacccccagctctgtacacaagggtgtacatctttctccttgactctgttcctcttgctctggctctgcctgtctttctctctgcgagtaagcctgggctctcaccatggatccttccagacatcgccgggctgctctctggccctctgttctcttttctctctctttcgagcattctccctctgtctttcccctcagatcttgtcccgtatctgccagttcatgcctcctcttccccacttttctcctcttcttattttttattttattttatatttatttatttatttatttatttatttatttatttatttattttgagacagagtctcgctctctctcccaggctggagtgcagtggcgcgatcttggctcactgcaacctccacctcccaggttcaagtgattctcctgcctcagactcctgagtagctggaattacaggtggggcccaccacgaccggctaatttttgtatatttagtagagacggggtttcaccatgtcggccaggctggtctcgaactcctgacctcaggtgatctcctgccttggcctccgaaagtgctgggattacaggcatgagccaccgcgcacggcctccactcttctttctctctccctcttctcttcctcttctttccctctctgggtctctctccaccttccccccatgttgtcccattcatctctttctcctttccctctccctctttttctctcccttctcttcctcttcgctgtctccctttcccctattctctctctctctctctctgtctccccggacctctttctctgacagctcccacctcccccaagtgctccccgcagccagcctcatctgctgtctccatcacttacctgggaccacatgcggaaggaggcagagacacaggcagctcagggacacccaggggaccctcctccagcgtgcccccttcatggctgcggcaaaagtccccctggctccctggggaagctccacggcccagcagctgcagtgtgaggagcagacgtgagcccgtcccctcaggcggctggcccgaaccaagtgcgtttctccgaaggggccagggaacctgggaagaggacaaaagagggcggggccccacgctaatcacccttttctctcctcagccccaccccactaccccaccaggaaagaaaacaccgatacacccgttgctctgcttctcatcagcctgagctgagtggcgggagggatgggaggagacatgggggaatgggaacaggtcacactggaaatgggtgggccaccctcctagccgggttcctgggtcctctcctccctccccaggggctgcccctgtcccaccagagctttgggctgctgggaagaatggggaagaaagggccccagagggagcgaccttggggctgtatgaatgggggaaagagagtgagacttaagcagaccccaaggaattgggaagcggggaaccatgtgggtgaggggcaggaacagaaatgcactgtatgccgtcttttggaaaggggtggtgtgcttggaatatctgctcagtgcaggcgcgtggcagaccccagacgcgtggcagaccccagacgcgtggcagaccccagacgcgtggcagaacctcagtgcagacgcatggcagaccccagacgcgtggcagaccccagacgcgtggcagaacctcagtgcagatgcgtggcagaccccagacgcacggcagatcccagacacatggcagaccccagacccatggcagactccagacgcgtggcagaccccagacgcgtggcagactccagacgcatggcagaacctcagtgcagactcgtggcagaacctcagtgcagacgcatggcagaccccagatgcgtggcagaccctcaccagatggtggacttcttctttccagggcagggagctggagccagggtgcagggagccagggacagtctgggagactggcctgagggagctggcatgggcagtgggttgaaggcagaacctcggtaggaggaagcgactgtaacctgtgaggaggtggagctgctcctggagacctgggggctctgctcaccccagttccacctcttggaactcacaggcacaagcgaggagggaaagggaccccaagtagggttgtaaagacgaagagggcagttggtgtagctctctgcaaaggaaaacggggatacctccgctcccctctttgccacagtgtgaatctctgcttctgattcctcaagacttgattcccgaatgtggggtgtctgtggggtgactcgtcccagagcagggaccttcgatgctcagacactgtggggcccaggacaaggactcagggtttctgcattcccaagcagagccagccttgtccagcaaggagtaggcaaccgacgctgtggcgctgtctccgagggtcacggaggccctgtgaccacttgcttctagaagctgaaagtctgttcatggccccaggccaaagcctgggccacgccataataatgcggataccgtggggaagtggcgtggtcccccaacagtccctccagctctgggtggacgagctgaccctgttctttcctggaggtaagaaaatcataaaggtaaagagtcatgtggagcatcctgtgggcgcctggacggggcagcaggagggacctactgcagggaattcgcagacaccaaggcccagcttggccttcgtgatcattttgcacttttttttttttttgagatggagtcttgctctgtcgcccaggctggagtgcagtggcaccatctcagctcactgcaagctccgcctcccgggttcacgccattcccctgcctcagcctccctagtagctgggactacaggcacctgccaccacgcccggctaattttttttgtatttttagtagggacgaggtttcaccatgttggccaggttggtcttgaacccctgaactcagatgatccgcccgccttggcctcccaaagtgctgggattacaggcgtgagccactgcacccggcccgtggtcatttttctgtcagctcttgctcgtgggtccccccattacctttccacaggttttgtttggtgacgctttcaggacaacagttttccatctctagaggagaaaggagcatccaggtgagaccaaactaagcgctggacatcttgttgaccgaacacaggtagctgacctctttcccatgccaggaaggccagaggcacacagcgctctccggaagctgctgtgacggccgagactccaggagggcgttacaaacccgggcttgatcccagctctgccaccgcgtcaccacaaagtcacagcctcttcgagctgttttcctcgttcacctgtaaaatggggataacacctatctgaaaggttgtagggtgggagtgagcctgtagatgctgaggggctgcgggagtattaggacacctgttgtgaggacacctgttgttacgacacctgttgtgaggacacctgttgtggaggacacctgtggaggaacgtggctcctccttccatccgggcatcatccctggagggagacacaaacgagggccagccaggatacaggaggagtccggaagtgaatttccaggcccaggtctttcctgcgtcccctttgagtcttataggatcctgattaggagcgtgagatcctggagaactgggcgtgcgcactcctgttcacctcttccctgcccacgcccgtttcccttctgctttccagctcccctcaatatgcccattttccagagttaggatgcgtctgggtctctgtgataaatggctctgtcttcatctgggttgggtcacgggacacccatttgtccttccttctctcctcccaaggcatccgatggggacagaatggggtgaatgagaggggacaaaatgagtggcttctctagttccttgtggccgaaaaacctcctaggcccgcatactgctgggtctgcataggggcaggagtctgaagtcaggtgtaagttaatattccacgggaggcaggaagagcttagtgtggatgtggggtgtaagtaaattggagcaaggataagatcatgagattctcccagacttggcttgaagagacagctgggtttgaggcagcaaagccaggatctccaagagagattccccttctaagctacccaagtaggagtccctagttttttgggtcccctaaaattgcttacctttatatcatttatgcctcgtgctgtgaataaagttcaatcttgtcagacttaggacaactaggctgagctcgagcaggaagctggatgtttattaagtctgatttacctactcagtctggactaaaaaggtgtgtggattccctagtcagtgacccagcatgaagccggtcactagagtgccaggccctgagcctgtccccatggccctgtgaagtacaaagcgctgccctacctctcaagtgagcacgctgaggctccaggagcttcatcatccccgagtcaccggccaggtcgggccatctagggaaactggagagtgttaactccgcagttacagccttctgggccacacactgtcccaaagctggaatttgagctctgttctgcctggctccaaagcaaaagaagggcaatcacctgggctgaccgcccacgacatccttcgctccgggtcctttcccggtggcaggtggagacggccttttggaggggcctcgctgtccagctgcaaggatagtggttagtggacagctcccagctgctggcccctgcagggtgggccttgcttttatgctgagctcatgctcttctccaggtgaccctgtggccgatgactaagcaaagtggcatcacagtgacctcaccatttccaccccacaagactccgccaacaggcagtctgcccctcagagcgccccatgggcaggagctttgtggctgtgtcagctgtgccacatcctcctgcccagcccggcctccttcttcttacacaggtgccacatcctcctgcccagcccggcctccttctccttacgcaggtgccacatcctcctgcccagcccggcctccttctccttacgcaggtgccacatcctcctgcccagcccggcctccttctccttacgcaggtgccacatcctcctgcccagcccggcctccttctccttacgcaggtgccacatcctcctgcccagcccggcctccttctccctacgcaggtgccacatcctcctgcccagcccggcctccttctccttacgcaggtgccacatcctcctgcccagcccggcctccttctccttaccgggtgccacatactcctgcccagcctccttctccttaccaggtgccacatcctcctgcccggcccggcctccttctccttatgcaggtgccacatcctcctgcccggcctccttctccttaccaggtaccacatcctcctgcccagcccggcctccttctccttaccaggtgccacatcctcctgcccagcccggcctccttctccttacgcaggtgccacatcctcctgcccggcctggcctccttctccttacacagatgccacatcctcctgcccggcccggcctccttctccttacaaggtgccacatcctcctgcctggcccggcctcctccttcttaccaggtgccacatcctcctgcctggcccggcctccttctccttaccaggtgccacatcctcctgccggcccggcctccttctccttatgcagatgccacatcctcctgcctagcccagcctccttctccttaccgggtgccacatcctcctgcctggcccggcctctttctccttaccaggtgccacatcctcctgcccagcctggcctccgcccttctccttaccaggtgccacatcctcctgcccagcccggcctccttctccttacgcaggtgccacatcctcctgcccggcccggcctccttctccttaccaggtgccacatcctcctgcccagcccggcctccttctccttaccaggtgccacatcctcctgcctggcccagcctccttcttcttaccaggtgccacttcctcctgcccggcccggcctccttctccttaccaggtgccacatcctcctgcccagcccggcctccttctccttaccaggtgccacatcctcctgcctggcccagcctccttcttcttaccaggtgccacatcctcctgcccggcccggcctcgttctccttacacaggtgccacatcctcctgcccggcccggcctccttctccttaccaggtgccacatcctcctgcccagcccggcctccttctccttaagcaggtgccactcccctatagccttcacattccttccaccaactcagcatttgcttctgggaggacccgacccgagacactcacgtaaaagaggatgcccacgtacagatgtggcagcaggccctccgagctgggattcagacccaggtcagcacgactccaaaatctttcctcctctgcagctccttattccatggttcagcagggaggcgggcgggctggaggccccggcacctgctgtatgtggtctctatccgaggccatggtgaaagcagggaggtgggtgggctgggggcccagcacctgctgtatgtggcctctatctgaggccatggcgaaagcaggggccctggtactagggtcacacaaaggccactgtcattctcttgggattcggtttctcctttccctaaaagtgccaagcattctcacgccaattagctcatttcctgtctcatctcacctctgtggtggagcagggcatgatttttacgcatgcaacgtcttcttacgggcatccctgtgaagcagggccaccccggggcacaggagggcctggaggtccagggatctaaactcattccattcacccagccttaaggagaagaaaaccgaggccaggaagtcagcaagaacatgaagtcggtgacccagcatccaggtccccggatttgccacctgtgtccttttgtggggcttccctttgtaaagcttgaaagaataagaggatcttaacataattttaaaactggaagagaccctggtgaccatgtcatccgaagccctcattctaccgtggaggaggtgtgggcccagagagaagggaggtccttgttggcgcagccggtgagcggcagggtgtgtcccggagcccgggtttccagcgccctctctgtcttgctgccgagcgtccacgtctgttcggttgtctttgcacactcctggctcccagttagaccgctgctcccaggcggaacgtctgccacagcggacacgtacatgcggccaccatggggactgaatgagggtgggcccacaaagctctccaacgcggggttctgacagaaagcccaacccgggccgaaagccatcttttaaaatgaagtt

SEQ ID NO: 12182 - DNA, 23239 bp, Homo sapiens
aagcaccagctcatctacattccctgacagccttggatatgcagggcttttttatggacatatttcagaagctaaagcttttacctcaatgttgcagagacactcttctaacttcatgacaacttcagaaaattcgggtcttccctgtaaatagaaaaaagaacttttttcccttaagaataaaaggaaggagactctctttggatgttaaaattgggtattagcatttgtaaagaatgagattaacaataaagtatatttttatttaaaatacacttttattgaagtgttaattgaatgttcatttgctgttcatggagagatgttgagtctccctctgataagagttttaagtcagaatttgcaactacattcagataatgaaatagtggaaaagctttaattagctttgcatgtttttaaatggcaggtttcctcttcaaaatgaaagaataatagtgaatactaaaaactattaactatctcagtgccttgtaatacactgcacactgtgtataaaaagaactgctaaggctagatttataatgaacttcacttttgaaaagatcatctcagattcaaaactaagatgatgatagaaacctcaggactatgccttactttagggtttaaggtaagctttttaccttcagacagtgccattaaaaatattgcccattatgaacctctgtgtcagacgagtttggttaaaaaaaagtttattccaaatatatttcaagctttgttccagttgcaagggatataaaaatgattattggaaaaattcttggaattttagaaaatgttggcctcttctgagaaaattgtcttcttttgtcagatcctaaaactatacaccctatcatttctccttttttgaaactttcactgccaggaggtggagagcccaatttaacattcaggttcagtaaccaaataatttagattcttagtagaacaatttctcccttactatctagcccacccctgagaacactgcttcccttataagctgtttcctctcacatactccttgtatctctaggttggtgggggcagtgggagcagtgggagcagtggagtgagcaaaaccctgtgtcttccttgctgtcactgctacttccaaatggtttctcctctaaacaccaccagcttgtcaggctataccaccagagtctagccacaccccctcattctttggggattttaaaaactggcttacttcatactctctaacactactctttgtacttttattatccatgcaaatgatcattaaaatagcctgacctctgggttcctttgcctactcttctccaatgagcttgtcctccaaactcctttagtcactcagccccttagttataccctagaccctgtcatgaccaatgcctccacccctccatgctctttaacctctcaatctttatcagacaactctctgagctgtccctttctctctacctcacttcctctagaaacctgactccaacaagctttgatcacactggtacttggaagccattttaccacttaaaacaaaacaaaataaaacaagagctttttattacgagcagttccaaatatgtcctaaagtagatgctcttctttctacctacctacccatctgcctatctttttccctacttgtttttttgctcacttcatcatcttttcgctgtcactcactttccctttaccttatatttcatttacatttatcattagattcacttccaactatcactcccttccacacatcctcaactcccttgcttcatcttgcatttggtacagtactgaaagaatcctaaactttattgaatccattctgcctggtctcacttcaaaatcttgaccctctaatctcccatggaccgtcagtactattcagagagcctattacatatttctagtccattcactctctcacacttcggatggctattttgtaccttttcctctctcctaaacctctagctcccactactacattgacctactcacctatgacctacataatttgccctcacttttgtttctgtggatgaaatttgcctgattctcaggccaactccttcacttgtgtgctccagcaataattctctcatccatttttttttgcatcgttcatgttccttctgtattgtttaatctccaccagcatacagacatactatacattctcctatcttaaaaacaaacagcaaaataaaacccttaacgtcctccttcaagctactgttccattgctgtttactttacagcaaaattgttctagagttatccaaatttgcggtctctaattccccttctcccatttgcaatccatcctaatcaagctttctcctacaacactgctgaaactgcccttgtcaaggttacaaagatctcattgctaaattcaatggttacatctcagtggtcatttcacttggcatagcattaaatataagcaacaattcctttgtccctgaaacatgtttttcaattggctttgaggacaccattttcttattttatttttttctgcgctcattggcttcttcttagtctcctcttttggtttcatctctcctccttatctttaagctttttattgccccaagactcagtctttgagtctctttaccctttaaaattaatttgttgaggagttaattcagtcttatgtctttaaaaaacaacttccagattattatctctagcccagtactttctcctgaactctaaactcatacatgcaattaattatatttatagcctttcccatttcagtaaatggaaactccatccttctgcttgcagaggcaaaaaaaaaaaaagcaaaaaacaaaaaacacacacaaaaaaagtgatgatgtttgactactctatcatactttactcttatataccagcaaattatattgatactaccattcagtatctgaatgatcaagtagcttatattagatcaaccctcctacagaaaacaacgagaaactctggacaaaatgtaaatgacagctacctgaaggcactggaaagttaataaaagcaagtagatcctggaggggagtgagtcacttagaagaaaggaactagtatatttcccacctctctctctctctctctctctctctctctctctctctctctctctctttatagcatttagcctgagggtagaccacttctgcattttaggaaacaattaaaattctgatggtttgcttgtttgaaggaacagaggacagaattcagggcaactggagtgtattagttattgttttataacaaattaccataaacctagtgatttaaaacaatgttcattttttatctcagtttccactggtcaggagtccagtatagattagccgggtcctttgctcagagtttcactaggctgaaatcaaggagtcagcaggcactgtgattctcatctgaggctcaaggcctcttttaagcgcattggttgttggcagtactgatttctttgtggttgtatgacacatgtctgttttcttgccatctgttgcccagaaatgactctcaaattctagaggatgcctacagctgcttgccaaataggcagttcacaacatggctatttgcttttttcctaaccggcaagggcacatgcctgacttccactctgtgaccagctgtaaaacttattctgcttttgaagggctcacccagttaggtcagacccacttgggataatcttcctttagtcatatgatgaaacataatcatgggagtaatatctcatcatattcacaggttctgcccacactgaaggacagggtattctacatggcatgtacaccaggggacaggaatcttgcaggtcatgttagaatcctgcttatcacaaatacgcagtagagaatgagaggagatcctggaaaaagccctggagtctgtgtgtaaattctacctcaatctctggtttgcccctgaaccacacatccatgaggccgactaaccggccaggtaggactaaaataaatgaactgagattagatctgctgccccatgcagggcattgttcttactgttttctcagactggaattacctaatgcttattctctgcccatggaaattcactgtactctgcaaggcccaactcaagagctacatccttcttaaagcatccaagttattccacaaagtaattattcacttgcatttagatttacttcgtttctccttgtgttatagataggtatttacatgtctatcactagctagaaagttctttgatacaatggtttatttactcttagacacctagcacattccatcagacaggttaaatgagctcaaatttgttaaattaaattgcatcattatgataaaaaatcatctggaatatgcttacctctcatccttctctacaccacatcatcccttccttgtattactacaattgcctcctatttttgctacttatgttctttgcttatctaaaagtagttcccaactcagtagttaaaatgatctttaaaaatagacatcagaccaagtaatgccactcactatagcctccaattacttcccatgttatttgggttaaaacgctatgtctttgcattcatctctaaggtatacaacaacctgctcctatgattctgtgccctactcttcctcttacacactccactctggtcatcacaccaacctcctcatgcccttgagaactttgcattggatcctctccaccatgacacactaatgccttcaccttctccagcttattgttcaaatgttgttttatcagagagattttccttgtttgccatatttagagccctcgagtcaatgcgatcttctccttttcttgttttatttattctagagcatttatcaccatatgacttaatacatattttatattatttgtttattgtttatatccttttatagaaagtacacttcacaagggcaggtgcttgtcagcccctgctctatgcccagtactgtgagcagtgcctagcatgcagaaggtgatctacaaatgcttgttgaacaaatgatagaattaatcattttatgttttttctacattttattttgttctcaaactatcttattatataggtagagggttttattataatttgctccttgtttttttttttttaatcaaccagggaagatattataaatgaattgtcttttttgaacataaaattcaaatgatgttaaatatttcactggggggttgagaaagctttaaaataaaggtaaagtttaacatttactaaacacttagagtacccatttaactcttataatactctgtactgtagacatttattatttctattttacacatgaaaaagcaaaaaataaaaagaaatatttttttctaagataatatagtcagtaaaaacagagctgaattcaaagctaagtagagcttgtgagcttaatcttgacatcatactcactccctaggtgtggcatttaaatctataaggagtaagaatttagttgtaatcatgtaagactcagtgtctgagattagctttgcatactagaagaaacactggattgaaagttaaaagacttggttaaatacctacccgctatgtgatttaggatggtttgctaaccatcctgagctgtttctttagtctccaattgggttgcagaattaaaagaactaagtaagataatgtttggtgaaagcactacaaactatacattgttttgcaaagtaacttaattttttcaaaatactaataaatatgccctggatgtgagctctctgaatttatagtcaaatgctttaacatttcagtttaaattctatgcaaattaaggaatgtagttatttacctggcatcttaagagaacaccaagatgctcattgaacagtagaaattaccaaaatgcctcatgacctgtatgtacagaaataatggacagtgaatgccaacattatgatatacattgccctctactttcctttcaggtggatggctggtactctttgccatcatgttgcggttggtggcagcttgccctgagtcatgtgtggtgtgcaccaaagatgtaaccctctgtcaccagctaacctatatagtaggtaataaaactaataactctaaaaagcagtgctcagtgtacctggaaaattggttgccatacctttcattgtactgactgttctctgggctcagcttaagaggtaaccctttaatgagtacacttcatacaatgactaaagagactggcaatattttattttcctgttcctgatggtctcaatcaaaactayttaaagaccttcaraggtaactgagttattttgctattgcaaaagaatatcaccattttatccagctacacacttaacaaatatatcactttaatatctttgtacatactttgtgcagatttgaacyctaccaccagctggaagaaatatcaatgaatcagaaacctgaactgcaattgttcagcattagtaagattaagtgatgtaccagtgaaacagattattatcaaagtgcgtctcattttgaaagtctggtctttttttattggtggtaaatgagctgtagaaatgctaacaagatacactgcctgtattcattacatattgcttgcttaagtcaacaatttaataagacaccttattaacaaatttgaggagaatgtgatttacatcctgatatccaagaagagataaacaagctataagctctgccaatggaaaatttccataaacaagcttgagttacgacagagtggaagaggataatttcttccatttctaatatcccacgactctgataattaggaggtagatgttgtcaccatccttgacaggacagagaggttttcatggatagttgatgtgtatatcgtttctaatcagtattgaaaatgctttaacactaaactctcaccatctaaaatggatttcttgacttcactacatttatttttcctgatcagagacagttgatgtctgtaagaaacaaatatttctcatctacattgttgcatctctatatcccccttctcatttacagaacaccatatttgtgaagttagatttcataaatacagagaataaaatggatgaattgtgagtggggtttctgtctagacctagacaagaagtaattgacagaaataatagcctgctcattcagagtcagtaaatccctaaaggactggggacccatgaaaacaaacctccttcatcccatatctaaaacaatgatgagagaaacaaaatgccgaactggccagaattaatagaatccaaataatcaatcataaatgctgaaaaaatcaccaggatttaagcttgcttgtgctgcagggatgagaacagttcttccaaaagaaggcactctgagaatcttttgtcttttacgtattttttaatctctttgtttccgcgatgcagtctgaatttcctaagggatttgtgatttgcttccctggggttgactattctaatatcacctatagacctcccagtgacaatggactcctctatccttatgacactgtcatttgcagtcaaaacaatgttagcatgataaagatgtgttacaatgactcctgattataatacttctttattgagttaaaatgctttgatttstaatgacagagcagtgatagctctgaggtgattatggtgaagggatttaacagttggaagccctgagtaccacctgtcatcacatgatggacttcattggagggaacagatattagacaggaggccaagatggcccagactataatgagaaccccactgacaggtacttgggttgtctggattgaatatatatccttaccaagttgccaacttttagcctggggctagaaagcagaaatcaatgctccttctcactctccccatcccaactcgcacctttacttttgggagaaaagatgattgacttcacagcataaatacacattgctatggaacactgactatgggggtcagacacaggctcagctcttagttgattctgtcctggatctgcagggctagatcaggtcagtacatagcctcggagggagggcctgaaaagacaccttcaaaataacatcgatgaagataatccgaaacaatgaattaactttgacatctaaagtaacagatgggtttatgtttctcaaacaaacatgtcacagcagcaaagaatataaaaatccatcattttgatatatagccagcttcccctcaaatttggaaatcagaaaatcattttcattttttgtattgtttattgtttttacccaggtgataagattgctcagaggatattgattctctgctctccaccataccccctccctcccactcatgtgtaccctgcatctagtctgtgcttttttccccacagcagcccctatgaccacgagggttttaatcatcaccgatggatatctctcctctattgagagcacaaacctgtctctcttgtttaatcttgccctgctctccctaagcagaaatggtatcgaggatgttcaggaagatgccctgcatggscttacgatgttgcggaccttgttgctggagcacaaccaaatatccagctcttcgctcactgatcacaccttcagcaagcttcacagcctgcaggtactggtgctgagcaataatgctctccgcaccctacragggtcttggttccgaaacacaagcggcctgacccggctccagctggatgggaatcagattactaatctcacagacagttctttcggaggcasgaatctccacagtctcaggtatctggatttatccaacaattttatttcctacattgggaaagatgccttccggcccctgcctcaactacaggaagtggacctttccygaaataggttagcccacatgccggatgtgtttactccactgaagcagttaatccttctgagyttagataagaaccagtggagctgcacttgtgatctccatccccttgctcggtttttaagaaactacattaagtcttctgctcacacgctcaggaatgccaaggacctaaattgccagccatctaccgcagctgtggcagctgcacagagtgtgctgaggctgtctgagaccaactgtgattccaaagctcccaacttcactctggttctaaaggacagaagtcccctcctcccaggaccagatgtggccctgctgactgtccttggcttcgcaggtatgccggggagaagtgtgccctcctcttttctcttctcttgtccatatttttgcagcatgctaagtgatgcttatctcagacacttggttgccagggctatggaaaggagaggttgccagtagatgtgggaggatattagctgatttggcacaggttgcaagaatttcctgtttcagggaagctgtctaacatagaggaaagggccctggaccagaattcaagggctccagccctggtataaatagcattggtgaccttgaacaggttaacctgctatttagactttagtttccttgtgtataayacaggaataatatctatatttcatcaatcatcctttcaccaaagagtactagtgcatttgttatgacactaggagatagatatttaaaaactgatgggacatagactctttcctcaaggcacttacatttgtrtgcttctccatggtgtatagtaagagtcagagggctttcacagatggacgaagagatgctattatggcaatctcatatatcttagtctgcagtgtttgtatggcatagtagttaaataaatgagctctgtagttggattacctaggtttgaatcctggctctgctattagctgtgtgactttggatgcattatctaacttctctgtgccttggttttcctcctgttgggtggttttgaattcttctaagatttctgtttgtccaactctatgtaaacttggcccatacttccccagaccaactaaggggaggataatatgcaattctttatatattttttgtaatttaaaatttatgaaactatgcatcagctatcattacatctcactggatgaataatataaaatgacacttagtgtcattagttgaagaccaaagatgcatgagatttcttaagttatctagctcgatgtgtgtgttttcctctatgctctcagtgcatggtgaaatcctctgcacctgtgggtaaccatggtgatgagggggtggggagagaaagagagagagaccagagaccaacaaatggcatccaagactgacgtattttaaatatgtgctataaatcattattctgtaacagttatctagtgaattaattgattgtatttttacttcctgacaattacacttttaatcagaatagatggagaccagcatcaggtatagacaatggaactaccatcagcagtaatccaactcacttggaaggaaattcaaatgttaggaaaataaattcttttaaaaaccatgtaactatgtcagtaattgtatgtgctaagaaataatttaccataaaagacataagtgatagggcagcagagaggtttcccttaaatgtgcttcttagaatactagcactggtggataattaatagatatcccaataaaaacacacagatgcacgcataggcaatagatggtggggttcacataggtttagaaggtactaagttaagcaaagtgaaacaggtatactcactgcagcacttctcgtaacctttcattttctaataagcactataaatttctaagaagaaggtgtgatatggagcatttcttgaacttatttggccatgatccctttttttcatagaggatttcattgaatttgtgttctagaggacatcgttttggaaatattataatagagcaatttttagtatcttttagttacttttacatctgttttcagaaatatgtattcagaaatatatttagctacattaacagttctttattagtattgagatgaatacaaattctagaagattccaaaagttttgtcaaaatgactgggagcttaatatacatgaataaattctgataaattataaatatgattacatatatgttaagttttggtgtgaattatcatactaatatatctttcatcaaataattgttaaattgtagtgctttgagaagagattcttctttaaaaagactctgatttttgatgttaatttgctccattaagattccactctttctgaagcacacgtgtggtgagttatctatacttctagattgtgggaaaaacacttagaactataattttgcctatgagaccattttcttcttcagctatatctaagtcataaaaattccaaagaacataaatagctatatttgtaaatttaaaactaataaatggttatttggcatcaaacactaatatcttgacacttacactatgaactggtagayaaaaagtttttatgaagctgtaatgtgtttctaatgtttcaataagaacttatcattaattttccctttttctcttgccaacacagrtagattgttagaacactttttaaaaatagaaacaatgcccatggcaaagaaaattcaaacgtcttcttaatagcacaytccgcctgcctacaagcttcatttgctgcttttgctttctgcactaatggaaagtgaccatacctgactggtaatgggatacagatatatacctagtatcaagagcaggggagtgagtgggtccctgccattcagacacaattagaggagaaactgtatcctataatcaaattatgtttactctcatttcagtggctgattcttgtcttaaagaaaacttagcccttttgttccttcattatttggtctactaactgcactagtcatttaaaatatcatcataatgatttattttttggatttttttgttcctgacaggtgagtcttccaggaaccaatagagcaatgcaaaacctaaacaatggtagctcagtaataataatcacaaatcacaatgaacattcactgaatcaaagcactgtattaaacatgtcacatatattatttaatccctgggtagtattagttatcctcatttgtgaaaggagaaaaaaaataagtgttagaggaattagaaaatacccaagaaaagtgtcagaatatagctttgaatcttgagttttcttacccatatgagttaaagagtggttctaatttttaattttttaatatattctttaacattttaaaaccaaaatccttgtttgggataattcaaactctagaatctatctgtcaataaaaggattattatttacataattttgctacaactttaaaaatgtgcctttaatagagattgcttcaatatgttatagcactttccaagagtgtattgttggcaaatgaattmaaatagatttaagagttcaagatatggtaaactatacaatggtatgaggattttaccagaaactgctattctccatgtttgctcttcatctttaacagaaaaaaaagaaacaatyatgacctgataccctcccttttcatttaagttttaaaaatatgttttcattaatattgtctccagtggataaaactagacatggtgtagccagtcaaagaatctggaatgctgtctttatttccagaaaagggcactgtcctcaggcagatgtgggtttagggcacagatctctttattcaatctgtactgacaccatatcttcctaatcacatcttgagaatttataagattagatcaccaatgatttcattatcagaattcataaacagaatcccttctgttgatttaagaatatttaataaatatttctgcctcctttgtctcagagttgtggacactggggatagaatgttgaacaggamtaaaaggatgtgttgcctcacagtgctcagttgtagcagaggaggacagtctgcgaacaagcatatgaatgaataaacagaataatacacctcataagggtgaaaaaacaagggaaatcattgtgatagacagataatgaggatatgactcagggacattggtttgaacatttaggtggttgaggatgccatttgtcaagacaggaaaaagtgaaatagaaacaggttagagtcggcacatgggtttgagaaacactggatcttgcaattttattcagaggacaaactacatagaacatgaaatgacagtaccaggcagtctgagattagaagtcattcactctattatgagagttcataaaaggaggtgacgtagaccgaaaaaataatgttactgcaggaactgttttatcttaaatgagtttcagttcatgaaacagcctttttttctaccaaagagattccagatggtgttgtttcttataatttttaataggtataaagatccaaattggaaagcagaacaatgtcaatggtagcctctgtctggactgatatttttccaaatggtgaaggacttcctacccattctgatatctttcaagccattaacctttatatttgtggtttttacatttgatgatttatgtgtttcttcccaagatgttatcttttaatggtctctctatttgtcataggagctgttggtctcacttgcctaggtttagttgtatttaactggaaactccaccaaggcaaagcaaatgaacacacatcagaaaacctttgttgcagaaccttcgatgaacccctgtgtgctcatgaggcaagaaattaccacactaagggatactgcaactgccacttaactcaggaaaacgagataaaggtcatgtccaytgtggggtccagaaaagaaatgccacttttacaggaaaatagccatcaagyaacatcggcctctgagtctgcaacccttgacrgatcatttakaaacctgaaaaagaaagaccgtggggtaggcagcactttattttgccaggatggtagattgctgcattcggaatgttcagagcctcctggaaatatgasagcttttaatgaagcaggcttacttacaacatataatccaaggaaagttcaaaagctatggaatcttgagcctggagaagtccagcctcaaactctgcaacaccatataataagaacagaaggtgagtttgtcttgttttagaaratcccactccgtttaattctttttgaaggagggagcctccctcctttaatttcctcaacaggaaatactataaaaatcactatagcactagtctattccttttctaaaaatactgtgtgtgtgtgtgtgtgtgtgtgtgtgtgtgtgtgtgtgtgggctgaggtggagatgaagtgttcttacttttaggagctgacagtgcatctcctgactgctaaaagtaaattttgaggcccaacacctaacaatgttaaaaaaagaaaaaagtagccttttaaatagcaatagtgctgttaagatctatgggatagctagtatcagcttttattccaacatccttcgagctctaatgccaattctgcagtaagcaaccttcccagagcatgacatgttagaagaatgggccctctaatgctagtgattcatttcaggaatgatgtcaagaaacgtactttgcttgctgagctgtcagggatgataacttcccagtccagggaaagtcaggacttaattcattgtcccacactgggagccaagtgaatctggccgtgacatctacccactgtacatgggcgatgtcaatatttaggtgaaggcaatgaattaaacgtcttcctttttcttcctgaatagtaaggctacgcattcaggctcagcagtgaaaatgttgacagctgctctgtaaagaggttcctgtcatttatttgaattggttcacaacaagcagagctttctctaagagtatgaatgacagaggtgctgtatcaagaaattcttaccacaggggtctggccctaaggatgcattttggggcgactggataagaataaaaccatatgttatttcacgtatgttataaggtaggatgtgagtttattccattgcattcccacactccagttcttaccagtgtctgggggttgatgatttcacacaacagagggatggctgaggaaagaaacatatgccatagaaaccaggtcagactggctttattttataaagaaataagcacttaccctttcattagaatcataccttaggcagatctttcatttcatcttttaactttgtccaatgcctgaacttctctgtgggaaactcctataactgaaggggatgtgctcttttaaccatttaaaacccagtctgttgttttcacactgagaacactggtttgtcagattaacatgaatacttttaagaaataccagaaattctgctctatgccaggcattgtaccagaactagagagggcaggtatttgaggagaaaacagccaaggtcacatctgctccagaacagaaatcggtaaagaaaaattgccactctgattatgccttctgacttggaaaaagaattatagactttccagtgtagagagkactttagatctagactaatagtycttaatgtttatctttgagtcacagaactctctgagactctgacaaaggctacagattctttccccaacataatttgtttacttacataaagctcccatctagtccaaccttccaatacacagcgaacaagcagcttctccaaggtcacccagaatgttgacggcagatcttagattggaattagatgctagtctggaacttagtttacctcttggggaaaattggagatggagtatccccacccttaggagctgagagtacatctcctgtctactaaaagttaattttgaggcctaacacctaacaatgttaaaaatgaaaaaaaaaaatagccttttaaatagcaatagtgctgttaggattttttgcggttaagatgttttgcagttaagatttccttttttctcatggaataaaaaacttcttcctctggatgaaaaaatttcatgaaacaatagaaagtatactaataaataattttaaattttagatgcattgtggttaagacaatagggtcgtttaatgtcagatagacttgggttcaattcttggtttcaacacttagctgatgtgtgactacgggaaagcattcaacttctttaaagctcattccttcatctgtaaaagttataagacagtaggatctgtccaatggatcaygtctcttgtgaatattaaaagagatgatgaacgtacattatgagcacaatgcctagctcttagcatgtgctcaattaatggtattactattatttttgtcattaatattatttaatgtgtaaaaggagattagaggcagacattaagaagaagccagtacaagtttccttcttccacatgtgcctatagggctgtagatatggtctgtccccaaacagtcaaaggaagcttcctttctgaatggttcatcatgtactattttcctttagtaaatgaaagattgtaacatgaagaggaatttgcaggcagacatttaaaagaagctagcagaagaagttataagattaataagattaaatattatattaatctgtaccattttaaaagtcccaggtaaagactgctgccacacaaacctggctatatttcaaaatacctatttatttaacaaatatttaatgaacattttattaagttatgggaaataaaacagatatggtctctgctttcattgagtcaatagtattgcaagtatttccctttcattgtcaaattattatcttattattgattatctgaaacctgaacattactcaatattgcacccatgttctgcccaatatttaagttgcaaatgggaaatgaattcaggaaaaaattactatagccatttacaaaggatttacatactattcatatttaaagctaacctaaccaacaactaaagatatatgactataaataacatttatatttctaactccacaacttttaagtcagcatcgcaactgactgcagtgtgaccataaagagtgtcattgcaaaacatatgggactgacaaatgtcctttgtaggtttggttacaaattaggaaatagtgaagaactgcaattatcagaggagtcagttttatacttttcataaggtttctacgcatctgtttggttggggtaataaaactctgctaagtgctaaattcttgcatttattgttccacagatatcagcagtgacatatttagaagaagatatgcaacamccgcttcagccttggcagragaaagtcttgagaagcgtttaacaaatgaatcatggcagcctccaatagaaaaagaagacaatggcttacaccctcacaggcaaagacattttattacaagctcatcatccaagccttgtgagcctgaggaacactatgtacaaaatatcgtacaaaaaaatagatcaaaatatgatgatccttgtggactgttaaaacagagcaaacctaggtattttcagccaaacaattctcttatctgtaaatatgtgccctgtgagcaatttgaagattacatgaaagaaaagaagccaaatcgtagacaacactcaaagcctgagaaagagcaaatccaaattaacagtgcaatagaaaaatttcttatgagtgaggacaacatagatttatcaggattatcaacaaaaaccaagaaagcatattccccaaagagggttatcttccatgatcctgatttagtagaaataaataggtcgatgatgtcacccaaaatatcaaccccttggaaacgacagaaaaatcaaagtaaccaactgactaagttggatgttaaaaaatttagcaacactggggagagaaacaaaggagaaaaatggtttactaattcatgggttctgaaaaggaagagaacccctcagtctgacctcaaagggaaaattaaaggacaaaacttaaaattaaatttacatccttttagaaaagtcagagtccatccagaaaaatccttgtcaagtctcccaaagcaatgcaagcaggtattgttgcctcctaagaaattatccaaaacttctgagacagaagccaaaataaatactgtgtgttctgcagattttcttcaacagtcagagagtagcaactatgttagactcacttcaaagaggctgcctctgaaacatgactcaaagcagaccccatattatcaacgaaacactaaacgtgcccccctgctcagtgctaacaacttgcgtgtagtcaaccagagctctatagaaagcagctgttactcagctggccacattcctgatggaaacacatcaaaattgccccaacctacacccactgatgctgagcacaggcactcacattctcaattctcaactgagcaaatggaagatgcaactcagcttgaatcaaaagtgcttagttatttagcaactacttgggaaaatacaggaagtgatgttttaccattccaacattccaggagggctactgaccaagggacaacggagtccactgagcacatgggacagaatgtatcaaagaccagtgagttaaatcagttttctttgtccccgaggaatcaaacacaacttttagatgctcacaagactgacagctacaacaaggaatacactttagaccaaaatgaaggcttacaacacagagagcaaaattcaagtcatgcacagcttgaaaataaagaaaaaacattaatgacaaaaccccaaatatcacatcaaattgtggaaaattgtattatggataaggaagaaaatgatgtagaaaaaaaactttcaaaaacagaaacttatgattcctctctcattccccaaacacaatccaagaacaacctatcatttatgaagacaaattcaattccataccaaaatagaatagaacttcccaaggatatcagtacttctcctgttagtagtcaagccgtttggcacctaaccaatagtagcgaaaaaggaattgacagcacaaatgcattgcccagaaatgacggcactgaagcactagagataaaaatagtagggaaagaagagaaaaatatgcttgatgaaagcaagacagattctagtatgttaactcagatctcacaaatgaccttaaaaggcatcacaaaagaaaggcagcaaacttgggaaaatggaacaagtgaaaaatatatattacatgatgcaagctctgccgaggagaccattacagctaaagatttaagtatcacaagttcccatgaaacccaaaatagaatactttgcagtgaagtagatcctgaagttaacagtaatgtacataattttagagaagttcaaaatattcaaccagataaagatagtgcacataaagaaggcgcaatgacagtggagacacatgaagcgctttccttcttaccagggttaaaagacagttttgaggcagaaaatgaggtgtttttagttcctagcagaataaatgaagctgaaaactctgctccaaaacctgtactgtatccaccatctgctgaatatgctactacatcacctttagaaacagaataaagtgaacaaaataactcaaataataatccttttctactttagctttcttcaagaggacaaacacccactagcctttgcatgcattagaagtggatcattttggaggacaacaacgtcctcagtaactctttgttatcaataaaataaaaccagagttgaatatatgacaaaaatcaaagatggagtcataggatacgtctgacacaattaactgagtatgcttctctaaggaatgaaaaaacaagtaagaaaagttttgccaagtcttgcaaaagcaagcaaacattgaaaaaaaaaagccttaaacaaatgaaaaactacataagaagagtatttgagcagatttacatttgatgtttatttcatgtaaattattatacatatctcaattagtggtattacaatattgctttctacatggataattatatattcatatttgtgtttgatctgttttcctaattatagtatgaaaataaaaattcagctttgttaactgtagtgtaactgatatgcatattggtatgtttcatacatttgcaattgtcctgttgacaatcatcctagatttaagtagaagtctttaaaacttgttatttctctaagagaaaaaaattaaggatttccagggatagttggctgttcccataaagatctgcaaaatcctatatatccactaggtggagatctcagcttcaatcattttagaagaacagggcttgaagatcgacacaatggatcctgaacaaaaggaattttaatgagctttattgccaattgttattaatttaagattttgaaaactaaataacctattagtgcatagctttcaaggtctgatctcttgggtttcgcatgccactgttgtttggagtgagaactcctccttatacactggaattaaatgtgaatataaatattaaatttaaaaacagtaacagaacaaacatgtctcattcaaagccatgcttatttgaaaaatatagatatattcaaataatttaattattgagaccactgtaaaaaatatttgaagcataccttcacaatttagaatattataatattttacattttttagtaggggaacaaaaatgttaaaagggaaacaaacttcctcttctcctatctctacacctgtctaggtctatacatctttatatctgcatttggtagaataataataataaataagctttataaaccttataagattagaacaacataaatattgcctacataccccgcctcttttgtttcccttcctattcagagttgctaggaaataacttaagtttcttattttgaaaattcctaaacttcttacctctcttcttcatcttttctcgccaatattcaagactttattgcttttaatcctaattcctctggtatttctgttcattatctctgcttgagcttaactgctatgccacctatctgccttgcctgaccccactttatttttaaagcacctttaaggtgagacgagtatctatgccaacttcttgcatgataagtttattccaccctaatcgacagtttcttcatctttgtagaccaggtcactttttttcttggtagctatctttctttttcctttttttttttcttcttctttaaagcgctgtcaccttacttcagcacctttagctttgttctctctgctctcactgccaagaatatccctgatatctagaggcctaatgagtactcttggtcactaactgactctcaggaggcagcaatcctagttctcctggtctcttttctctcttccatttctgaaatccagtcttttacctctttatgatgtttcctttgaaatagttctcaggtttacccttgcccttgaatctccatggtaaccattgtagtctgtgtgttgtaatcaactggattactcaaacagcagtccagctggctgctccaacttcattgtcttttgcttgagtttcaacccattcattttttatctttgttgggcacaaatcacctggggcgcttgttaaattgtggagtttcaggctccatctgagagattttaattcagtaaacttagattagggccccagaatcttcatttcaacaaactttccagggtaatctggaatacatagtttgcagcccacatattaagaatcaatgcttagctattccaatgagcattacaagataattcagtgtttgccttactgtaggaactacaatttttttaagtaaataaatcctttgtatcaaactcagatgaacttcctaaaaaattacttttatcttttcactcctttagagaaaaaaatataattgccataatttcacgtccaaatttcctgttccagtttccaaaatctgtcactatctagtatcaggcttttttctacctcttactgttttccaaccttctcccatcttcaatagactattcttcttactctcctcaatgttctagtttatgagttttgactaagaagacatcctggagaaaatactgtgcttcaaattcaaggaatgaagtaaagacagatatgcaagaaaaaatgagaagcacagttcataacctagaaagtaatgaccagaatagcatgatgttagtgtcctccatctaaagatgaacttgtttcaaataatgcctgatacagagatttaacctctccatggctacaatgttgcaactgctactagtctttcccttgtatctgttctcctaatgaattttcatatgttctggttgcttagactgtttttctttctcaccaagccgccttctttcagaaaactactgtttatggcctcagctcaagtgttactctttttgggaagccttcactaacctgcattctgtctttgtcccccaacttgcgagtagtattgttttagtatatagtctcacagagttttgtctttcttaaccttggcagttaactatagaatcattaaaatgtttattcaatcaatctccatataactagcaggtcttaaactccatttaagagtttacatctctattgaatccctttcccctatcctaggaggtatacagtaggaactcaacaaataattgttgaaggaaagaatgaaaaacagcccactgttcccttttctttgccactcagcttgctaacatgatgaagaccttactggacaattaagaaagactcaagtgagtcacatacagaagcagctcaacttcattatcctgaggtggttaccagagccaagtcaggctcaactgactggcagacccacatatctcaagccagctgaagactttgctttcctaatatgctttttcttcatcttcccctcttcatctcatcagcagaacaaagactccgtgctgacaaacttcacttcttaacagtacaacttttctgctaagcaatcgatttttatcctttcttttttttaacagtatcctttggccatattccaatttctgtttgtcatttcccaactctttgcttgagacatccatcctacccaaaaaatgcttttagaacctgccaatgacctatctttacattgatattagaaattccacatgcctgttatctataattatgaagagacacttcatcaaagaaaaagggattcccttgattgttatttgatggtaaactttgtcatagtgtgtccagaattggtgggttcttggtctcgctgacttcaagaatgaagccgcacacccacgcagtgagtgttacacttcttaaagatggcgtgtccggagtttgttccttcagatgttcagatatgtccggagtttctt

SEQ ID NO: 12183 - DNA, 13318 bp, Homo sapiens
ctgttgggttctgtgcaaaatgaaaacatgagattaccttatttaaagacaggaaaaaatagtgttaaaggttctaaaatagaaaacatttcttttttctttcctttccaatctccttctcttgactttattttgccttttatttgctatttaacattattctaagaaaacatttaatttattagcatgaattctatcactcggctttatattgtgcaatgccaatttcaaatgcaaatatgagcatttaaggcacatggaatcactgaaataacacaattcatattatgtagcttgtgtatgcatatgtattttattcttaccagaacagtgaaaatgctacacaaaacttaattgtttttgtctgacttctcgatgcatgcatgttctaccttcactttctatcttactgattagtaaggaagaccttaaagggaatagagttgtgtgttgccttatattttagttaccttctatgttatcatcatcacccctacctcagtcacagacataacacgctgacgttgtactcactttgagactcactgacctgccagtcattatgggttcgccagtgtgctcatgaggcattacaaacgttatatgtgaatgaggagacaaggaacaatagacacatatattgcatgtgtctcctctgctcccttgcatgccctattgtcccattagacttcactaacaaacacaagttgaaagagaaaatgattaaggatttcaaggtagtgacagcactgcatgaaagcaagtgccaggccctacctacatgaagccctatgcatagggtatgcacccatgaggccagccctgccatctttttacagaatacataatagggaacataggaatcacacacgagggtaccgccatctcataaggaatgttctcaacattgttccttcattaattttctagatgtgcccctgacataacctttagagggtgaaatatttgccaagaatatatattattagttggaaaatagcttcaggacttggttagaacaactaacctcagaaagtccccagcccatgtgaccttcttttctaggttcagatcaaagaactgttgatctactaatggaatggttcatctgtcttttaatgtatgcagtatcatagctcatctttccctcttcttatgctaaaatcatattttgattaaagttgctcttcatccttcctttcaaccactgccacattccttgtgcatcaattccctgcttttcagaatgcttaaaatctagagtaatggagtatggtacttccactgctaaaatgaattggagatcaatgcacagaaactcacaaagccaacaagcctgctagtaattctgataccctgttaactgcatcttagtgtctggtggcctttgcttctcctggagacaatgtagccctcattctgctcaagacatactgtcttccattcgtggaaaatcacttagaatcacttcggaaaaaatacctaagtgatatggtaaaaaaaaaaaagctgcttcctggcacattccttttaccactctatctgctaccagaccttctattgaccttctgccctattcaaatccacattttgtaactgatgtggaacacgcagcattttgacacaccgttcttgacacaccgttcgtacgaatttactgtaaaccttgtgcctgcctgcattgtggtagaaatcatattaccagattcctaacaagaaggcttatgatgttagaaactgttaaaaacatgaatgagaaaaggccccttcaaacagagcctgaggagctagctcaagtaacaaagccctgttttccatcttttatgtaaagcaaatggattaacaacaactggcatgaagctgaactgacaccctgactcactgtgccaggcaagcgctctattgaattgtttgcaccagccatttcttgtgtgcaaacaggaggaacttgttcaggcagcagccactctgaatggtatgtgaggatttagtgaaatacatgctcaggacagctttcttaatccttgcgagtctgcccaacagagggaattccagggtgacggacgaaggaagcgtccaagtctttcactaaacacagtcaagtccaaaaaaagaaagttgaagtgactttgttatatgtttagtttatgctcatccaacaaataccgctgttaggaaaaaaagtttaatgaatgatggtaataaacaggctggtactacccactgattaaagtgtcatgatgcctctttcgaaatcaaaggagttatcttgctaatgaactaaattagactgaactaacattcatgttaataattattacttacagagctagctgtgttaggagtgataatgataatgtgaaaactgaatataataataatatttmtcaggtgcatatcctctagtttaaagcaaatttgacaggaacatgcaggtacctcagtggcccaattttgagaaatagagggaattttttcatcgtaaggatggtagattaggtcctaggtgagtaatgaaaagaaggctgaaaaacaaaattccttattagaaccagaagtgttaacctgacaaacacattcattcaaactctttagcacgtgaaatatatatatgaaatacatatggtactcattttcccttaaaatgagccatgattgaaaaaakaaacaattttacattctcaaggttggaaatagagaagatatgcattggcgataatattgatttwaaaaaaaatctgctgaaaggctattattagacatagattatagttacagtgaaaactgggagctgcttttaatcccctagggggcagaaagttatgtagggtcctttttgtcattttcaaggtgtagaaagaatgaaaaagactgcggtgtatttcattattagtacacatgaacagtttgaactctccattattgggctgtcttttttcatagttggtaactttttcaggctccttctacgaaactatttgacaaggaaaaaaatagccttcttggtttgatatgtgagtatatacaagttcgcacaggttttcacaagaaagtaaatgaagagcatggcctgcaagcttaatcatattaactctgaatataatcaaagcttcaaagtttaactctatcttagcactgaatgtgaatggaaaacaaagactataatatgaagacatttcttagtcttggaggaaattttttattaaatataaattactacctctcaaagtaaaatttacattatatctataacaatatgaaatatcttatttagctacaaccagatactattatttgactgtttagaacacagaacaaaatccttctaaaaccggtaccttggaggatgttgtctttctttgaattaaagccacaactaacaagccaggcacagtggcaagcacctgtagtcccagctacttggaaggttgtggcaatagaatcccttgagcccaggagctccaagcccagtccaggtaacacagcaagaccttgtctcagaaaaaaaaaaaaaaaaaagcgcgcacacacacacacacacacacacacatagacacatacaagaaaacaccaacaccaaaggccaaatacttctcaacataccaacgattagcaagattaatgattacttctttaacatatcagttctctcaaactattactgttaataattataggtaacttgcacctttattttctttgtgtagggggaaagaagtggccaaagtattttattttaaattagtaatctcacttttttcatcagagtttgtttgatatgattctactttccacatgtttcttattcgctgttttgtcttttaaggcagggaaagtgagtcaaaagcaaatcatgtttcatgtgaatattggactttgacactatttggaccaaattatagagaaaacaatgttccggaatttttttttttctttaaacacttatgaagtgtcaagataggccttagtgaatcaaccaagcacatttttcaaattgtttcagtaaagggtgagaagttgtaaaaacaccttttaaaatctcaacgttttataatagcttattgcaataatggaataatttattccattattccaaagggtaatgctgtctctttatctgtttgtccataatgtatgtctgtgcaaacttaggatggcttttacctcatcgtgctaaaagagcaaatgaggagattttaaacacgtctacattttaatatgtgagcctgtaggctgctatgcacagtcttctacagtttatagtgagatgtttcacatcaattaaaaaaaaagatgagagaatgggttacttgaagagtttgtttccttataatcaactctaaagagamtaaggtcatgcaacagatttctttttctttctttcttacagggagactatgtgatgcaaattgctttattggtgaagggaattaaaattataaaaagctgggcttaaagaagtgcaaaatcagagctgtgtcggagcagggacaatataattgtggtatggattcccatatgggactaaattatctagattttagtaaygtcagcagttctgtgtagttgctggaatgcggccaatgtgccatatttgcttcatttttaagatggttctgattctacacaatgttaaatatgcagaaagctacaattgttcgggtatcttggtggcacttctcagatacatctctttgcatgtcagaaatcttatttgactattaaacaggaagtgacaccaatgtgactttatttttctaagcaaaatgccatttattatcatttctatctaggctataaaatcttcccagtagggggaaaaaatacccttttctgtragtacatatcaaggttgtcttcctttacagtgtaccattcagtaatactgttttgtagcaactcaataaagctgatagtttttctgggwaattacccacagcccccctgcaggacaaattagcattcatgacctgaataatgcttactagaaagagttcaayggaatttacttwatcagaatcattgctttctcttggctaatttttttttttacctagtccccaacgcttgctaatagcaaatatctttcaagccaatgtttggtatctgatagagaaaaatgcatgaatctttaaatgttctaatgtatttgtgagtcttgaaaaaataaatgtatattttttatattgagtgtgtgaaaaattaagatatccatcttctttaaaatttctaattaaacttacatgcttatttctctttttaatgcttactggtttcagaaagacagagagagatttttcattttctaattatccctcaattgtttctcaatttgctgaggacaaagctagaggattggttgtgatttttgatagatgcttggtaatcactctgtatccttaggcatcaaaaattaggagaactttgaatagacaatgggtgttgtttttgacaatttgattgattcttactttgttcttgatgacttatttaataattttatgatttgaaccaaaatatatgaaatgtagatactaagatattagaataaaggaggagagaaagtaatattcactgagcttctactacttacaaaacactctgtgaagtaaacagtatattttattaattcttgaaatggctcagtgagggaaggactagtatcttcatgtttataaaagagggaaatgtgtttcagaagatacttactccaggttatacagccagtaatgaaacagaaccgagacacaatccccagactgcctgaatcaaaagcttacacttttttggttttgtgtttatgtgcaaagattttaggtttttaggaaggcaagaagaggaagttctaaaccaattggttctaaaccaattcccttgactgaatctttaatttggaaaagactcctaacctggaagaggaaatgtttctaaaatacagctgcatatcaatgtctttgaaggacagctctatagacaacaaccaagatcagagaaccacagcaatggggccatcctctaaagtttattttagcttatttatccccccttcctgtcatcttcygtgaatcttcacaacccagtggagtaaackgcaggtgtgaactgttgagacacaggctcccacaatggagcattactgagggttgggaagtaatccagtcaaatcaagctgaaagacaaaagtgtgagataagatccaaaaataacaaagtaaaagcagaaaggtcctttggggtttctatgcacttaactcagtggagacatggaatttctgtaggttggggagatttgtctggaggcttagtttgtatagcaatctcagtttttacctaggtggtatggttgttttggattgcatattatgtttgtttagagtatatatttattggaggtgccttgggggaaggctctcagagattatgtggggtagttacagccgcagaaagaaacctctaggctcttccactgattagattgcatagttcgaatgaattaaaacagtccagtgcaactgaaaaggaggattcactcattcaggcccttgtgccttgcagtgctgaactgaatttggtacttaattaagtttccaggggtgcaaaatggctaycccatttctaaatctaaatraatcaaaatgttttttcaactttgggggtttcagaaaacccacaacacattttttgcgcagattttccttccaaamactagaatattgcraggaaaattcaatccatatgtttcagactcasgtacagttgtatcaaaatcttgtgttgcaattgacatttgatgttcatgaagttttctgaatgcttcttatttgcctttaactcaagaacataaagttgatttgtcaagcttataagtaccaaaaaccccaaaatattacatttgagttgaagacaacaaatttaaaattctgcatcgggcattaaatttaataaagcttttgtcttaccatctctgcagtgttgtgtacttgcagataggcatatgcctgatgacatggagtacaaagacacagtatacttttgatattgacatggtgaggagaaagtgaaatgatagaaaaacaaggacacatattttctcttctggtattcctccgtgatttaaatattaacagcatattgtttataatttaatgcaaaaaatatgtgcactgacagcctatatctaatttcttcttccatccttcaacaatctccgtttagattctggttggtacttggcagctcttcctttcctgccagtgttcaggcaatgatgtatcttctggtcagtgggtccctccacatcaccacaaagacaagagaatactgggaggaggaaaggcaagaggaaaaataaatcatttaaactgaagcatcagtgtctttgggatggttatataaaagaatctgtatttgttgctattaacgctattttagaggtttctaaaatgattatgtccctttgttcaaggctaataatgtggttctgcctttgcttagaacatgataatggtgccttccaatcagaatcagctcagagaggagaatcattttcctaagagccaggaacctcagaaaaaaaaaaaaaaaagtcttctgttagcacaaaataaataacagtgttctgacatttatttatgacagtgtctgtatagacagtatagtagttggtcattcactttgctatgtgacttgtatatgtgggctcttttatagttttcattattcttgttttcagtgtttcttcccttagaacaaaaatgatgtatgtttattgtggaaaataagaaaatattcgtaactaaaagaagaaaatatttccgaagcctcactttctaaagataactgctatttacatttatcatatgtcccttcattgtattttatacataaacattcatgcactgtattttttataaatataagattatacagcacatactgtcagtggcaatatagagcaatagaagattatgctatatgtttttaaatcttcttttcttcttttatgatatgctatattttagatggctgtatatagttcattgtttgagtgaaatattaaatcaagtattcaaatataattattcaaatgacttcatggtattccattgtcagaatgaactatttatcatcaaaatattcaaatataattattcaaatttaataattcaaaattttaattttcaggctgtcctaatacactggttacataaacaatacttgaaaataagatctttccttcaaatctttgccagtgtgaataattttttccttagaataaatgcccataagtgaaatagctagtcgatgttttaaggcttttgaaatatgtttacaaaaatagcatgcattttactttttttattttttcaaaatgacaatagatgtatgcctctgcttctatgacctttacttgatccttgtcagggcaattgcgagaggtccagaaggttgggaatgtagaatacggtgggtggccaagaaagacaattatgctgaaaagtacaaagtgactcaaatgcacgtcttgttccaagattctttgttatttagattcctgcattttcttcctgcatcttactcaacacccccatcactcctgcaaagtattacctgacttttagagtctatagtaagagccccacatgttttccatgaataaggctagttttatagtgagctctgatcatctgacaaaataatatttaattgtaagaaatgttttcaataatcatgaaaattcttgtaagtctaacatgggccaacttctattcgggaacgtaatcatgtgtgaagtccctgtggagtaaattggaataatgtgagtaactaggaaatgcaatcattctatccctagttaggagatggatgagacaggaaagctaagtggaaaagtgtatagaccctgtgggaaaaggtctgagtttacacccaacccctccattcactaactttatgacttcaagcaaatgactggagctgccaaagtttcatgtccccctctgttgggtgcttatatgttctacatgccatctcggtggcgcagacacactaacttgcatacagtgggtggttaataaatagtaaatactttagctttttttagacagagaagatgcaagttactcactgaaggctattttaaatgcctttagcccatttcagccagaggtcatattgattaagaatcatattctgctacaagtaacaacaaaaaaagagtagcttaaactaataattcttatttttttcacctacataattccacacccagaggtgaaccttgttagtggttattggttgaagaatgtcaaaaccggccgggcacggtggctcacgcctgtaatcccagcactttgggaggccgaggtgggcagattacaaggtccagagttcaagaccagcctgaccaacatggtgaaaccccatctctactaaaaatacaaaaattagctgggcatggtggtgcacgcctgtagtctcagctacttcttggtaggctgaggtgcttgaacctgggaggtggaggttgcagtgagcggagatcatgccattgcactccagcctgggcgacagagcgagactccctctcaaaaaaaaaaaaaaaaaaaaaaaaaggatgtcaaaaccacgatccttcggattaatgtatcgtttcctctcagctaccaacatatggctgctgccactgcttttgtccactgctttagccccatgtccccatttcaggaaaggagaaagaggaagtaataggagggagaggaagcacccaggtgagacatccagagcagactgtgaatatctcattggtgactgccacccctcactgcaaggaagagatgaagagctgggcacttgcttttctaaagaaaaccagagttacattccgtctgccaaagatgactttttcctttctctgaccatacctctttcttttgtttgcttcctgttcgagacagagtaggctcagctagcatagttagaggggcgttacaaatcccacccaataattctcacccaccagtttctgagaatgcctaaaatttcagcatcagtgaattaagctaccacccactatatgttaaaatgcgtatatctctgggaggaaagttagcaccttgcttcatttccatacttaacaccttagataaccaataaatgcattgattaaattcccttaaagagaaaattaattgagactaggtttttagcgaggaaggatggagagttcagttctgcgtgacaggcgctagccaggcaggcaggagtaggaacgcgtgaaaggaaataaagagcaggaagggcagcgtgaagctgcagacaggcagtagaggctgttagcaaatattagataagcacctcagaaacaaacaccacctttcacagtgtgtcctgggagtagatctgattgctcctttctctttagtcctcatcgtgtctgatcacatgcaaaactctatattaatacacatcgaacactccaaaccacaaaatagataactagcccaacctgtgcctgatattctgttaaacctcacttcaagcttcacattttgtgaagcccaatgtggttacactcaggagccactatccagagaaatgggaattgttggctatgcaggctacttctcaggtgagagtcttctgacttgatgttaagatagcggaaagagatgttcatcctcaacatttgataagacagacagtgtagcattattgttcagctcatgatttctagagacaaactgtggcttcaaatccacagtgactatgggagaggtatttaacttctctgtgcctcagtttcttcatctgtaaagtgaccataataatggcatttaggcttggcgttgtggaggaggttgcagtgagctgagatcgtgcgactgcactccagcctaagtaacagagtgagaccttgtctcaaaaaaaaaaaaaaaggtatttatctctttagtttgttgtgaagattaaatgagatatataacaagagctgagaactgtgcctggaacacagaagtgtttgctttattaagtttaaagcattacttttttctgtctcagatcttttccatagatactgataatcatatcttatatgtctatagctttttacgatttccaaagcatttccctatgtatttactcatttcaggcaggtgggtcatttttattaggcccattttacagatgggtgaatggagtcacagagattatgcgtatgtccaaggtcacatggatattaacaaggcagagacctaaacccagctatttgaagacaaattcaatgcactttctgttatgccacattgacatatttggaagcaaaagttttgacatcatggcaaaatgaacatgtctcagagttgattctgtttatgtgtattcctgattcccaaaagctgagtctacctataggtattatccagtatacttgcctgggtaggtgtaagaagtatttgacttcctgactcatatgtaatttctgtactattccagaaggatcacaatttattccattactattgaatgacccagtaattatacttctaggaatatacccaagaaaagaatctttagcagtgaaagaaaaaaaaatagttgtataacaaaagatactaatttaaagttatatataatagccaaagaagcaacaaataatctaaatatacttggcataggatcagttaagtaaactctcacacatcaacttaatgaaataatgatgatgataataactattgtatattgagcatccagtatgtgcaatgcattttactatctcctttcaaatggcatctcttttgatttcctaagagttaggcattactgtcaccccattacacagataatgccccaaagccaaggttgtgtgcccaaagtgacagatacggctaatgactcatccttcaacctttcttgcttctttattgccaaggagccctgattttgcttgagaaaaaagtacccagccccagaagataaatcaagaatagtccaagctgataagagcacttccaatctccttgcaagtactaagtctagggatgggcatgtggtataattcttgtcaataagatttaagaataaattttcttgggcttcttgaaaatcacttcctcaagtcttttttaattttcttttttcctgctcccttttttcttgcctttgaacatttttatgagagtagatgatgctggaggctgaagcagccattttgggatcatgaagggattagaagcaaatgatgagaatgacaaagtaaacaagaaaagtaatctaggcccccagtggctgcaattagccaacaagctaccctggtattgcctgctgccttttgggttttctttgttttttgtttgttttgttttttaatagaagcaatacacatccttttgagataaatcactactcatctactgtttagtactaaaaccaattatattaggtaggatttgataaagctgtgagtgacataaaaacaccatccccgcccctctgccacacacacacacatacacacacatactaacttgaacttaaacaccttttaaagtctctgatatggtttggctctgtgtccccacccaaatctcaccttgaattgtaatccccataatccctacatgtaaagggaaggacctgaagggagatgattggatcatgggggtggtttctcccatgctgttctcatgatagtgagtgagttctcatgagatctgatggttttataagtgtttgacagttcctccttcagactctcttgcctgcctccacgttagaagtacctgcttccccttctgccatgattgtaagttccctgaggcctccccaaccatgcagaactgtgagtcaattaaacctctttcctttacaaattaccagtcttgggtagttcttcagcaaggtgaaaactgactaatacagtctctctcataaaaagtctatgacaggcagtctggcacaaatatggcattccacgaagtcctgagagacccaggcttttctggcttttcattccccgatcccaggattgtgcccaccacagggaccaatacggctacttgatttccagcattctagccaacagaaaggaggaaggagcaaagaagaacatgtgccctaacttttaaaataagccagaaagtttcacacaccattttattcacatcacattggatagaactgctagctgcaggaaaagcaaggaaacgtcatctttattctggaaggtcatgtactcagctaaaaatcagtgattcaatcagtggggaaaaaagtaaagaacatgcagagggaaacacatggcagctgatgaatcc

SEQ ID NO: 12184 - DNA, 46057 bp, Homo sapiens
ttaactgatgacattgtcttgtgaaattccttctcctggctcatcctggctcaaaagctcccccactgagcaccttgtgacccccactctgcccgccagagaacaaccacttttgactgtaattttcttttatctacccaaatcctataaaacggccccacacttatctccctttgctgcctctcttttcggactcagcccgcctgcacccaggtgattaaaagctttattgctcacacaaagcctgtttagtggtctcttcacacagacacgcatgaaagttgccttaatgatttaccacttcccttcgtataactctttataattaaaaaaaaaaaacacttcctcatttgatcctcataacaattttacaaagtaaggagatcaggtattatcaactcaatgaatgaaactaagatactgagcttgtggattcattcatcattctgtaatacttattgaacactatttccagcagagtggcaggctggagctatagtggcaaaaaagaatgcaaggcccctgctctgatggagtgggagacagagaatgaatacataaataaacaagataattacagattttgataaatgctctttaggaaataaactgggtaatatgatagaaagtaactttgaagggatgtggggcaggggttacactcttagttagggcatggcgtccctgaacaggtgatgatgaaaccaacagttaaaactgagcaggagctggttgggctgaagacctaaacgaggagggtatcaggaagctgtgtatacagaagccctcacatgggaagacactagctgggttagaacagaagaggctggggagctaaagtgtagtaagcatgatagaaagtggggggcttataaagacatggggtcttacagaccaggggtcagcaaagtattgctcattgtgcagaatctcactcgtgagcagaatctggcccacagcctgcctgtacagctgcaggctaagaatgatttttagcttttcaaatctttgggggaaaaagcaaagaataaagagattgatatatgaaattagagttccagtatatataaataaaattttattggaacacagcctcattcacttatttacatattgcctatggctattccaggatacaagggcagagttgagaagtaaaactattttaaatgtttatacttggccccttgcagaaaaagtgggttgatctcatcatagaccacggtgaaacatttggattttattctaaatccacagaatccagcatcaaaactattttacctgacataacaattcatagattggtggcatccagtggccagcaaagtaacagctagcatttgagtgcttgtatttatcagacacttttctaagtacttcacatgtgtaagctttttaaatcttctcaccaactctattcggtagaaactattattcccgatttatgaaagaggaagttgaatcttagaaagattcaataattcacacacagtcacacggctcatgagtgttagggctgagaccaggaccatgtcagcctggttccagagcctggactaatcatggaaaatgttttttaaaagaaacttcaatgaaaatattgcagaaggctgaggtgtcttggggatacctgggttcttcagaatacagtttggaaaccacaactttcatctaatctcatttatagatgaagacgccagggctggtcacttatctgggcagagctccatgagctggggcctgaagctggcccttgctatcctgtggtatactctccgaaaccacaattgccttctgaaatcagctcatatttgggttgttttcagaatgatctatttcactagagtaaataaagtttctaccctcacgaaagcccaggttcacaatagtaggttttttcggcagaagtcttaacaaaaggtgaatgatgcctttcctcctcccggcacacccaacctaccatggttcctgtggggatgagatgctgctccagccacctgaggtctgcagatttatggagaatgttttttgtgccaagatgctgggtgctctgggtattataatattttcaatttaaccatccatgagtgccccataaagaaggtgtggccccgggtgagctggttctcttccaccgagggcaagtataaaaatttgaagtccttcaaaggaatctcatagacaaagaaaaatgtgtgtgtgtgtgtgtgtgtgtgtgtgtgtgtgtgtatcactgactcactgtgtcacttcaggcaaacttcttaattctttgggttttttaaattttatttattttttttgagacagagtctcgttctgtcgccgaggctggagtgcagtggcgcaatctcggctcactgcaacctccgcctcccaagttcaagcaattctcctgcctcagcctcccaagtagctggaactacagctaccgtagtctggctaattttttgtattttagtagagatagggattcaccgtgttgcccaggctggttgcaaacccctgagcttaggcaatccacccatctcagcctcccaaagtgctgagattacaggcgtgagccaccacgcccggccaattcttcatttttaaaaatgctacagtcgaactttctcagctcctgccttatgattcctggacagtcacctcaggctgtaattattcttcccattttacaagtgaggaaactgattccaacaggcaggtagtgtgcttagtgctacacagctgctagtgacagggcctaggggacaagcctgggtctgtctgctactcactcccatgctcgtcccactaagctcccactactgctaggaaacttctctctgaatcaataattaatttcaaaggctgctgctctggcttagaaactccacagtcactttgtgcaagttttacagcagtgctcagaaaacctcaacacttggtgtgagttatctgaggcatcttctggtagatgcaggcgagtccacctcttactctgaccttgggaaaggtcacgattcttcacagaatctgtgaaaggtcaagaagaaagtgtaggccccttttgtaaatgcaacaaaaaaacccagtggcttctagacataaggaaatcccctgttttctgacccttaaaacagttcatctttagcctatttaataaatgtcttatttttcatgtttgcacccccccacccccaaaactcaggttgacaagggtgacgatgaaaaatagagaggatgtttgtttatttctccaaaatatgtcccccctctgccaccccaccaaatgttatttcctattagtattgaaacataatatgaagatttcataaaacggagaccaaaatgacaaactagctatcagttgtgaggtctcccacatactgttcagtagactctttcccattagaaaataggtagaccacttattaccttccaacctcgtctttttctcccaattcactgagcagccacaatctgctgccctctcctgttgaatactacatgagctgcaggctgaagtgggggtaatgagaacagggaccctggaaagcacacatgtatgtcgtccaccagttcaccttgtagcatttcccccaccaaccgttcttaatgtccaagtccagtggactattgtgacatttgtcaaggttttcaaccagttgaatatggcacccgtggatgaaaaggatacactctccatcgtccaaagtgcaatttaaagtaagctcttctttaatgctctggggaaattgtaagtcaaacatctttttagacttcagagcaaaaagagtagcatttacatctcaaataaagagtcaatttagtctttcattcactcgttgacaacctatgtcaagtgttgttgtgggtcaggttcctgggaaacagaagctgatacagagatccgtgtgcagaagtttatagatgagtactcttggtgacaagaaggaagcaagttggagaatcggtagaagctggactgaggtgcagttacaacaaagatctcagctgatcctgatcccttggggagcttcagagttgctccacctcaaggcaagggaaaaggaccttgagaccccctcatggatgccctatggaggaagagtgaccctgggtaaactgttctcttctactgaggacaagtataaaaattagaagttcctgggtggaatattatgagcaaaagggaaaaaattaaaaaatgaaaaatttgaaagacaaaatattgtgttttggaggattttttatttttatttttttaagacagggtgtcactttgtcacccagattgcagtacagtagtgtgatcacggctcaccgcagcctcaacctcctgcattcaagcaacccttccacctcagcctcccaagtatctgggactacaggcatgcaccaccatgctcagctaatttttgtattttttgtagagatgggggtctcactatgttgcccaggttggtcttgaactcctggcttcagatgatcctcacacctcagcctcccaaaatgctaagattacaggcatgagccactgtgcccagccaacaaaatatttggaagacatttttgatgagtaagacttttcctacccaaacttcatcaaatttatcagagtattaacactaatttcaattagagccagtaagtagtgtttccttttcattttccaagcattgcagactgatctctgttttctaaacataaacttactaatattttactgtgtgctcctggaaaaactacattaaatctatctcaatttgtccaattaatgaaaattaaataccagaactgttcatatgtacattgtctcccccactagattatattctcctgaaaaacaaggaatttatgttttttatttgagcatgtctcaaagtagtgcatactagatgctgtacaggtgacaagatgaatgggtggatagaaggatggatggatggatggatggatggatggatggatggacggacggacatatgtatagatagatgggtgggtaaatggatgaatgagtgggtgaatggatgaatgcgtgggtggatagatagatgggtggttgggtggatggatgagtatttgcatgtatagatagatgggtgggtgaatgaataggtcatggacggatggatggatggatagatggatgggtgaatggatggatgggtggataaatggatggatggatggatggatggatggatggatggatggatggatagatggatagatggatggataaatagatggatggctggctggctggatggatggagagatggatggatgtgtggatgaatagatggatggatgggtggatggggaatgagtgggcaggtaatacatgagtgagtgggtggatggaaggataaatggatgggtggatggatgtgtgggtggatggatggaaggatggatggatggataggtggatgaatagatttgtatttgtgagtgggtggatgaaaagatgggtggatgggtgggtggacagatatatagatttcaaaaatgagtatatctatatgaatgaatgaattcctccccgacaacaattataaattgatgtcagcatagaaataaaatattcccaaaggttgagcaaaaattatctaattgtatttatctaataaactagaaaagtaaaaataaggatgacgtcactacacagggacattttacagtatttctcccacccatgctccctctaaaaaccttgcaactagttgatttaccagtactacccacttgtggtaaaacaatttttgtcaccaacacatcactcacacctctctgccatcaagataatacatgtggtccccaraatgttccaccaggaggtgttctgggggcagctaactaagagggggcttccagacagatggaggagttgatacacatgaggtcacagatctactgcctctcccccttyaaaagaaactactcagctccatttgtctcagaatctagaggaagttgacaaaggtgccacagcagcacagcacagtatgtggtggagagttctcagcttgctggcatggttccccttgcaaggtaaggacttagagttatttttgttgttgctcagctgacttaatgttttgccacatctacctatcagtcagtcaactgcatttacagaggagctgctgtagaagacaacccaggtaactgctaatactttccaagccatgctcaaatcatgcatctgagggatgttactgcgtttatttgatctctcgttcaatggctaaggagtatagaaaggatcattatagtgtgtgtctctgtgggtcctatgttacggcaagatgaaacaagcttattaggctctgtcttttaagggcataccagttgaaagagcatccgtattgaattttattttattttwtttatttatttatttatgagacacagtctcgctctgtcgcccaggctggagtgcagcggcacgacctcggctcactgcaagctccgcctcccgggttcacgcctttctcctgcctcagcctcccaagtagctgggactacaggtgcccgccaccaccacgcccggctaatttttttatatttttagtagagacggggtttcaccgtgttagccaggatggtctcaatctcctgacctcgtgatctgcccacctcagcctcccaaagtgctgggattacaggcgtaagccaccgcgcccggcctccacgttgaattttaaaatttccttgctgtataaatcttagccaaacgatttaatctctttgaaactcagtttctgcatcttaaaatgaaaatgataaaaacttttgatccaccaaactccctggattgttagaaggatcaaatttcaaatgtgaaagcactttgaaaatgataaagcgctgtgcaacacttatttagctcagaggtaataatgagaccaatgaaaacttcgtgtttatttttaaagagtaagttatactttacattttactataattttcaaatttggattttagtgcttaatcctaatgtagcattatgaaaattaaggatagaagcagttacctttttggagcaggtcaaattattttctacccaaaagtgggggcaggggtgtaggaagtggctcctgttgtccctcagtctctgcttacaattgtatcagattcatgcaaaggacatccctcacaaatccactcaaaaattttgctttttgtgtgtttgttaccaaatattgaaactgtagttctgtttcatgaaatgcacctatccttctaaatctacatttaatctggaatggcatctgaaggacgctactttaaaaaactcgatttcctattktacatagtacttcaattccctattttatatacttcaattaatgccttctttttttggtccctgtaccctgaggcacttartaaggattcaattttggtaatgaataatattagtttcttcattaagtggcttaaagaatagctaatacattcaaaaagagtacatttagacagctaaaattaggatgatttcaatttttccagagtttaaagcctttcactgaccttaactttttcaggctttgagttattgcctcataaaaaataactcataaaaatacattttttaaataaatagcaaaaattatgtttcaaggtaaacctaaattacttaaatattatttatatagagaggaaaaatattgtttcatgcacagtgctgagtactttgtgttaattacacttaatcatagcggaagtactgaggtaggtactaatatccccaatttaaagatgagaaaagaagttatgtaacctgcccaagttttaaagctagaatatgacaacataaataccagcctataaagcacatagtaaaagtatttatttcatgaaacttctaattaacktgtgtgtgtgtgtgtgtgtactagttgtgacagaaaatgtattaatgtggatcaaaagttggaaaaccactgactttcacaatttggaggattcaatattaaaaagtcctatttgaaaactcgttcaaggggccacccgagggcatctaagctcaatggcatttgagcagtggctgccacccctgacctaaccttgctcaagcccatcccagacgtaattaggaggaggtgaccatgttgctttcttgtcagcaaaaaaggcagcaaatcatcagttttggcaaagctataaactgtcagctgattttagcaaattaaattatgggaagatcactgtgactacttctacagtgttacttctatggctgccaaaaatttatggaaaaaaaaaaagtcacgtaatctcagagcctgccctcttttcaaggccactcccagaataaatagtcttaggactggtaaaaacacaataaaaatgaagcatttttcaaaattcatcccattaaattacactgtagacaatgaaaatgtcaaatccaatgaattttgaaccctctgttttcattgttttgtggagggtaggatkcagaaaacaaaggaaaattgcaaattgagtagttcttttcatactttctttgcccaggaaaaagtcacatgttagatgacatgttgagacagcttctttaaaatgtactaaaaatattccgattctgacaagtctgatttatttttatacctgcaattttctctattgattcaatctaaaaataataaaaatctttttttgtaatgatctgaattaaaacacacttttgcttaatgcctcatgacagtcatgtaactagggctctgatttgagmattaatgcattgcatgtctctggctttaacttagccctagtctttattatttgatataacagttaaagagcaaagttagcatcctattataatatttattcctaaatatatacttttactctatttttttttttttttgagacagagtcttgctccgtcgcccaggctggagtgcagtggtgtgatctcagctcactgcaagctccacctcccgggttgacgccattctcctgcctcagcctcccgagtagctgggactacaggcacccgccaccactcctggctaattttttgtatttttagtagagacaggctttcaccatgttagccaggatagtctcgatctcctgatctcatgatccgcctgcctcagccttccaaagtgctgggattacaggtgtgagccaccgagcccggcctatttactcatttttatccactaattcaaccaatatctaaaattttacattatgctaaaatgagtggatggcaaacagcttttccataaggagtttgtaatctatctacagagaaacacctgtaaccaaataattataaagtaatgtgctaagtgctgtaatagaagtatatctcaagmctttgggaaactaggggaaagacattatggggaaaagggaagctaaggcctgttttggaagttttgacaaaagttgtgtaatttgagttgagcctataagttgagtcttgagttgggtcttaatgttgagtcttgaaggagatgagaaagacattccaggacaagagaatatcatagaaaaagacaaactatcttctggagcctggaactttctggaaacagcaagtggacatgtacaaggactatctgaaaaggagtatcacgacatggcaaaggaggagaacacaggagtcaagtcggctggaatttgggcctgattcctataggcaatggaagccatagcaaacacttgaatgaaggaagagacataatcaaattcatgggttatatgtttgtttgtttgtttgtttgtttgttgagatggaatttcattcttgttgccctggctggagtgcaatggcacaatctcactcaccacaacctccacctcccaggttcaagtgattctcctgcctcagcctccagagtagctgggattacaggtgcctgccaccatccctggctaattttttgtatttttagtagacatggggtttcactatgtcggccaggctggtctcgaactcctgacctcaggagatccacccgcctcggcctcccaaagtgctgggattacaggcgttgagccaccacgcccggcctcaaattcatggttttaaaatgtaatcctagaaccagatgatgatgawgaattagagagaagagagactagaactaagttattacagtggtccaggaaagaaatgatggagtccttaactaaggcagcaataatagtgacaaaagaggactaaattgattaaaggatgttttggagaaagaagagtttagagcacctctcaaatatctggtgtgcagtggttggtgatgacattaatttatataagggaactctagaatggggcaggtggyatatctgtgttagacatgggtggagcatggggacagtagagataacgagttccaatgggacatgtagagtttggggtctttgcaggacaggcttgctctgctctggttttaaatttattgcatgtaaaaactaggctattaaggcaagaaaaggaaagaatattttattcttttctcagtctacatgatagtctatagtagaggtaaagattgcacatgagaacttccaaaatcttgggaaagaccaaaaartcttacgaactgcactggttttgtctatgtgtactttggtagatggctgttactgctgcttgtccttttgtttgggagtagatcacatgtgctttggtgtaaagccatccactgataggacaattagttcatgggatttgggatggtgatgacggtgaaggtcacaggttccatttccatatataaagcagtcacaatctatagccccaggatcagctagcaatctcataacatatggtcatgcatggatggatgaattcagtcacggagataatgacaaagcccagaagtcaataatccattctgtaaacatcacctaccgtaggaagtggtgacctcacaggcgaaacaccacagtcattcattgtcaaggtctgtatgttcagcatgtggggagccgtgcagggctaatttgcagataagaactctgaagctcagataggactaggaagtaggtgtatggcactcggggtctaataagaaagcttaaaggtaaatggggatgtacatgtctctagagcctacagaggaggaagtggtaagcaaagaagatatctcacaccccatccctctgacaacaaaggtgaaagtctgactccaaacttaggtgaaagaaaagtcaaaagaagttctaatttggtttccagtggcaatgagaagaccctggggaacttgtccttggaaaatgtgccaccaaaacttaggcacrgcatcctgctcttccacctttaacaaaactacagacattgaaacatatttttaagcactacagtctaagcaaagctgggtgggtctgtggcttctcactggggctattcttcccttctacagtgatttcctgtttctaaatcgaacatggggtctacatgataacactgcaagataagcagacccgtaaagccaaaagcaaggcttgttgcaaagagtaaaggaaacaacgaatattctatgcctcaaacacagccctttccrtatgaaactcaggcctctacagtgtggtcaatctggttagccgcctgataccgaattctcagcaagtgcaaacattaatcttaagacatacagtactttagtgtataataaaaagccaaactatatttcatcacaatttttaaaatgttgtaagggttaaattatactatttaattcataagcatgcatcctaagaaagagaaaaatgatacatacaaccttaaaatgggagacatttattcctaaacaagctgcagataaatctcaccactcccatcttacccaatgcaggctttctgtttagaccatcattttaccaaaggtaagaacgttggcaaaacttctgtcaatgtctagtcctcaaggatgaaattagggcatgtttcttaatactactctttattctatcattgattccatgtgtaactttcttccagtagcttccttcctgtttctcagtatttttattaacaacaggagaacaaaggtatctgtcaatcacctacattatagtgccatcgtgaatactagcattaagccagtacttttcaagctcacattgtaatagtttctgtaaggaatgaattttagagaaatataaaacatagccgttgtcctctagaaacttcagtctgtttataggcatcaagacagtacacaagaactagtgagtaaaacagtaagcatcacaatgctatggaagttagacagttctggattcaaatcttggctcaaaagctgcttaacctctgagctttgatgccctcatctgtgaaatgggaataacaacaccttctttacagagttattggttttgggcctgaataactaggctatttgctgttggtgaaatctaaaataacacatttgggggaagagaatcaagagtttgtgttgtacttgttaggctttcagacttctaactgatcatcagaaaggtgatgaggccagatgagatgacctatggagtgagtatagagagtctatccaggatctgacctccgttgtgtgaagggcagattgatgagaagaacccggaaatagagctgaggagcagcagctgccagtgagttaggaagggagtcaaaaagagactgacatctagggaaccaggtaaagacactgatttaaggggcagagagtgatcatatatggcgaaggaacaccataggttgaataagatatggtctgagaatggagcattggtttgagcaatgtgaaggtctttggcaaccttggcaaagagagatttcaacgargtagtggagttgaaaacctggtcagaaaacaaagagtgggataaacaaatatagatagttctttagaaaaatgtgtcagtgaaagagagggaaggcagggcacggtggctcatgcctgtaatcccagcactttgggaggcagaggtgggtggatcactttaggtcaggagttcaagaccaggacaacatggtaaaactccgtctctgtactaaaaatacaaaaattagtcagatgtgctggtgggtgcctgtaatctcaggtactcgggaggctgaggtaggagaattgcttgcaactgggaggtggaggttgcagtgagctgagatcatgccactgcactgcagcctgggtgacagaatgagaatctgtctcaaaaaaataaatcaataaaaaggagggacatagggtagaatagggtagtataggatagtagctggaaggaaatctgacatcattttgtttatgcattttaatatgggatgaatagtatatatttgtgtgctgatgagaatgacagttttttttcttaattttttgtaaagacaaagtcttattatgtttcccaggctggtctcaaactcctggcctcaagtgatcctcccaccttggcctcccaaggtgctaggattacaggtgtgagccaccacatccagccagagaatgatacagttaaagagaaaaaaaacaatgatggtagaattatttttgtaccaaatcatcttttgagagatggagcaacacagaagggaattccttgtgtaaataaatgagatggaaactagtgtccaagtggagataccgggtacccactccattcacagcaatgtagggcacgccaagtatgcaggatctaaaagcaagtagatgtgacttggggatgacattgagaaacacatatgcaaataagttagcatttcaatagcaaacaatttatgtgatgaagagaagagagaagtgggaaaacatattattatttaatttaatttatttttgagatggagtcttgctctattgcccaggctggagtgcaacagcatgaactcagctcactgcaacctcctcctcccgggttcaagtgattctcctgccccagcctcctgagtagctgggattacaggtgcccaccaccacgccaggctaattttgttcgagaccatgttggtcaggctggtctcgaactcctgacctcaggtgatctgctcacttcggcctcccaaagtactggaatacaggagtgagccactgcacatagccataaattttattatttcacagagttctaacacctctgtctgtctgtctgtctgtctctctctgtcttttcatcaaataatgattgtgtaccatgaactgagtggtatgattaactacacctttggttggaatctaaggtccaaaatgaaaagaactcattatcaccatttgctcctcaaaacctttaatccttctgaactgttccaatttagatttactgcgactggaactgcttcttccttaatgtctactaggacctaactgcttcttccttaatgtctactaggaccttagaatgtttaataataaatagtcctgtaacactggggaaggagatccctagtgaagagctgcagagctacaaggctttgtcttttgacactgactctttccacttttctttgtaaagcaagagtcagttcagcttttcaaataattattaagcactatataccaagtaaaagaagaatgtcatgcttactatggactaagtactacactaggttctttacatatattttttaattgcctcaatgactctatgagatgaatactattgtttttcctgtttttatggtaaggaaattcacacacttaaattgcctaagttcgtgctgttagtagtggaggagccaggattccaacccagtcaatttggctcgtgtgcgtgtgtgttaccattgcatcatatgccacccaggttagggacacagagatgattataaacagctcctcggtgcaacaggttcagatggtacaaagcctagggstctattgacagataagacaatcaagagccagaatgttctcagaaagcttgaaccctcactccaaacttaccagataagactgaygtagggagaatatgaaatctgaactttggttccaaaatgaaatgcatcatgaacacaggatagggagacgtgatgtgacacaaattctctgaagaagatctgggtgttttgggtgactgcctcaacaggagcctagtgagatgttacagctcaagagtgaaaccctgggcttaatagaacaaggaagtccagagggtgggtggtgatgcaagtgaatgtccccctatgctcttgccagctctgatgacacataagtcccctgtcccatgcaaaggggcatatttttggaggaacatggacaaactacagtatattcacatgtggctgttggcaagtggtgaacaaatgataatgaaactagaggcatagcttctttaattatttgaccttatgctatggaaaagacttttatcttcagaagacccagtctgactaagggcataagggcttggacgcagtggtatggtagaatgtcttctggaagtctttgaaagtgagattgatactcatcttcctgttccatgtggtttctgcagcagcwgagagttggtcccaagtatctgaggagcagccacagggctctggaattttattcattacactgcaactgtgggctttgggaataggatgctctgaacactcaggcctggggtcagaagaactgatgcgtgggccccaccacgaattccgagttaattagtagtgaatgaggccaggacacaaactccctgagtgagtctaacatactgccaaggtggaggaccactggctttcctaccttcttaatatggatgtcatgagaacacaaaatagggactcaatggcttcttaaatctttattatcagcaaaaatcccttagaagaaattctattgtcattctctattaatatcatccttattactcaattatggattgatgtcacagaggagaatatttccaaatggccaaacctaagcagaattctggccttatgccccagtgctttttttggaaagcacagatctctttttattacctccttgttgttcattatggtattggtggatgatatgggtgtttttccattagaactccagcaaacagtttcccgtgaaagcttatatgaatccaatacaataattctgggttatttctgctagaggctagattcaaattaatgacctaggaatggaacaaacaaaaaagtagacaccaattaattcccagagctctccaaagcacttttcctaatacttgaaatttatcacaagaaaatatattctcctggtttcttttttgttgttgttgttaaggtttaagatgatgccgtaaaacttgttacatttgctattcataatttataaccccatggtattcttctgtttataaaagtggtttataccttcattgataagaattgccttttcctcaggacaaataatttaatttataatatgaaggaataatgaatggcaataagcatgccaaatcatcaggaatgccagtttatttttcatcaatttctttttttggggagataaatgtgcagctacttagaacaaattgttcatcattctctgggggttgtgattcggagaaattagacttgtgtttgtctggagaaagctcggctgtggaatactgaattgaatgaaatcttagaacatcctccctctggtgtagaaactctcggacaggtggggctcagccacttgccctgaagggtaactccgcagttcaccagagcaccacgattataacattctttcttagaattctagacacacaacttgaaggtactagatgctcttttataagctgaggccagaaaggttgcattttctggggccttgtggcttagataggctgatgtagttacataaacacggcctttgccatccacagccctgggtacagatcccagctcaatgacctctgttaccttgagcctctattccctcgtctgtaaagtgagcacaattcttcctttctagggttagtttgaaaattaaattcgggttgggtgctgtggctcacacctgtaatcccagcattttgggaggccgaggtgggcagatgacttgaggtcaggagttcgagaccagcctggccaacatagtaaaaccacgtctctactaaaaacacaaaaactagccaggcttggtggtacgtgtctgtaatcccagctatttgggaggctgaggcatgagaatcgcttgaacccaggaggcggaggatgtagtgagctgagattgtgccactggacttcagcctgggcaaccagagtgagactttgtctcaaaaaaaaaaaattaaattcaatacaggtaaatggcctggtacagttcctggcatatggcagagcaatcgcccaaaacctgttgaactgtagtttgaccttccctgtcttctgtcaaaatcctaccccttccttcagacctgattccagggtccccttcttcaagagatatcattactgctcctactctcagttcttgcctctcccctcccattttgtttgtatttgcttattttttggtttctagaagaaatagataatacatgattgaatgaatgaaygagacaaaatccctgagacactgtggaccccyggcctgatcatccccatttctcttcctccacagmggcctctctgactaaccacacagaaaccatcaccgtggaggaaggccagacgctcactctaaagtgtgtcacttctctgaggaagaactcctccctccagtggctgaccccctcagggttcaccatttttttaaatgagtatcctggtaagtgaaagaaagaaagaaaaaatgccaccagaccttaacctgagggtttttccagccggacagtttggtgggacagaaagcctgcatgagtcacccaaggggtgggctcagcccacctactgttacacatgaatcacgcctccaaatcctgttattttacacgcagtggcttgctgggggcaggaactgtgaaatggaaaccccaccagaatggttgttaaagggggttcagattacaaagcacatttccatgtccccaccccacactcacaccactttttcactctcagtaactatcacacaaccacagcacaatgacagacaggcaaccaactgactgggagcccgatcctcatgcaaccaccaccaccccagataagaagccagctgcttcgttttccatctgagcaatccaaaggcacattacaaagctcctttccagatagctcttcttctcctgttggtcttaacataaaatcaagatttttaagcaatagaaatagacaggatgtattaatttggaaatgaggacagtcatttctcttttcacaaacacacatgaagaaagtacaagatgtctgagatggaaaaagactcttaagaatctcttgggttcatctctttgacgttaggcagggttttactaaaccctagatcattttatgtctccatttaatattgctaactgccaaatacttggaaaagtctaaaacacatttcagtcttatttataaagcagagcctcttaaagcatatcatgctggctgggcgtggtggctcatgcctgtaatcccagcactttgggagactgaggctggccgatcattttgaagtcaggagttcaagaccagcctggccaatattatgaaaccctgtgtctactaaaaatacaaaaaaattagctgggcgtggtggagcactcctgtaatcccagctattgggggaggctgaggcaggagaatcacttgaatctgggagatgacagttgcagtgagctgagatagtgccactgcactccagcctgggcaacagagcaagactctgtctctaaaaaaaaaaaaaaaagttatgctttgaaagcattattagatactgatatgttaacataaagaaatatattatttcaagctaaatcaactagaagtaaatactaattgttaaaagttctgagagaaaaaaattttaaatagagataattctgttacataatgctttttgttgttttgtttctggttttggtacactgggagaagagggactctctcggatttctgcagcagaatggcttgatctagctcagtggttccccacccggaatgatcttaccttcccgtggagataggacaatgtctggagatagttttgattgtgccwaatgtagaaagcggggcagtgcttctggcatctactgrgtagaggccaacgattcatcggatatctttcctcataacagctctatttccctcttgtacagctttaaaaaattccaaataccagcttcttcatcactcggmcaatcagctctccatcactgtgcctaacgtaaccctgcaagatgaaggcgtgtacaagtgcttacattacagcgactctgtaagcacaaaggaagtgaaagtgattgtgctgggtaggtacctgcaagtgaacccagtaggggagcaatatggataggaacacgatatgtcgtttttaaactgaaccttttagtttaaaaatgttgcctagagcaaggaattgcctgggacacctctgccatcttttattgaaaggaaacagaagagagcattttgagaagcaagaccaagattgaactgtgaacttgtgaaatttgtctttgacagcaactaaattttctctccagggaactaaaagaaaagaaaaattgatatttgatgagctgcgactatgcgccaggcaccatgtgaggttctcgggaatcagagatgaattaggcacaatctctgcccataaggagtttgcgcaccagctcaggaagaaaaacatgtatgcaaatgaagtggaacctcatgacagcaaatcctaagatagaatgaattcagatgtagctgcactgcttgatctgctcaaatcctctctgccaaacaattcctcttttctgtaggagggcgggattgggaggtgcggataggaagtgacagcctcctaattacctgggacttactcagttctacagatggtcaactgtgtccagtatgtctatccttacttgttttgttttttgtggcagaacagatcgattaaaaacattgctttttattgatctctaagtaacatcatctcacatatcacacaaatgaatgtcttagacttctcctgttgaattactgcagtgtggtgcctgccatacggtaaaggcatgatgggaaagtagctgagaaggagtggctctcggggaggggtttgagaaccattgtgactcagctcagcgttgtctttttgtaagggagcacacatcctggctcagctgcttgtgtgcccttctgggctctcataacaccccatgtatactctgtcattgctctcaacacataatcttttcattaacagtttaggggctgaagccacaccagactattagctccttgaatcatacctttttcatcttcgtattgccaacaagtaacacatctaatgtatatttggagctaagaagtgcctttataaggtcttgatggcagatgggtgagttaagtaaatggggaagagctcagttctggactgaagtggaagtagaatgggaaacaggaagaagcaagcctaactaaaaagtatttccaagacagaagtataaagaaaaaggacgaacatgccctttataagataaatgcaccttttttttttttttgatggggtcttgctctgttgcccgggctggagtgcagtggcgcaaactcggcttactgcacacaacctccccatcccaggttcaagcgattctcctgcctcagcctcccgagtagctgggactacaggcgtgcaccactatgcccagctaatttttgtatttttagtagagatggggtttcaccatgttggttggccaggatggtctcgatctcctgatctcgtgatttgcctgccttggtctcccaaagtgctgggattacaggcgtgagccacctcgcccggcctcatataccacattttaagaattgttgctacattgcttgttcgggaattttcagagactaacaacacactgagtaatacacattctggcttcagccaaagtagctttgcaagcacatgaaagccctttaacatgactgtattctggaagagattaagttaaaaaatatgggccgggcgcagtggctcacacttgtaatcccagcactttgggaggtggaggcgggcggatcaattgaggtctggagttcgagaccagcttggccacagagaaatctcatctgcactaaaaatacaaaaattagctgggtgtgatggcgggtgcctgtaatcccagctactcaggaggctgaggcaggagaattgcgtgaacctgggaggtggcggtttcagtgaggcgaaatcgtgccactgcactccagcctgggcgacggagactaagtctaaaaaaaaaaagaaagcccattaattagagtataccctataacaatcacctacagattattagcctctgtgctttgttgagatatgcagactcatatctaattaacacagaaaaatccattttgttctagcaactccgttcaagccaatcctggaagcttcagttatcagaaagcaaaatggagaagaacatgttgtactcatgtgctccaccatgagaagcaarccccctccgcagataacctggctacttgggaatagcatggaagtgtccggtaaggggagaaatggttctctttgtcttccttcctactcaaatttccaggggatttttaaatgttttggcaccctctagtggcagacaatgccagaagacatcatttaatatttcatcagctcttttccagacaagttattcttacaaccaatcaattttatgccttaatcttgaaaggctaatcatagatattgaaaatgtttttgtttaaaacaggtaaaaatstaaagtgaactataatgacttcttaaaatttcacaaaattgtctaaaataagtataatacagaagtataatatctcaggcgaggcacaatggctcatgcctgtactcccagcactttgggaggccaaggtgggtggatcacctgaggtcaggagttcgagaccagcctgaccaacatggagaaacctcgtccctactaaaaataaaattagctgggtttggtggtgcatgcctgtactcaggaggctgaggcaggagaattgcttgaacccaggaggtggaggttgtggtgtgagccaaaaatcacaccattgcactccagcctgggcaacaggagcaaaattctatcaaaaaaaaaaaaaagaagaagtataatatctgtgagcataaactttttcccagatataaaatcgaaaatatatttaacataatacatataattggaacagatatgatcttccctatattgtatagtactatattgtgtcatacccacaagaacagattaaaaatattcttgtaacaaagcacctaaaggttgagcctttgaaacagaataactaattaattatggtgtctgggtactgtttatagtttgcttacatttcaacagacattacctttgatatctatgtaatcaaccatcttttttttttgagatggagtctcactctgtctcccagtgcagtggcacgatcttgactcactgcaacctctgcctcctgggttgaaacrattcttctacctcagcttctggagtagctgggattacaggtgcatgccacaacacccagctaatttttgtatttttagtagagacagggtttcaccatgttggccaggctggtctygaacccctgacctcaggtgttccaactgcctcggcctcccagagtgctgggattacaggcgtgagccactgcgcccggcctgtaatcaacattcttagagttgcaaaggacyctttacagttgagaacactgagggccaaatggagttctagagagaaaagacctaaacccagatctgattcccagggcagtgccaattctacttcattataagacttccctttaattcgccttattcatataaccagaataaggtcttggatctttgtgtttcataacaacatcaagctgtccttcttaagctttgaatttttttttccagtagtgaaaagtttgtagaaaaccatcatctactctcattcatctgtttgcctttgtgaccagaaccaagcctatacaagggaactggctgaggttagaatgaggttagaaatctaatgtttgccatgaagtcaaggccattggcctctaatagaaccaayctcatccagtagcattaaatagccataacctcttcaaattgctacataggtggaacgctccatgaatttgaaactgrtgggaagaaatgtaatactaccagcactctcataatccacacttatggcaaaaattcaacrgtggactgcattatccgacacagaggcctgcaagggagaaaactagtagcacccttccggtttgaagatttgggtaagaagaactaatgattctcttgaataatttttgatttactttaatattacactatcaaacaaaattaaatgcagtgggcagagtccttcagattaagattactgccaacaaagctttcctaatagcaaattcctgtaytgattgaaatttctccaggtgagtgacggaattccaactattccaatgttcaaaagaaccccagttgagcagaaagcctagcacagcgccatatgcaaatagtgtcatgcttgctttttgataatgactttaaatcgttttattgctgttgtgtttttggagtaatcatatgaatcatactgcatctttgtacttgacccagaaggagataatgttagctgaaataaacctaaattgtcaatatcattttatgtgaatatgaaacacacagatacatgaagacataattcctgtttagatttattttattgttataattgctttgaagattttagtttaaccatgttaatattctgagttgaacaccattttaaacatccaatattaaatgtgaagaggagttgcctccattctcagaacctctattctatgattctttccccaaaagtccaagaaataattttaaaactgtacacaactctttgagccaagaggtatcctttaagatgcatgagtcctgtaagaagtctgcaattagtaggactctgagtttcactgttttacaaggtacttctctgtgtaatcaaatcctaaagtataaggaattactcacatcagtgaaagaggaaactgttggatgacaatgcatttattgaaaaagctcttttatcagacgaaatcgctgatgctgaaaggcaagcttgcttaggagaacctcactgtgggaaagctgccgtgatgccctgtgggggctgtggctgcggttaacaggccccctctgactaccacaaactttccatgggtcactttctcaccaaaccaaaagtagtcattgcagaagctgcactgtaagactcatggacctacagaccgagctgtacagtaaccttacacaaccacccccacccctctgtgagtcatccccaccccacgcctccacctccagcagtagaactgaagcatagggcatgtgggggatgagcctgtatctaaaagcttcctaaagacattcaggttcttcaataggagaaccaacaatgtcgaaaaaaatgcattcttaattttcagcaattgttcaagccatctacaaaaattactatgaagggggaaatggcagttctccacctttacggctatagctctgtatgactcaaaattatagctaaagatgtttttaataataggctaaggccaggcgtaatggctcacgcctgtaatcccagcactttgggaagccgaggcgggcggatcacctgaggtcaggagttcgagaccagtctggccaacatggcaaaaccccatctctactaaaaataaaaaaatcagctgggcatgattgtggacgcctgtaatcccagctacttgggaggctgaggcacaagaatcgcttgaacccgagaggcggagtttacagtaagctgagatcacgccactgcactccagcctgggcaacagagcragactctgtctcataataataagaataataggctaagacttaatttttatttgtgatctatttgctgtactcattgccagatctccaaatagtattcaaagagaaacgccagcatcagctgttgatagcttccattagttcattgtttcttccatttggctagctgctactatattgacatatagatgttacaaacattttgttcacccaattaggtaaaaaatattactagctgaggatgctttaaaacacatttacacataagggttctgacccctttcattcctgtgctctgcatggaaggacctgggtaaagtgagggtcatgccagcaccaggactagggtggtcctgaggaaagaagtgccttcctctgaaaaagccacagtgtgatgcttcgagaaagagagtagagcaacaggaattgatttttgaataggctatctttgtttttatgttttgttttgttttttgagacagggtctcactctttcaccaaagctggagtgcagtggtgtgatcgcggctcactgcagcctcaatcttccaggttcacaatcagtcctcccacctcagcccctcaagttgctagtactacaggcatgcaccactacatctggctaatttttaaatttttgctgagacggggtctccctatgttgctcaggctggtctcaaaactcctaggctcaagaaattctccctctttggcctcccaaagtgctgggattacaggcatgagccacctcacccagatttcagaattatcatttatttatttcttttcttgagacggtctcactctgttgcccaggctggaaggcagtgacacagtcttggctcgctataacctctgcctcccaggctcaagttgatcctcctgcctcagcctccggggtggctgggagcacaggcatgagccaccacgccctgctaattttcatatattttgtaggtatggggtttcgccatgttactcagcctggtcttgaattcctgagctcaagcgatccctcaacctctgcctgcctcccaaagtgttgggattacaagcatgaaccaccacacctggctctttttgttgttcttgttgagacaaggtctccttctgtagcccaggctggagtgctgtagtgcaatcatagctcgctgcagcctctacctcccagacttaagtgatcctcccacctcagtctcctgggtagctgggactacaggtgcacacaccacacctggttaattttaaaattttttatagagacagaatctcattatggtgcccaggctggtctgaactcctgggcttaagtaatcctccctcatcggccacccaaagcactgggattagaggcgtgagctactgcacctggtttatttcatctttttagtatttaaaatgcggaatcttggttttctattacttacctggggataggattttttaaatatttgaaaaacagttctcaaacttttgatttcaggacctctctacaatcttaaaaataatcgagaaccccaaagaacttttacttatataggtgatgtctgtcaatatttacctattagaaattaaaactgagaaattaaaaaaatatgtatctgtcaatttattttaaaataataaatctgctacatgttaacagaaatggcatatttgtttttattttattttttgagatggagtgcacttattttttgagatgagtgcagtggcccgatctcagctcactgcaacttccgcctcctgggttccagtgattctcctgcctcagactcctgagtagctggcattacaggctcctgctaccacacctggctaatttttttgtatttttagtggacatggggtttcgccatgttgggcaggctgatcttgaactcctgacctcaggtgatccacctgcctcggcctcccaaagtgctggtattacaggcgtgagccaccgcatccggcccagaaatgacatattttaatgaaaamaaaaagtatattttgtaacactgaaaagattagtgtgaaaatgtcatttttttacattttgaaaatctcataaatgtctagcttaacggaaaacaattaggttcttgtaacttttgcattcgatctcttccaaaatgttattttgctttaaataaatatataaaaattcaatctcacacaaatatataattggaaaagggtagaatattttaatagctggttcagataattgtggctattcttctttgatgttacaccaaaactcaacaagtagtagtttcttaaagattagttgctatgtggactctgggcccatgtcaatgaacttttcatactgttatattaaaacccactgaactgtcttacactttgcttagaatttttacccaggcatgatttttctaacattatgttttagtcatttggaaaatactgattcactaagttctacagaactttccaatgttgatatatttcagcatcaaaatcacattcattaatatcatcaccgatctcatcagaaatctttaagcatttggaggttgtcaaactcacagtggtggatacaagttgtccgaaatttgaactttaagtgtgactattgcaaatgaggagctattttattttttgagatggagtcttgctcttgtcgttcagactggagtgcaatggtgctatctcagctcactgcaacctctgcctcccaggttcaagcaatactcccrcctcagtctcctgagtagctgggattataggtgcccaccaccatgcccagctagtttttgtgtttttattagtagagtcaggtttcaccatgttgaccaggctggtcttgaactcccggcctcaggtgatctgcccgccttcaccttccaaagtgctaggattacaggtgtgagccactgcacctggcctaaatttttaatatattttcattttaattaattttaatttaaatagtcgttggagctagtgcataccatattggatagcagaggtctacaatattctgaccaactaggggggtagatcatcatgtgccagtatccacccaattaaaacaacattcagtctaaatgcaatagtttgctagcttgttaattaacaggataaatcaaagtaaatacagagtctagttttaaatatgtatagataaaacttgttttgtacataaacataattttctgaattcacatartatatactatgttagaagatttaaatcactattgataaattttattctatatgtccccagtgatgtccttcttcttttttaaaattttgagacagggtctcactctgtcacccaggctggagcgcaatggtgtaatcacggttcacagcagcctcgacctctctgggctcagatgatcctcctaccttggcctcctgagtagttggaactacaggggcgcaccaccatgcccagctatttttttgtagagatggggtcttgccatgttgcctaggctggtctcaaactcctgggcttaagcaatctgcctgcctcggccccccacagaactgggattacaggcatgaaccattgtgcccggccccatattcttcttaaaatttattcccagtacttctatttgactagcattccagcttttccctcttttcattgccagcagctctcctctttcttcaattttctctggcacctgtgtggtcagagttcattttagccttatagtctatactattatctctataatgtttccttagtaattctttctttcctcagagcccttacacacaattcaggtatttttatatttttcatacagtttgaatgtttgattaaccagatatgttttcaaaaccatggaaaattatttgattaaataaacaccaagaagcactcacaaattttataaaaacatgaaccacctgtgacgtgtcagtatatatatatacacacacacacacatacatatacgtatatatatatatatatatatattttttttttttttttttttttttttttgagagggagtctcctcgctctgtcgcccaggcttgagtgcagtggtgccatcttggctcactgcaacctctgcctcccaggttcaagcaattctcttgccttagcctcccaagtagctgggattacaaacacacacacaccaccacgcccggctagttttttgtatttaaagtagagatggggtttcaccatgttgaccaggctggtcttgaactcctgatttcaggcgatccacccacctcagccttccaaagtgctgagattacaggtgtgagccactgtgcccacccgacatgtcagtgttagtatttgtaaagtgacaggcacagttattacatgcttcctggatgtggctggtaaaacctgttcaatgactggtaaaacctatactaggctgaccctctggaaacattcctaagcattgattaatgttatacaataacatttagcactgtgcttcataaatagctaggcattgtactaaacatgttatataaatgaacttactaattctcacaaaacactcgaagaggtaaatgctgtcagtatctccrttttacagataagagaaaaaaaagtgctaggtcgggtatcttgtccaactcattcaggagcaggtaaatagcagcactggaattcagcccagtctgaggctgattccaaagccatctaataggtagatagataggtggatgggtagataaacagacagakggattgattgatggatagaaggacacagatagaaacagtgaatactctttgcctaccactgccaccacacagaggtccagcatgctgtgctttaagccaggcaggtgagcagatggacactcagtgggatacagattcaaaaaccagagcaggagccacagaacacacagttctggggtttctgcacracctctacaagcaggtagcygctaaatatattctccaatctcttttactgagcacaatgtgggtaaaactgctctctatagtagcagaattttgtttttcccctttcctagttactgatgaagagacagcttcagatgctctggagagaaactctctatcctctcaagacccacagcagcccaccagtactggtaagtgtcaaaatcattcaaacttgtttttaaaaaatcacgtttccttgggaaggttatttttctcattctaagttttaagaatattttttgttttaatttttactaagaccatacaggcccctccaactggctccagctttgtaccatcctagagaagaaccacatcaggcatcggaatacttagtgggatgggcttcaggctgacataaagctttgcaagttcagttctagtttgcctgagatagagatgtacacatgtacacacacacattcacgactgtgacatttgaatttcctctgcagtaaaggacaaagttgaattcatttatagagagactcgtttctttttttcccatctgaagcacaccaaacacaaaacacagacttggtatcaacaaagagaaaagaagcagaagctggagatttggtgttgtcattgaataacaaaatcacctctgaaggcacatcaattacttgattgtcaataactcaggtcatttttgatgatgggattgaactacaaatacagaataatttagaaagcctggattataattccarttttttagacagtgaactcactagaggttaactcagagcaatgattgtatatctaatttaactttgtattttacctagcatagtatccagcaatagcagcttctcagaaaatgaattacgaaagaaagaaagaaaraaagagagaaagaaaagaaagaaagaaagaaaaagaaagaaagaragaaaraaaagaaagaaagaaararaaagaaagaaagaaagaaagaaagaaagaaagaaagaaaaagaaagaaagaaagaattggttatggtgctttgagcaagactattagcctcatccagaaaggcataaattcctacatattctctttccatttcatgtaatgtgtcaataataatttcatttgttggaataagggctttcagagcattatcatgttcatagttctgagtatcagatcatatttttaaaaatttgtatcctaaataatatttaaaagtaaatgtttgggatttctaaacactgataaatacaacatgtaccatacaattttttgaaggacaatggaaattgaaaatattatgaagtggaacagccacatcacttgctttaataatccaatatttgtaaacgtgtttagaatctagtaatctttaacggcttgctactgagcaactcaattttctgctctgctttttcatatataagacttttaaaatagggtttctaaaattcctttcagctttccatttctacgattttattacatttaatacccattttcaatagaatgggaggcttcattcccctcggggtccacatagtggcgctgtgcaatggactaaaaagcaagaaactgcagagagaaaaaaggaaattggaaacatcagcagtaaaatctggaaaaaaaaaccacacagtttctgattttttataatttatcttatctagaaaaaacatcatagtacatcccacttctaatggggaggcaagcagaggtttgaataactgaagctatatttcaacataaatttcaggctgtaggttttctataattaaagcttggaatgccgttcctcggtgttcagttgttatcttgaagcatcctaaagaccttctccctaataggcctgattcaggatggaaatatgaaataatggtttaaatgctgggctctagagttaggtaaaacagagtttatgtattggctttgccacttatttgctacaggactttaggtactttacataactgctctaaacctccgttttctcagagctgtggtgagaaataatatataccaagtgctcagttcaaggccaggcacagagtaaatgcccaaaacatttaccttaaaaaaataaggcaaagtgagcctagccatttgcaattatgtttgcaagaaatccatagttcacaaatgatctcagtactgtttttaaatttggcttcccaagctgctctgggaagacttacgtaactacagttgtatgtagtcacatgtatataatgcatgcatagctcatgttttatcttctttcactttagtctcagtaacggaagattctagtacatcggagattgacaaggaagagaaagaacaaaccactcaagatcctgacttgaccaccggtaagtgtcacccactgcatttagaataaacactcgacattttaacctcttaatcgataaattcaatggcctttgtcagtcctcccttttcttgacctttctgccctttaggacatgattggttaatcactcccttgtccctccttgatttagttacctctcggcttcttgacatacttttcctggttctgttatttgttgctaaccactgcttctctgtatccattaattaacttatcttcctcttctgacttcttaaatgtgtatgtacttctgattttacttctccatcttttgttcttcccttttttttatatatatatattttttttgtgagacagagtttctttcttgttgcccaggctggagtgcagtggtgcaatcccagctcactataacctccacctcccgggttcaagtgattctcctgccttagcctcccgagtagctgggattacaggcacacgccaccaccccagctaattttgtatttttagtagagatggggtttatccatgttggtcagtctggtcttgaactcccgacctccggtgatctgcctgcctyggcctcccaaagtgctgggattacaggcgtgagccaccgcgcccggctgttcttcccttattttttaaagagtttactcattcccaagatggttcctgttgccactaggcaaaagatttctctcttttttttttctggttttgttttgtttttagagacagggtctctctctgtctcccaggccagggtgcaggggcacgatcatgttcaccrcagccttgaactcctgggctcaagagatctcctacctccacctcccaaatagctgggattacaggtgtgagccactgtgcccagtaagcaaaagatttctatacctatatttccagaacatcctcctcagcattgctcccaatttctttccattttctatgtatctgtagctgaattttctgtgatttccccaaactcaacattgctaaataccaaacrgcaccttctcccacaaaatcagcttgtccaaagcatcacacaggccccaaagcaacacacgggtcccaaaccttggtgttatctatcactcctatgtatgtgtacaaatatatctatgtgtatatgtatatgcatatgcacacaygtatataaaatcagtcaatttccaagaacttttgagtcttgtctttcaggtattttgtccattgtcactgttaacgtcccaatccaggctctcatcatctcctgcatggagtattataacttcagtttctcctcctctggttcacttttagcaccctaccatcaaaatatctctttatctgcatacctgtgttctaaaaccctttatagcttcctgaagtctacaacacagagcatgagtcccaaacacctcattaggtgccatctattacctacttctgcmgtctcatatctacaaagtccttatgagatacatatttttctctgaaaacatcaacccttttcaatcgccctgcccttgtttatcctcactgcccctggtggaagaggagacctcctctcacctctccttactccctcttcaaggccaatatcttcactgaaaacttttttgaccaactcaaccctcagagaccattcttgcctctgaacccctgaacacactatgatataaatacatatggatccagaatttgacatatcttacttttgtttgtttttattaatttgtttatatatagagacagctaatccccaaagcatgtgaactgtgccttctgtaggtccaagcacaatgttctacacatagctggcactccttaattattcattggttaagatgaggtgactaggacatttagcaagactacagcccatagaatcagaattctaggtttagaaagcctttttttttttttttaagagacaggtctcatctgtctcccaggttggagtgcagtttcacagtcatagctcactgtaaccttaaactcctggactcaagtgatcctctgcctcagtctcccaagtagctaggactacaggtgtgcaccactgctcctggctaattttttattattattatttttgtagagacaaagtgtcactatgttgcccaggctggtctcaaactcctggcctcaagcaaccctcccatcccagcctcccaaagtgctgggattacaggcatgagccactgcacctggctagaaatattttcacaagctcatctgatttagcccaaatgccttcctgtagggccacatttaacctaaccaagataaataaattttcrttttatttggatagttttttaaactccttaacaatccctcttgctacttaactatattttgctaaaaatcattcctaaagctaatttgaatctcctgactataacttaagtcgattttctcatatgctttctgtagaaataaaaaataactagcccaatagctacgtcacttaaaaaatcttttcaaatcatcacacataattgccttgtttgttgtatgcctgtttgcttgttctcagagaatgaacaatgtaagtctctttaccttcaggggtaagctctttctcatctcttcatctgagctgtctattagcttatatcacattgtagaagtattgttacatattctccagtggcaaaaaaaaaaaaaacccaaagtatctaaactcctttttcattttccttatagaagcaaatcctcagtatttaggactggcaagaaagaaaagtggcatcctgctgctcacgctggtgtccttcctcattttcatactcttcatcatagtccagctcttcatcatgaagctgaggaaagcacatgtgatatggaagaraggtcagtgggcagggaacctgacgggggctataagacgccagaacaaatggctaaaaaaaagggaaattctgtccattaaagctttctgtcagacactacataatctatttgataagtgctgtctcagataagcaattgtttgttttctagtaaactcgggtgtgaatctccagggactatagtctaagagtgtataatcaatagaaactagcatagatccagaaattggcattaaatgatagacacttctattcacagaaggataaaaatcccaggactgcctagcacagtccctacaggaatcaaaaactatgtgttgaattaatgaggtatgagttatgggaggggcatggtaagtctactattgcacagtaacagaggtattatcttattcaaatatacatttctacatgtccatggcatcagaaattagttgcttgattttctttttttgyagaaaacgaagtttcagaacacacactagaaagttacagatcaaggtcaaataatgaagaaacatcatctgaagagaaaaatggccaatgtaagtcaactgtatgacctgagatctgaacaatgaggttcattaatgtattagtcagatttctccagagagacagagacaacagaawatrtgtgtgtgtgtgtgtgtgtgtgtgtgtgtgtgtgtgtgtgtatgaggtgggatttattaggggaattggctcatgagattatggaggctgacaagtccttggacaggaggtctgcaaactggagaccctggtatgctggtagcctggctcagtccaagttcaaaggcctgagaactcaggggaccgccagcgttaagtcctgaaatccgaagctagggagtctcgagttctgctgccaggagagaggagggagtgtattccagctccagcagacagatcaacacatttgccttctttctgattttgttctttctgggcccccaacagaatggatggtgcccatccacatcaagggcaaatctcaatgcccacctactccactcagactcacacactaatctcctctagaaacaacctcatagacaaacccaaaaataatgctttaccagatttgaggtatttcttaatccacccaacttaacacttaaaattaaccatcgcaattaagtagtcgcctttaaaaagaaggaggctgggtacggtggctcacgcctgtaatcccagcactttgggaggccgaggcgggcggatcacgaggtcaggagatcgagaccatcctggctaacacagtgaaaccctgtctctactaaaaatacaaaacaattagccgggcatggtggcaggagcctgtagtcccagctacttgggaggctgaggcaggagaatggcgtgaacccgggaggcggagcttgcagtgagccgagatcgtgccactgcactccaacctgggtgacagagagggactccacctcgaaaaaataaaaataaaaataaataaaaagaaggagaagaatcaaaatctgattttttagcactagaaagtctcctaaatcatcctgtagaacttaaggagtctcatctgcaaaaataaatagtagcagttaagttcatgtagcagaaggtgacttccttttgggaagccatccttgactgtttgacgtcacacacagggataccccaagaccaccagaggatcctatgacacctttgtcatagaagcacgtcttcctccatattgtaatttttggtgtttttacatagctactacaatactcctttaggtggtgagtaatcagatttactctgtatcctcagattctagcacaggttagttgataaatttgtgttaartgagtgactataggctcaattaattcaagaaggcatgtgtcaggtcctttggatgacttcattgcaattcctgagacaaaatatgtaaagaaaatgaagagaatcgggatgggaaggagattgtgtatgggaagtggaggttggggattgtattcttgataaagatctggaaggcagaagctaggactatagaaaagcaagaatattccaccttccaaccatattatttcctccatacaaactaacttattctacccgccaggagctgcaagaaatacagcgagttttgccgctctattctattggttttactgaggtttttgtaggaggcttgtcttttataacacctctgcctctttaggttttgacctactagagcgtgaactgaaaagaatgaatagatgtactagctgggaaaggaacacaagagaattgactgtgtgaaaactgggggtgggaggggaaaatgtgtgtaaataacatccaagtcgattgtgttgcaacacctgtttctaaatacccgtcatcacatactcacctggtggacaggaaaatgatgttaatatcatgtgtgagttgggttgctccctgagctgtttttcctaggcaagaagaaccaaaacagtgggagtagaattatgtctgttagctggaaaaatggaagcccttccagttcaacttttaaaacaatttttctttctttttttttgagacagggtctctcactctgttgcccaggctggagtgccatggtgccatcataggtcactgcagccttgacctttcgagctcaatcagtcctcccgcctcagccttcctagtagctgggactacaggcacgcaccaccacgcccagttaatttttatatttttagtagagatggggtttcaccatgttgcccaggctggtcttgaactcctggactcaagtgatccacccaccttggcctcccaaagtgctgggattacaggcatgagccaccacgcccagccaactttaagaatatttaaaatgagtacctgcacgactcaggggattcctccccagaaaagtacatcttcaggggtttgctgggggtttcactttctcccgagctcaagccttcactttcatcctccttgccttagcaccctcaaatctagcattttaattgtgttgttttggacatattaaaaatattctctggggccatctctagtctctttgtacagaattgcataggccttgagtgtgatctgccccgaccctatttttgcagtaagccctgttatttctagtgtgcaattttgctaaggcaatatgttatggtcagcaacagattattttacagcagaaatatctgtatattttatttcacgtttaccagtatattgtttatatagtaagacttctttaaaaattatagtataggccagtgcagtggcttatgcctataatcccaggatttggggaggctgaggcgggtggatcacttgagcccaggtgtttgagaccagcctaggcaatatagtgaaaccccgtctctacaaataatttgaaaattagctgggcatggtagtgtgtgcctgtaattccaggtactcaagaggctaaggttagaggatcacttgagcccgggaggctgaggctgcagtgggccgtgatcacaccactgcacttcagcctgggtggcagagtgagaacctgtctcaaaaaaaaaccacgaaaaacaaaaaagaatataataatgccttcagaccatttatatgcatcagtaagttttaggtttttataaagcaatatgtgaacctaaaaatatgatatccaatcaaagtgtttcaagtaaatgggtgcaatgttattcaaaataaatattcatcttcaacatgtttttctttcagcttcccaccctatgcgttgcatgaactacatcacaaagttgtactcagaagsaaaaacaaagaggaaggaaaaygtacaacattcaaaattagaagaaaagcamatccaagtaccagagagtattgtgtagtgctctctgcaatggaacatgtgatttcagggttgccgcagtgtcamctcagtggaccagcctgggggaaggagcttaattgctgagacattaataatgacctcttagtgcaatgcaagatggtgtcctcggataatgatctgccccggagctagggcagcaacatgaggaccaaaccatgcacataaagcttgtagtttaaaaaagaaaagcaaaaaaataattatgcctgacactacttcagagcaggaggattctacgaagccttggggatcagggtcagtgtgagcagctaacatcctacctcaaatggaacaggaktttttgatgctttgctctaatggaactgttttaaaaatttttttttctttttaatattttcttctggtcacaaaataaagaaatttgggatgcaaagtacctaaagatctctgatcctaagaagttacttctggccaggcgcggtggctcatgcctgtaatcctagcactttgggaggctgaggtaggcagatcacttgaggtcaggagttggagaccagcctggccaacatagtgaaaccccgtctctactaaaaatgcaaaaattagccaggcgtagtggtgcgcacctgtagtctcagatacttgggaggctgagggtggagaatcgcttgaacctgggaggtggagattgcagtgagtcaagatctcaccactgcactccagcctgggcgacagagggagactctgtctcaaaaaaaaagaagttacttccaagacagacttttaagatgtaaccagcacaaagcaatgtcagggaggagtgatacatgacaataaatgagtcagatgagcaagaaggccccagaacccatgccccaaggcacaaagaggagctcagggtaggcccaaagattcgaattccttagattactaaatcacatgagcggaccttgtctgtcagataagatttttacctggaaattccatgaccaatacatgtgcaaaagaaaatgatgggttgaatttactgattattgacctaatggatggctttttaaaatgttttaataaaaagcagaatagatgtttgtttttctagtggttataccaagttatacttcctgttttcacgtgtgaaagtaacatgggacatgcctttcttttccgatcagtttatttaagctatacagcaaactttggcatttatgtggagcatttctcattgttggaatctgaataaaccaattacaaaataacatatgtgcacattgtaagtctgtaatttgtgataggggccagatccaaccatgctgattttttgttctcttgacaaaactgttttggacaatcacaacattacagaaaagtgtaaagatagaacaaagcacttttccccctggaatcatttgagagtaagttgacacaatacccatcaccccccaaatccttcagtgtgtgcttcctacaaataagaacgctctcctttagaaacacaatgcaaccatcaaaagtgggaaattagcactgttctgcttccacgaacagtcctcagactccattcaggtttctccaattgtcccaaaggatccagttcagagtcacacttcattttagtctcattcagtttggaacagttcttcggtcttggcttgcctttcatgacctggatatttttgaagattacaggctggttattttgtagatcatctctcaatttggctttgtctgcttcctcgtggttagattcaagttgtgcagctctcataggactgtcacagaagcgatgttaagtttatttcattgggccaggcacaatggctcacgcctgtaatcccagcactttaggaagcagaggcaggcggatcacctgaggtctggagttcgagaccagcctggccaacatggtgaaaccccatttctactaaaaatgcaaaaattagctgggtgtagtggtgcatgcctgtaatcccagctactcagaaggctgagtcaggagaattgcttctaccaaaaaatacaatcccagagtgctgggattacaggcatgagccactgtgcctggcatataatggggttttgagctagatgaaatatagttctattgttcaatgttgtaccttccaagagagaagccctcccccttcctgtgattgctttgaacaaatttgttcaagagcaaatttgttataattgataattactctagacctgttgaaatatgttaatttttaggccaggcgcagtggctcacacctgtaatccgagcactttgggaggctgaggcgggtggatcacgaggtgaggagttcgagaccagccgggccaagatggtgaaaccccatctctaataaaaatacaaaaattagctgggtgtggtggcgggcacctgtaatcccagctactcgggaggctgaggcaggacaattgcttgaacctgggaggcggaggtggcagtaagccaagatcgcactactgcactccagtctgggagacagagcaagactctgtctgaaaaaaaaatttttttaaatgttaattttttcttacgttttctgctctatgtcttgtttccagttagaagcaaaccaaaactaaggccacaaaaatgtcattattctcccaaatgccatcttgcctaggttgatctcaaactcctgggctgaagtgatctgcccacctcggcctcccaaagtgctgagattatagacatgagttgccaaactggcccacacacttttaaacaaccagatctcgatgaactcagagtgagaactcacccattagcaacaggatggtaccaagctattcttgagggacctacccctgtgatcaaaataccttctaccaggccccaccttcaacactggagattacatttcgacatgagatttggagggaacaaatatccaaaccacatcaacgaggctagaacattttatactagaaagaaaggaagctatcaaagactcttctggaactgtgttaaagggcccagaaaccaatttgtgtacaccctccagggactttcagtggccaaagatgggataatctgagcattaaaaaagagtagtgattgggccgggcatggtggctcatgcctgtaattccagcactttgggaggctgaggcaggtagatcacgaggtcaagagaccaagaccatcctggtcaacatggtgaaacctcgtctctactaaaaatacaaaaatttgctgggcgtagtggcatgcacctgtagtcccagctactcaggaagctgaggcaggagaatcgcttgaacccggaagagggaggttgcagtgagctgagatcgcgccactgcactccagcctggtgacagagcgagaccctgtctcaaaaaaaaataaataaataaaataaaaataaatgaataaataaataaagagtagtgattgaaacatgttaaatacattaaaactcatgagtttttacaatactttaaaaatgtactgatcagckttagagattgctcagacactagtttttaaactgaaatttgaaatatatcattaaaataactatgtaataaaaacagccatgagcacaagaaaagatgggaaacgcaaatcgaaactggaatatgatgccgcttcacacctataaaaatggctataataaaaaagagaaaataacaaattttggaaaggttatagagaaatgagagccctcagacatgactggtgagaatgtaaaatagctcagccacattggaaaacagccttgcgttactcaaaaagttacacatagggttaccatatgcttcagcagttctactcctagaaagaatatacccaagagaattgaaaaatatgtccacacaggcggggcgtggtggctcatagtgaaactccatctctactaaaaatacaaaaattagttgggtgtggtagtgtgagcctgcaagcccagctactcaggaggctgaggcaggagaattgcttgaacctgggagccggaggttgcagtgagccaagatcgtgccactgcactccagcctgggcaatagagcgagactctgtctgaaaaaaaaaaaaatatatatatatatatatatatatctccacacaaaaacttgtacagtaatattggccaggtgcggtggttcatgcctgtaatcccagcactttgggaggccaaagtgggcagatcgcttgagctcaggagtttgagaccagcctgggcaatgtggcaaaaccccgtctctacaaaagattacaagaaggaattagtggggcatggtggccctcgcctattgtcccagttacttgggaggctgaggtgggaggatcacttgagccccagaggtcaagattgcagtgagccacgatggtgccactgccttcaagctgacaatgagaccctgtctcgaaaaaaaaaaaacaaaaaacaaaacaaaacaaaacaaaaaaaccttttacaggaatattaatagcaatattatttataatagtcaatagtgaaaacagcccaaattaccatcaaatgacgaatgggtaaataatagtgccactgcactcaagctgacaatgagaccctgtctcaaaaaaaaaaaaaaaccttgtacaggaatactaatagcaatattatttataatggtcaaaggtgaaaacaacccaaatggccatcaaatgatgaatgggtaaataagttgtggtatattcataaagtgaggctgggcgcagtggctcatgcctataatcccagcactttgggaggccaaggtgggcggatcagctgaggtcaggagttggagaccagccagaccaacatggagaaaccccgtctctactaaaaatacgaaatacaaaattagccgggcgtggtggcacatgcctgtaatcccagctactcgggaggctgaggcaggagaatcagttgaacccaggaggcggaggttgtggtgagcctagatcacaccattgcattccaccctgggcaacaagagcaaaactccatctcaaaacagaaaaaaaaagtgaaatattatttggtaataaaaagaaatggagtactgatacatgctgtaacatgaactttgaaaacattatgctaagtgagaaaagccagacacacactcacaaaacacatattgtatgaagccatttatatgaaatgttcagaatacaccaatccaaagagacagaaaagagataagtggctggcaagggctgagggaagtggggaatgaggggtgactgctaatggatatggggcttcctttggggagacagtctggaattagctggtcgtgatgattgtgccactctgaatattttaaaaattactcaattgtgcattttaagaggatgaattgtgaggtatgtgaattatacctcaataaagctgttactttattttgagactgagttttactcactctgtcacccaggctggagtgcagtggcacagtctcggctcactgcaaccacctcctcccagggttcaggagattctcctgtctcagcctcccaaatagctacgattacaggcacgcgccaccatgcccagctaatttttgtatttttaggagagacagggtttcaccatgttggccaggctggtcccgaactcctggactcaagtgatctgcccaccttggcctcccaaagtgctggggttacaggtgtgagccactgcacccagccaagctgttagcttttaaaaatcactttgtagaacttgtttgggtcctgatttaaaccaaccaattataaagacacgtaggagacagtctgggaagtctgaacactgaggattagacgatattaagaagttattactaattttgttttagatgtgatcgtggtgtcatggttatttacaaatgatctcttggggacacatcttaagtacttacagattaaaccatgtgatagctgacatttgcttctaaataatttagtctgggaggagcacagtatgtatggaaacaaggttggccacatactgatctttgttaaagatgggtgagaacaatgtgcccattcattatacttttctctctactgttgaatatggtttcaaattttcatgatgaaatgtttcaaaattatttttaagaaagaaaaccaaggacacaaaaaaggagaaaaaagcctgtcattaatcatctgttcaggccaggcatggtggcttatgcctgtaatcccagcactttgggaggccaaggcaggcggatcacgaggtcaggagatcaagaccaacctggctaacacagtgaaaccccgtctctactaaaaaaaatacaaaaagttagccaggcgtggtggcgggcgcctgtagtcccagctactcgggaggctgaggcaggagaatggcatgaacccgggaggcagagcttgcagtgagctgagattgcgccactgcactccagcctgggcaacagagcaagactctgtctcaaaaataataataataataataataatctgttcatttgcattcctaagagccatccttccagatcatctatttcccaaagttgatcccggccaggctgaattctcttcctctgggcttccccagcacgtggctcgttcttctagaagggtgtcaaagttactcgtatttctgtctgttgagtttcattttctgtttaaacatatatttataccatttcagtcctctaaaattctcagggctgactctttctaagtaaatacttttcttttggatagttgaggtttatctctttgagatgttaaatgttttaatattttggacaaaagtctttgtaaaataagttacatgacttttacctttctagtcaatatttatgaagctgacttaccctatatgagtttcaagaagttaatcattatgaaaattaatcttggcacttgccataatagtgtgattctcacacaggatattcaggaataaggctgtttgttccttataccaaatgaacccaggttgctttgtttgtttgaacatctcttgcttttgtgatattttggtcacttctcttgctggtactgccccttctttctgccctgagagtgccctccttgaccctttctgatttaccctacgtgtgaagaaaccagacaattaaacatattacagttatatgtagaatgactacactgcctggctacccaggacaatttcagtgtatacctattgtcccagtgtaattaataaatagcatccttaaaaaaaattcttgaatgtatcctagttggctttttctttctttttcttttttttagtggtgggatctcactctgttgccca

SEQ ID NO: 12185 - DNA, 22426 bp, Homo sapiens
  misc_feature (1)...(22426): n = A,T,C or G, or insertion/deletion polymorphism (see Tables 1-2)
ggagtgcagtggcacaatcatagctcactgtaacatcaaactcctcagctccagagatcctcttgcctcagcctcccgagtagctaggaatatgggcatgccactacacctggctcatttaaaaatttttttgtagagacggggtcttgctatgttgcccaggctggccttgaactcctggcttcaaaggatcctcctgccttggcctcccaaagtactgggattacacacgagtcactgcacttggccctaaatatagtttatttaaatgcaggtatatatgatttcatttttaataatgattatttttaacaactggctcacaaaattcttgaaaattaaaaattggctcttatgagctggtataagctggctctagcagagccctggacgtattgaaatatatcttagtaagcatgattcagtgtataattgttcatattcagtgcaagcaacaatggcatgtggcttggatgcaaacaaggaaatccaggggaattcctcaagctgacatgtctttttggatatttgttatatgattaagtcttggaattctgcctaagagcaatgctaagcaactaattaataaagttataataatacctagaccaggatgagaaatccaggctttcctctttttgtctgtactcttttctctttaccgctcccttgtttagccttgtattttattttctcccttccttttctctccatttctctcttgttctttgccttccatcctaattttctctatttgtgtttcccttgttctttctcttttttgcttttcccttttgatcctctcctcccagtgcttttctcttccatttctctctttcctctttaatttttctttcatatttatttgtcctccttttcttccccatgtcacttctaatagatacacatattccttctctgcccctaaagcctttgggataatttctgaggacgtgggttctaagtgatggctcttacaacaggaccattcccagagtgagcagggtcagttgagaggggaagtgggagcgggagtcaggggtagcacatgggaaaatgagagatgagaaatgtcaatatttggtatcattagggaaagtttcgtgggtgcattagagttcaagtttgttggctcattgtaggactgtcatttattaacctaaggctctagtcctgtttgtgtaatatggtagccactagccgtatgtggctatggaatgcttgaaaagtgacaaacctgaattgaaatgtgctgtaagtgtaaaacacacaccaaatttcaaagacattatataaaaaaagaatgtcaaatatcttgctagtaattttttatattgagtacttgcgaaataatattttaatgtggtgaattatataaaatatattattaaaattaatttcacctctttttgtctttttaatgtggttaccaaatctctccaaagtctttcaggttcctagcacgtatctaggatcattttattttattctttttcttttttctttttttttttttgagacgggctttgctcatgttgcccaggctggagtgcagtggcgcgatcttggttcactgcaacctccgcctcccagcttcaagcaattctgctgcctcagcttcccragtagctgggattacaggtgcatgccaccatgcctggctaattttttgtattttcagtagagacagggtttcaccatgttggccaggctggtctcaaactcctgacctcaggtgatccacccacctcggcctcccaaagtgctgggattacaggcatgagccgctgtgcccggccaggatcattttatttgtttgaactaaaatgttctccttatactcaaatgtagtaaatgaatgacaaatgatttaaattttctaaccatgtgagaattttattacttttcatttatttttcagaaataggattcagaaaaaaaaaaaagttgttactattttcacttactgataccagtaattaaagtaaaggagctttccccagctaacacgtgctccacactagaccctgaaccacccgcagtgctcttagggagaatgcaagcccaggccctttcttctacccgtgagcagctctaggtcatgtaactttcctacctgcctggatcagggaccaaggccctcttaaaggcaagaactataaaaatagactgggtgcggtggctcatacctgtaatcccagcactttgggaggccgaggtgagtgggtcacctgaggtcaggagttcaagaccagcctggccaagatggcaaaccccatctctactaaaaatacaaaacttagtcgagcatggtggcacatgcctgtgatcccagctatttgggaggctgaggcaggagaatcacttgaacccaggaggaggaggttgcagtgagctgagatcatgccactgcactccagcctgggcagcagagcaagactctatctcaaaataataataaaaataaaataagctagccgcctgtaaggtggtcatgaatcctctgcccaatagagacgctccatcttgcatagtgaggcaaagatctgatcagatttcccttcttgggggaagtattctcagagcgggcctcagcccttgactgtaagccatgagcctgggaaaaggctgtaggaagacacatatagaagcaaaggcagcaataaagagaagtggggaatagaaagagaagcagattgaggaagagtcaaagagaagtcaagtcatagctaaagtggagagcagcccaaccagacagcctgaccaccacggctgctctgggagtccccagaagccactgctccaggtctctagagggcctggctgtgctgctgtgtttccttacagcctctagtgtctttaaaataaacctccatccccttgtggtaacccaaggttctctgttcattgcaacatatatgaaggcagaatcacagctggcccacgtctggtatcagaggaagacataggagggaaatgtgtgtttgtgtgtttgtgtgtgtgcgtgcgtgtgtgtgcgcgtgcctgcgtgcatgcatgtgtgtaggggcagggggaagttttttaaaaaggaataaaaatattacatcttaaagttatcagcacatatggttctgagcatactattcttggttgctagttgtgaataaagatttaaacgttttagaaatctcaggtgaaggcagagagagtattacataacctcttgggcatctggagtcgtgaaaaaattgtgggctttggaaccagacttacttagttttgaatcttggctccctcccctattggatgatgaccttgtgcaagttttttgttctctctcaaccagtttttccatctggcgaatgggaataaagtatatgttctatgtagtttgtggtggtgattagccaatatcttgtgtgcaatactatctgcacttaggaagtaaatgcaagcttaatgatgatgattagatgacacaagcaacaactctacttggctcaacttgtttttggtaaacaaatgtaaaaacacttaaagaaaacttctccgttttctgacaataaagtatttaaacatgttggtctctggggaaaggaagaatatgtctttggacaacaaaaaccccaagtgattatttttccttgagagggcaatatacagtgtgagtgtgctgatcatagtaatttgagaatttctgaaatgaaaaagattttagagcttagttcatccaacaagctgggaatcccctctccaacgttcctgacgggtgttcctgtcttcctacgtttgtgtaatatagacatgtttgtatatgtttaggtgaggagcagagctggttttgttttgctgttgtttttctttttacagttatttatattttgtgtgatttccccctacaatatatgtggaaatacatggactacattttaaatttaaaaaccccaatatgatagttaaaaaatgtattttaagaacccacccactccccaattttataagacataaatctattataatcattcatgtttaaattgatcattcctcctgtagacaaatccatctggaaattttcttctttactcgtgatctccagcagtcacctaaatcttaagtcaagtatgaaaaaaacctcaaaaatgttgctttaaaaattgatccgtactttgcgatctacattttaaaaaataccatgcttattttaccacttcacttcaagaaaaggcctctaggtcagaggtctccaatctttttggcaccaggaccaatttcatggaagacagtttttccacagaccgggtttggagatggaggagagatggtttcgggatgattcaagcacattacatttattgtgcactttatttctattattatgacattgtaatatataatgaaataattatacaactcaccataatgtagaatcagtggaagccctgagcctgttttcctgcaactagatggtcccatctgacatgatgggaagcagtgacagatcatcagacattagattctcataaggagcacgcaacctagatccctcccatatgcagctcacagtagggtccaagctcctatgagaatctaatgctgccactgatatgacagggtgtggagctcaggtggtaatgcaagcgatggggagcgactgtaaatacagatgaagcttcatttgcttacccaccactcacctcctgctgtgtggctcggttcctaacaggccatgaactggtacctgtctgtggcccaggggttggggaccactgctctagataactcctttccaccctcttcctgcctgattgctgaaattatggagtcaccattcctactcctgcccatcatcacatgactgccccacccaactgatgaaagggataaccgacctgcaccttgaagaaaagcatcatcaaagagctctaagatgctgtggaaaaccagtatggtagttctgcaaaaaattaaacagaatggtcatacgatccgtgaattccacttctaggtatagactcaaaagaatgttaagtaccaacttaaatagatatttgtgcaccacgttcacagcagcattattcacaagagccaaaaggtgaaaactacccaaatgtccattgatggatgaatgaatgaacaaaatgtgggacgtacatacaacaaaatagtattcagccttaaaaaaggaaggaaagattctattattctatgtaataataatagaaatgatatggatgaaccttaaagacattatgctcaatgaaataagccagtcacaaaaaaccaaatatggtataactccacggacatgaggtacctagagtagtcaaattcacacagacagaaagtagaattatagtttccagggtctgagggaaggggaaaatgggaaattattttttaatggcatagaatttcagtttgggatgacgaaaaatctttggagatgggcagtggtggtggttgcacaacagtgtgaatgtacttaattaatgccactaaattgtacatttaaaaatgcttaaggtcaggcgcggtggctcacaccgtaatcctagcactttgggaggccgagacaggcagatcacttgagctcaggagttcaagaccagcctgggcaactggcgaaaccccgtctctacaaaaaatacaaaaaacttagccaggccagttggtgagcgcctgtagtcccagacatttgcgggactgagaagcccagcctcttgcgggctttagcgcaagaggtcaaggctgcagtgagcagtgatcacaccactgcactccagcctgggtgacaaagtgagaccctacctcaaaaaaaataaaaataaaaataaaaatagaaagatggtgagcatgataactcctatgttatgtgtatttgaccacaatttaaaaaagtgctaagattataatgaatatatataacatgcaataccagtagcatgcagaagagggcggatggggtttaagctttacagaaaacctcgattcaattccctcctgcagccaattctgaccgtgtcaacgaatcatccacgcacctgcagctctgctgagagagtgcaagccgtggggtaagaaccttagctttgtttgttgtaactctcattaaaaagatataagggctgcatgggtattttctaaaaaggagataatttgagctaatattgaggggagggaagtagggttatttagatttttagtatttactattttgtctagattaatgattagtgaccttggggctattgatctgaggaatttcttgcagatgcttgagagcgtgggtttcttttcactgattgcggatcaaacctggtcagctcttctattcagattgaacggtcctatgcactgtggcaagttttttctagctcttatttccccacagcgtatgttaacctctgctggatgaaacctttggctatttaaggcatatttgttgctcctttaccccgttgaaaagttctgcatttgtgttacctgtttaaaagtaggggcagatctgatggatcttgtacaatgcagttcttattccgtttccttcagaagtggacaaagagggccatatgtggttgctgtaaagaagaggatggttaacaacctgtgagcatttggtttcttgataagctttctcccagaccacctacaytgagctattaattaggaataggatgcacttcgagttttatttcaattcttgtgaacttataactttcctaagaatatatttatacatgtaggcaaagtctcttgaactttgtggcacctagcagagtgtcccacagcagctgcatgaagcttcatagacaggggcatggggtgagaaaggaggaagtggccgccatggcagctggtcagatcaatggattcaacctcagtgattcggtccttaggatgtcgttacatcttaagccacctcatttcaaggtttgaggtgccttgcatttgggtttagttaccatccagaaggaaccagacaggtctgggttcaaatctctgcttcttcagttggtcatcttgggcaagttactttacctctgggctttagctcctccatctgtaaaatatgaataataatggccgccattttgttgagtcattgagggattaaacaaggtaatggacataaaacacttagctccatgtcagacacgtaggaaatactgaaaagaagtcattcttactcttatgttgcaaagatcattcaacattcaataggttcttaatctcttttctatttctttatatcattgggaaaagataaattagatgattaaatattctttggtaaaacactagttgtcatttgatgatgtcttttgacttggacttttaaattataagatattaaagatgtattaaggaaggtcattctctgttttttacctgcttttaacgtagtagtagggatatgatattaacatatatatactatttatagactacatcaccaacatggtgaaaccccatctctactaaaaatacaaaaattagccgggtgtgatggcaggtgcctgtaatcccagctactcaggaggctgcggcaggagaatcgcttgaacctgggaggtggagcttgcagtgagctgagatcataccactttactccagcctgggcaacagagcgagactccatctcaaaaaaaaaaaaaagtgtatgtcctacttttaaaattgctttaatgaggccaagcacagtggctcacacctctaatcacacccatttgggaggctgaggtgggaagattgctggaggccaggagtttaagagcagccttggcaacatagtgagaccctgtctctatgtaaaagttgtttttataaaatgtcataatgcataagtattgcctgagagataggacctttactattgttatattaagagaagttcaaaaagagttcctctcccattgtagtcccagataagactgtggtattgggcagggggaagaagtgggtaagagatagaaactctgacttctcagcgcagagttccagctaaagcaactgggttagattctgctgcattcttaaggggccatggctctaagacctagaagcttaaagtcaattgctacaaattaagcactctatgagaggataacattaaaagcacctttgtcaacctaatgattataactgccagggtcctatcaagccataatagagcctgaggcaaaagaaacaatcagcaatactgatcctgtctttatgaaaaatttcgatattttgttcaacatagatttttgcattaattttcatttttaaaaatatttcatgtaaacattatcttgattactgagttccttgggacccccttaacatttatgccttccttgcttcacccgagtcttgacctgataactgccaccatttattaagtgtgatatgctaggcatggtactaagtgacttacatacattgtcttatgcctcttcacaagctccattttacagatgacaaaaccagatctttcagagattaaataaatggtccgagtacatagctaatgagtggatgaatggttaacattggatttgaacacagatccatcaatcactaaaaccaaacttattctttttttttttgaaactgagtcttgctctgttgcccaggctggagtgcagtggtggcatctcagctcactgcaacctccaccttttgggttcaagtgattatcctgcctcagcctcccgagtagctgggactacaggcacatgccaccacgctcagctaattttttgtatttttttagtagagacagggtttcaccatgttagccaggatggtcttgatctccttactttgtgatccacctgcctcagcctcccaaagtgctgggattacaggcctgagccaccgcgccaggcctaccaaactcattcttcaaccatcatgccctgcactgtatcaggaattcacaacataaattcattcattcaacacatatttatgagagcatattatgcatcacgttgtactaaggattaaaacgttgaaattcatacatacaaggattcattcattcatatgtgcattcaacaagcagtaatgagcaggcaccatgtgtcaagcactatgctacatgctgaggatacagaagtgaacaagacagacagctaccacgggaatgaacagagaagggacaggtgacaagcaaatgaatgaaagtttatttactaagaggtcattcagaagagatcatgaattcatggaaaattattttctgcatctagtggcatggaaattaagatattctgaattttaatgtatagttttaagaaaactgaaagaaaatataaagtttatcattatacattggatactatgaacacaataatttgagtagtaattacacttccaggccacagttgtaaactgattttctattagaaatatttaaaagtagatgtagaaaacttactcttaaatatataacagttcaaaaatccagcaggaactaagttaattaaatagaatattcacctgttttttctgayaattatcctgtgttatatttacatattaatgcagtataatattttagtatacattacactctagggagtcactgaaatgtcagcaaagaaaaatacggccggaggcatcttaagtcatttgaccacgtttttaaaagttggtgttttgagaaatcatctaaatgtggtgaccttaccaaaatgattgctttttctccaagatatttgagaacacttaccagaaacaatagtttatgaaatataaaaattatatgatcaatgtggataattaatatttttacaaaggaattctccaagtttacattgtaagggagttcacacaaagaaactatgatcatatgtgttcccaagataagagataagatgctctctctcctttactagtatcagcagctaatggaaaacttgggagtggccctctcactccctactctccataggttttctggaatttcttcacttcaagaaaaaaaccagacttgggaaggttctagagaaagagaaatacagatgagagagaggtaacattctaagtggccttatgttttgattctgccccacctttgttaccctgccatgtttgtgtgcattcctgtggatgggcgtgcccactgcctccctcacctcccatccaggctttcagaatgatgggaacatgacacgcacagagaattctctctaacccatcctctttctgttgagcatatcttttgctccctctgcttgtctatgggagtgacctgtctgagggaggttgagggtcaatgtgtaacagatacatacaaatggaagcagaaaaactcccccactaacttatcacctgctcttggtgccttcagagagcctggtgtggggacacgtagagttaaattgtttactaatttgaaattagaatctaaccacttctctccacttccattgatacattctctctggcacaagttacgctatagtgtcccaaggagtcttccctgccagccttgtggctcccagtcatttccacccaacaaacagaggaatctttttatttgtttgtttgtttatttatttatttatttattttatactgtaagttctggggtacatgtgcggaacgtgcatgtttgttacataggtatacacatgccatggtggtttgctgcacccatcagcccatcatctacattaggtatttctcctaatgctattcctcccctagccccccaccccctgacaggccccggtgtgtgtcaatgtgttctcattgttcaactcccagttatgagtgagaacatgtggtgtttggttttctgttcttgtattagtttgctgagaatgatggtttccagattcatccatgtccctgcaaaggacatgaacacattcttttttatggctgcatagtattccatggtgtatatgtgccatattttctttatccagtctatcattgatgggcatttgggttggttccaagtctttgctgttgtgaatagtgctgcaataaacacgtgtgtgcatgtatctttatagtagaatgatttataatcctttggatagatacccagtaatggcattgcaggatcaaatagtatttctagttctagatccttgaggaatcgccacattgtcttccacaattgttgagctaatttacacccccaccaacagtgtaaaagcgttcctatttctctacaccctctccagcacctgttgtctcctgactttttaatgatcaccattctaacaggcatgagatggtatctcattgtggttttgatttgcatttctctaatgaccagtgatcatgagctttttttcatatgtttgttggctgcataaatgtcttcttttgagaagtgcctgttcatatccttcacccactttttgatggggttgtttttttcttgtaaattttttaatgttctttatagattctgggtattagccctttgtcagatggacagattgcaaaaattttctcccattctataggttgcctcaaacagaggaatctttaaaatgtatgtcagaacctgtcattcctggactctaaatcttctgctggtttcttatttcagtcagaggaaaattgccaagttcttataagatccgacctcttctctgattccgtcccctaactccactccaggtcttcctcacattttccaagcacatcaggatctttaaatttgtacttgctgttctctctctctccaaaatactctttccccagacaacaagtgtcttgcttctttggcccctttagatttctgcatgaagatcactatcagggaggccatttttgatcattctataaaaaagaaaatcactccccagtctctctctgtttcccttatcttagttatttttccttcaagacaatatcactgcctgatattggtccccacccaaatctcatcttgaactgtagctcccataattcccacatgttgtgggagggacctggtgggaagtaattgaatcatgggggcgggtctttcccatgctgttctcatgatagtgaataagtctcatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaatcctgtggttttataaagaggaggttccctgcacatgctctcttgcctgctgccacataagacatgactttgctcctcattcgccttccaccatgattgtgaggcctccccaggcatgtggaattgtgagtcataacatataaacgtattgttttgtttgcagtctctcttttcttaacttctttctagaatataagctatgtagaaacagaaatctcttctgttcactgctacttccccagtgcctagaaaagtttctggcagaataggtacttaataaatatcttgaataatgaatatcgtaaaatcttagtactccaactacctctgttctacgtctaatccaaccacgtgaagcctggcacatctcccaaagtcctcagaattctatatccttcaatttcctcatctatcaaatgggagtagtagtacttccctcacagagtatggtgataaataaatgagataatatacatgaagcaattagtatgtatcttggcacattgaaatctaacctgaaagctttgattctatgccataacagaattcagcagctgaatatcaagacctttgaattcaacaagaagttaagacatttatagttgtctaacaacagactgaagattgtggcttggtattcactggcaggtttcagacatttagatctttcttttaatgactaacaccatgcctatctgtggagaagctggcaacatgtcacacctggaaattgtttttcaacattaatactattatttggcagtaatccagattgcttttgccaccaacctgaagacatatagaggcagaaggacaggaataattctatttgtttcctgttttgaaacttccatctgtaaggtaagtgttgaaagtcagatattggctccagggactttctatatccacaaatacaaaaattgaggggtaactccttgatatcaagtcaaaggctcacaatgtctggtaataaaacaaattactttcaattttcttgaaatcttcaggctatcaaaaggagatgtgagagagggtmttgagtctggcctgacaatgcagttcttaaaccaaaggtccattatgcttctcctctctgagaatcctgacttacctcaacaacggagacatggcacagtagccagcttggagacttctcagccaatgctctgagatcaagtcgaagacccaatatacaggttggaaccttactccaacctcttgatgaatgtagtcagatgttggcattttttttgcaaataaaaatcctacaggatttaacaaaccaaataaaaatctaatattatatacttttttttagggttttgagctcatcttcatcattcatatgaggaaataagtggtaaaatccttggaaatacaatgagactcatcagaaacatttacatattttgtagtattgttatgacagcagagggtgatgctccagagctgccagaagaaagggaactgatgaccaactgctccaacatgtctctaagaaaggttcccgcagacttgaccccagccacaacracactggatttatcctataacctcctttttcaactccagagttcagattttcattctgtctccaaactgagagttttgattctatgccataacagaattcaacagctggatctcaaracctttgaattcaacaaggagttaagatatttagatttgtctaataacagactgaagagtgtaacttggtatttactggcaggtctcaggtatttagatctttcttttaatgactttgacaccatgcctatctgtgaggaagctggcaacatgtcacacctggaaatcctaggtttgagtggggcaaaaatacaaaaatcagatttccagaaaattkctcatctgcatctaaatactgtcttcttaggattcagaactcttcctcattatgaagaaggtagcctgcccatcttaaacacaacaaaactgcacattgttttaccaatggacacaaatttctgggttcttttgcgtgatggaatcaagacttcaaaaatattagaaatgacaaatatagatggcaaaagccaatttgtaagttatgaaatgcaacgaaatcttagtttagaamatgctaagacatcggttctattgcttaataaagttgatttactctgggacgaccttttccttatcttacaatttgtttggcatacatcagtggaacactttcagatccgaaatgtgacttttggtggtaaggcttatcttgaccacaattcatttgactactcaaatactrtaatgagaactataaarttggagcatgtacatttcagagtgttttacattcaacaggataaaatctatttgcttttgaccaaaayggacatagaaaacctgacaatatcaaatgcacaaatgccacacatgcttttccckaattatcctacgaaattccaatatttaaattttgccaataatatcttaacagacgagttgtttaaaagaactmtcyaactgcctcacttgaaaactctcattttgaatgrcaataaactggagacactttctttagtaagttgctttgctaacaacacacccttggaacacttggatctgagtcaaaatctattacaacataaaaatgatgaaaattgctcatggccagaaactgtggtcaatatgaatcygtcatacaataaattgtctgattctgtcttcaggtgcttgcccaaaagtattcaaatacttgacctaaataataaccaaatccaaactgtacctaaagagactattcatctgatggccttacgagaactaaataytgcatttaattttctaactgatctccctggatgcagtcatttcagtagactttcagttctgaacattgaaatgaacttcattctcagcccatctctggattttgttcagagctgccaggaagttaaaactctaaatgcgggaagaaatccattccggtgtacctgtgaattaaaaaatttcattcagcttgaaacatattcagaggtcatgatggttggatggtcagattcatacacctgtgaataccctttaaacctaaggggaactaggttaaaagacgttcatctccacgaattatcttgcaacacagctctgttgattgtcaccattgtggttattatgctagttctggggttggctgtggccttctgctgtctccactttgatctgccctggtatctcaggatgctaggtcaatgcacacaaacatggcacagggttaggaaaacaacccaagaacaactcaagagaaatgtccgattccacgcatttatttcatacagtgaacatgattctctgtgggtgaagaatgaattgatccccaatctagagaaggaagatggttctatcttgatttgcctttatgaaagctactttgaccctggcaaaagcattagtgaaaatattgtaagcttcattgagaaaagctataagtccatctttgttttgtctcccaactttgtccagaatgagtggtgccattatgaattctactttgcccaccacaatctcttccatgaaaattctgatcayataattcttatcttactggaacccattccattctattgcattcccaccaggtatcataaactgaaagctctcctggaaaaaaaagcatacttggaatggcccaaggataggcgtaaatgtgggcttttctgggcaaaccttcgagctgctrttaatgttaatgtattagccaccagagaaatgtatgaactgcagacattcacagagttaaatgaagagtctcraggttctacaatctctctgatgagaacagaytgtctataaaatcccacagtccttgggaagttggggaccacatacactgttgggatgtacattgatacaacctttatgatggcaatttgacaatatttattaaaataaaaaatggttattcccttcatatcagtttctagaaggatttctaagaatgtatcctatagaaacaccttcacaagtttataagggcttatggaaaaaggtgttcatcccaggattgtttataatcatgaaaaatgtggccaggtgcagtggctcactcttgtaatcccagcactatgggaggccaaggtgggtgacccacgaggtcaagagatggagaccatcctggccaacatggtgaaaccctgtctctactaaaaatacaaaaattagctgggcgtgatggtgcacgcctgtagtcccagctacttgggaggctgaggcaggagaatcgcttgaacccgggaggtggcagttgcagtgagctgagatcgagccactgcactccagcctggtgacagagcgagactccatctcaaaaaaaagaaaaaaaaaaaagaaaaaaatggaaaacatcctcatggccacaaaataaggtctaattcrataaattatagtacattaatgtaatataatattacatgccamtaaaaagaataaggtagctgtatatttcctggtatggaaaaaacatattaatatgttataaactattaggttggtgcaaaactaattgtggtttttgccattgaaatggcattgaaataaaagtgtaaagaaatctataccagatgtagtaacagtggtttgggtctgggaggttggattacagggagcatttgatttctatgttgtgtatttctataatgtttgaattgtttagaatgaatctgtatttcttttataagtagaaaaaaaataaagatagtttttacagcctacacatcctactcatttggcttgattcttctttctggtctcacaggtcacaggaagaaaagcactcctgaaatataatttttgcaaaattatatttcaaaaatgacaattttgcaaaattatatttcaaaaacaaacatcatgtcacttctctggttagaaaaaaattttgtggcttaaacacatgattcagggagagaatgtcatgctcctttaagatctgacagcaatctccttttatatccttgcatcttctttatttttaatttttagagactagctcttgctctgtcacccaggctggaatgcagtggtgcgatcatagctcactgcagtattgagctcctggcctcaaatgatcctcctgtcttggactcccgaagtgctgggattacaggtgtgagccaccacacccagcccctccttgcatcctatcattgggccctatggagctactggcccttccccagaactttcagtgttctttcatggctccagagcccagatttcacatcatgcctgctgtaatgccttccctacttgggtttgttcaggaaatcttacagttctctcaggacacaatccacatatcgactcttctttgaaatcatcctcactctttcccgtaagcatgatgcttcttgattctcttccacactttggacatatttctatcaccaacctaattatgtacatttttaaagtttcaatttcccactagactatgaactcctcaaaggctaagacagacttacatctgcccttgtgtctgcagcagtccctggttcagaactggtgctcaaagaatgtttatggaatggatgttgggttggctagaggagcttagtgggaactcaactggcttaaggatagatggtggaatttaaaggcatattctgagaagctcaggaagagcaggaataggtaaaactcaggtaagaagacagagaatccagaattgtaggattcctaagtagagctcacgtcatgtgaaattgccaaaatttggttgctctcgacctagaaaagcatctacttttaaaaatctcattccatctgtattagggttctctagagggacagaactaataggatatatatatatatatatatatcacacaatactatatctatatctatatctatatctatatatatatattgcaaggtctattgtgggaccttgtaattgtgtgggtcaacactccttaataaactcctatatatataggaggtacatatatatataaaataggatattacatataggatatatatataaaataggatatatatataaaataggatatatatataataggatatatataggagctatataggatatatatacaaatatatataaagtatatataaatatatatactttatatatataataggatattatatatatataggatatatataataggatattatatatatataggatatatataataggatattatatatataggatatatataataggagatatatatataataggagatatatatatataataggagatatatatatatatgagcttattaaggagtattgacacacacaattacaaggtcccacggtagaccatctgcaagctgaggagcaaggaagccagtccaagtcccaaagctgaagaacttggagtgcaatgtttgagggcaggaagcatccagcatgggtgaaagatgtaggctgggaggctagcccagtcaagtttcgtcatgttcttctgcctccttttattctagctatgctggcagctgattagatggtgccctcccagattaagggtgggtctgcctttcccattccactgactcaaatgttaatctccttggcaacatcctcacagacacacccaggaacaatactttgcatccttcaatccaatcaagttgacactcaatattagccatcacaccatctactaagactaatctcctaaacaagttaaaaccggattctgcatctaattcattttcttatagtttgtatcttatgaattcctcatgctagtgattattttaaaaattgtactcaagaaggccaacccgagagtacagggagggcactgggtgtcaatctagaagccaggccatgctaccatttagccagtagctggagttgaggagctagagtctagcagcttgggggctgagcatctctctttctcttccctggtgagcccatggtctgtctggcagaaggggaaacccaaggaaaccacagtggaatggagacaaagcatggggaaggtgccttcctgggcaggacactgatgtaaatgtgattcttggcttctggaggagtgagaccgattctgcacaagggttggtaaatcttgagtaaattattcagaatgagactttcacctttaattagttaatgaattcacctttaattatttaatgaattcacctttgattaattaatccagctttaattcacatttaattaattaacttggaacacacgaagaatgtaagattagccctaaagtcaccaggatttagttatttcatgctagaaccctcagtttagcaataccatttacaaaacagatgtgttttattacaagtttaaaaataacacattaggctgagctctcagcaacttcacagctggacaatccttaaatcttacctatcaaatcattttgctgttcctgtctcagaaacttaaataccatccaacatttcctaatatgcttggttttgactgttatgaattacaatcagaaaaaataaattttacatgagttgaacgttatttgcttttgaggcttgaaatacaagtaacacctagcctcatacaaacctgatgatatacttttacccaagaaatttcagatttcaacaaagacccactgttctgaatcatgacattgatgcggaagtgagcatacccaggctgaatgctgtaacagcagccggtgtcatgaactccgatcatgttttaaaaatgactctggagcttgtaagttcctttttatttccttgccatttgtcaacctggagcttgtttcatttttttccccgaggaaactgaactcttaagtgaagtctgtctgtgtattcctcagggggctttcacaatctcttagcatctctacagataaattgcaatcctttctggacgtcaacagttgagttgttgagaatggtctgtattctctcagcaaatgtggcaaagagagctgtactgaaatggaattgcagtccttgaattcccaacagattagtgggaagaaggaattttacatctaaattttggcaaatgttccccaaagttcactcctttatctattatgatgaaccattcaagagaagcatagactaggcatattaaaagtgggtgagaatttggagattgtcaagtataactctcactttcaaatggggaaattgaggctttagaattttaaatggcccacccaagcccaaggtcatagtcttttaactcctaatgtttttccttccaatccacaaccaagtggcctttactttttgcatttgatttttattctctcattccttctattgcaattctcaagaacagagccctggatggggcactttgattatcccgtctatattccccaaagtcatttgaggtctaggctttctctgcagtcttcctccatggccaaagcatcctgtatttgccacctgattctatccccgaaaaaaacattcttttgccatcggtaacttgcaatgggggctgctcctcagatcagccacccctggtctaggagccagaaaatgttctctatgtaaaggatggggaataatggggagcctgttctcccctggaggtttcaaaggcaacttaatcaccagcatcctgctggggatacataccttggtccctgagctcaattttccacctggtgtgctgtgacccatgacttgctgctgccattgatccttttaaccctggacagggctccttgaggacccacttgagatagggagtgggtctggtagtgcatcctgaagtcctgccaggggacaagcacaatgaaaaactcctgactgtgggtctggaagtygcctacacctgtacatctattcaacagccagctgctgagacactgccctccttcacagatgggggctctgagctgctggacaacactgcgttctggatgttcaaggacaaagttgcagccaacagtaggggtgttcaggattatggttagggaagctgggtgggggatcctggctagcacaactcccgacagcagcccatgtctgcctcttcacaatgagattcttgtcttcagaatctgtcttgttagtggtgtccaagcagcctcaagggtaactattaatactctaacaacacatgcacattctagtcattattttgaaatacttaatgaaaagccagtggagtgaactctaaatcaattcacattttccccaagacgtttatttcagtattctttttgcccttcaaatctttgctccaatcccatttccgttgaagacttcctggatgacctagtagaaaatggcagcactctttgtccaccttccttgctttttatttctccatagcatttgccatcttctaagtttacttctaagttttctctttatcctgctgattccctgtcttcccccactagaatgcaaactcttttagagcagaaatttttttctgttttgctcacagatattgtctctatctctgcctagaacagtgcctggcacaggtccactccccagggattttctttctgtgttgattttattttctttgttgattggcctcctctgctcctctgaagtccagcagggcctctgttgccaaggctgcccccttcagtgtcagcgcttattgttggaaatcaaggatacagattttacttgtaagggggtgtattagtccattttcatgttgctgataaagacatacccaagactgggtaatttataaagaaaaagaggtttaatggactcactgttccatgtgcctggggagggctcacaatcatggcagaaggtgaaaggcacattttacatggtggcagacaagagcaaatgagagccaagcaaaaagggaaaccccgtataaaaccatcagatcttgtgagacttactcactaccatgagaacagtatgggagaaactgcccccatgattcaatcatctcctactgggtctctcccacaacatgtgggaattataggagctacaattcaagatgagatttgggtggggacacagccaaatcatatcgggggcatccctcaccatctgtatttttgctgacactttctaggacctgccatcactggcttattgcttcccccaaccaccccacacttcatgaatcttctctttgcctcctcctattggaagctgctggatctcaggtgcttgctgtgggcagccctttaactattttggagtctgcagattatatgaatcactgcaaatggggtacctggttcccccacccccaaccacttcccctgttcttttgctgtctcagcctttttagaggggaaggggcagcactgggccaatgaagcccctgccgtgagcccacgcctcagatctcccctt

SEQ ID NO: 12186 - DNA, 30759 bp, Homo sapiens
ataaatgacagaattttattattttttatggttaaatagtgtacctttgtgtatgtatgccacattttctttaccattttctgttgatgaacacttagattggttccatatgttagctattgcaaatagtactataataaatataggagtgcagataggagttcaacacactgatttcctttcctttggatatacagctagtagtgggattgctggatcacttgaatgctgatatgcataagaggatctacactggagaaaaaccatggaagtgtggagattgtggtacatgcttcagtcagggctcacatcttcaaattcagtgtctgttctgtagagaaaccttaataatgtgatatatgtgacagcaaagagttataagatatgaatatgttaattttagtagatacttccgaaaagtatttcaaactggttgtaccactataaactctgaccattattaggcaagaattggctttttttttttttttcttttgagacagtcttgctctgtcacccagactggcatgcagtggaatgatcacggctccctgcagccttgacctcccaggctcaagaaatccttctgcctcagcccctcaaaagctgggactataggcatgcaacaacacgcctggctaaatttttgttgtagagatggggtctcactatgttgcccaaattggtctcaaactcctgggctcaagcgattctccctcctcagccttccaaagtgctgggattacaggcctgagccatgcgcacagcattttgttttgttttgttttgtttttgagatggggtctctcggtgttgcccaggctggattgcttattcacagatgcagttacagtgccctatagcctcgaactcctgggcctaagtgatcctcttgcttcaatcccctgagaagctgggactacaggcatggaccaccacccctgattgatcttctttagtttctataacaaaatagtacactgtttccacaaacttgggaaggctagtatttgggggtggggggcgtggaaatcactaaacaacaaagaaaatctgatgaattggacagcataaaaatattggcataaagatgaacataacataagcaggaatatttaaagcacatactttttatagagtgtctcccctgtaatgtctctggttaaatgaaagggtttcaaatgtgaagacaaccctaaccatactcattatctgtaaaagatgtagcattgtcatggactccttaataaacgtgaagactttaatccatctgaaggtgcatcacatttctgaagtttccaacactgacaaggtgatgggcttatggatgaaaactcatgaatgggaaaaactcagctatcgttaaagcccatatattttattaaagatattggggctgtctcctaaatctagttagtgatgaatttcaagtctagagccatcaccgaatccttgtccacattcattacacataggttttctgagaaaattgtctgctggttatgagaggtcttctcccgtgccaaagtgagtataataaccttgcttttggccaggtgcggtggctcacacctgtaatcccagcgctttgggaggccgaggtgggcagagtgcctgaggtcaggagtttgagactagtctggccaacatggtgaaaacccatcactattaaaaatacaaaacaattagctgggtgtggtggtggcgtgtgcctgtaatcccagctactcaggaggctgaggcaagggaattgcttgaaccagggaggtggaggttgcggtgagccgagatcacgccactgcactccagcctgagtgacagagtgagactccatctcaaaaaaataaaaataaaaataaaagtaaacaagcttgctttcttttatgtgctccttgattttgatggtgatgtgaaatcaaactgaagctgaaaatacaataatcacatttatacagggcatttttcaaggaaatttattgatttttactttaataatttagtgcctcacttttgtaagtctcttgtaagtggccaggcatggtggctcacacctgtaattccagcactttgggaggctgaggcagaaggatcaattgaatctaagagtttgagaccagctttttacagagtgtctcccctataatgtctctggttaaatgaaagattttcaactgtgaagacaaccctaaccatactcatattctagttcctttgcctttccatataaattttagaataattttatatctacaaaatatcttgctggaattttgatagtaattattttaaccctgtgtatcaatttggggagaatgaacatttttgctatattgagtcccacgatcctcaaacatggaatgtgtctccattcatttaatattgttggattttcttcatcagtgtgttgtaattttcatcttacaacccttgtacatcttttgtcaaacttccatctaggtatgaactttgatttccgtgtgttcattgctagtataatatatataaattaattttggtatcctgatcatgtatcctatgatcatgctgaattcgcttattgtctaggcattcatggattggaagacttcacatttttgtgatgacagtactacccaaaccaatctacagttttactgcaatcactatcaaaatccaaacagccttttttttttttgcagaaatcaattcataaattcatatgtaattgtaatggaggcaaatagacaaaatctttcttttttaaaggaacatgatggatggctcccacttcatttcgaaacttactaccaagctatagtaatggaatagaatttagagtccataaagaaactcatacatctaaagtcacttgattttcaagaaggatccaagattgcttaatggagaaagcatagtctcttcagcaaataatgctgggcaaatatatatacatatgcaacataatgaagttagatccgcacttcacactatacttaaaaattaactcaaaatgatcaatgacctaaatataagaggttaagctatacaactcttagaataaaacataaaggttaatcttcaagactttttatttggaatggattcttagataagacaccatatgcacaagctaaaaaaaccccacataaattggactagagcaaaaaaaaaaatgctatgcatacagagacattgtcaagagcatgaattcttctagtatcagaatatataaagaactcttagaccaggtgaggtggctctcacctataatcccagcactttggaaggctgagatgggtggatcacttgagcccaggagtttgaggcctgcctgggcaacatggcgaaaaccatgtctctacaagaaacaaacaaacaaacaaaaaacaacaacaaaaaacaaaggtagccaggcatagtgacccatgcctgtggtcccagctactcaggaggctgaggcagaaggattgtttgagcctgggaggtcaaggctgcagtggggcgtgatgtaccattgcactccagcctgggcaacaaagagagactctgtttcttaaaaagaaaagaaagaaagaactcttacaactcaataacaagaggagaaaccacccaattttctaatgggcaaagatacaaatagaaatttcagatatacaagttaccaacaattatgtgaaaagatgctcaactattagtcattaggaaaatgcaaatcaaaccaataatgagatgccattttacaacagctatgttagctatcatctttaaaaatagaaaatagccgatgtggtggcaggcacctgcagtcccagctacttgggaggctgaagtaggaggatcgcttgagcccaggagttttgaggtgtagtgagctatgcccactgggtgtccacactaagtcgacatcaacatggtgatctcccaggagcagaggactaccaggttgcctcaggagaggtaaactggcccagggtggaaacacagcaggtcagaactcccatgctgatcagtagtgagatgttgtctgtgaatagccactgcaattctgcctgcacaacgcagggagaccccgttttcaatttatacacacacacatatacatatacatatatattttatacatacatatatacaaaataagtattggagaggatgtggagaaattactaccctcacacactgaaggtgggaatgtaaaaatggtgcagttgctgtggaaaattgtttcgtggttcccaacatagaattaccatatgaatcactaaatttcatatctaggtatataccccaaagaattgaaagtaggtgatgaaacaaatacttgtacaccactgtttgtagcaacactattgactacagccaaaaggtggaaagaacccaaatgtccctcaatcaatgaatggataaacaaattgtggcgcaagcctgtaatcccagcactttgggaggctgaggtgggcggatcacctgaggtaaggagttcgagaccagcctgactaacctggtgaaaccctgtctctactaaatacaaaaaaattagctgggtgtggtggcgcatggctgtaatgccagctacttgggaggctgaggcagaagaatcgttttaacccaggaggcgggggttgcagtgagctgagatcgtgccattgcactccagcctgggcatcaagagggaaaccccacctcaaaacaaaacaagacaaagcaaacaaaaaaaacaaatcgtagtagaaacataaaatattatgaagtactggtacatgctgtgatgtggatgaactttaaaagcagtatgctggcagggcgcggtggctcacgcctgtaatcccagcactttgggaggccgaggcgggaggatcacgaggtcaagagatcgagaccatcctggctaacacggtgaaaccccgtctctactaaaaatacagaaaaattagccaggcgtggtggcacgcgcctgtagtcccagctactcgggaggctgagacaggagaatcgcttgaacccgggaggcggaggttgcagtgagctaagatcgtgccactgcactccagcctggcactttttttgagattccgtctcaaaaaaaaaaaaaagaagcaggatgctaagtgaaaggtgtcagaaacaaaaggttccataatgtataattccatttatatgaaatgtccacaataggtaattcaataggacagagattagtgttagacagtgactgcttagtgggtatggggtttttggggtgatgaaaatgtttcctaactttttatttgtactacatatatcctaaaatggtgaatttcacgttttgtgcattacacctcaatagagatgttttaaataataaaatacattaaaatgttttgcatagataaaacaataaaaaaaaacgtttttgttgagaaaatatttgcgagataaaatgttaatatcatgaatataagaacagtgcttgaaaagtgagggataaaaccaaaaactcaataagaaagtgggcaaaacatctggacaatttacaaaaaatgtaataatgacacctgaaaatatgcaagaatatgccatctttacaagagttataaattaaaactacatgccatttcttaccactggcaaaacttatttgaagagtgtatcatctcgcttgttccctttccagtaacactcctgtcctcactagaggggtttagacttcaggaattcctttctatacggtattttctcttaggcacccagggagagggaaggacgactctcagggtagaagtccacatttcccaacaggcgctcgggggtacgagattcgttccccgtgggaagagtggtcaagggcttcccagtagtcgtcaacacttccctttgagtgtaatgctgcaggagtacagtccagaccctcagtggaatcgcggtcggtttagctccggcagttgggtcccagggaattctgggaagtgtagtccagacgctcagtggagtcgcggtcagtttggctccggctggcgggtcccggggaattctgggaagtggagtccaaacattcggtggagtcgcggacacttccgctcggggactgaggttgctgcagtttttccgcgatagtttggggcagttccgcgcgttgcaggcccttctgaatttcctggacctacgcattggatcctcaaagaactggtgatcgaattaggggaaaaggggcctcgtcggagagtagaggtttggaggggcaagggccgctgtttgcgttctcgtccgtggcaccttcttgggcttgggtctgtcctcgcttcccgggggcattggtacttggttgggtcgcgtctcacctggtttcagggtttccggggctctgagctcgcccactccgccccctgcaccccacgcgcgtggccacttcttckcgatataacgttggggtgttaatctccttgggtttcccgttactgttctttaaaatggggactttagggccatcctaatggaatcgttttgggaactggaagaggtaacacaaatgagagccttaaagcagtccctgtcacttggtgactggtggtctcttgttaatttcccacgaaggaccgggtggggtcagagctccagctgcaggggcctcggcccttctccctgatccctgcaggacgctggatgatcccggaagccttctgacctctttttaggagagcgagggttgcgtccactttcatgaagggaaaggagcatttaacttttatgggggacggcgacgcggtcaaggtgtttcacagctttctcgttccccaacccgacctttccagaagagctgcagggagggacttcttggcttctgagggcaaagctctacgtgagtggtccttggctctttgaccgagatgctcaccccaaccgagagtgtataggttgtgtcctcgggcatgggggtcgataataattaagtcttaattagtaacttcattctaagggctttatacaaataaatttacgccacaccgtggctctgtggagaagtattgcttttttctattttaaaaacgaaagtgagacacagagcgcataggcacccgactagtgagaggtggagctggggttggaacctaagcagtctgggtcagagcctgatttgatcttctcttgggatacgttgtcaytgaggcagaggaactagttggacttaggtggggaaagcaagacttaggggcttgaaattttctgagtttctaaaaatgttgtcaactattttgtttcaatcattacaaatattttgtattcttatagaaccatgtcattgtacagcattctatttttctttattaagaacaaaatgggcctggcgcggtggcttacgcctgtaatcccagcactttgggaggtccaggcgggcggatcacgaggtcaggagttcgagaccagcctggccaacatggtgaaaccgcatctctactaaaaaataattacaaaaattagctgggcgtggtggtgggcgcctgtaatcccatctactcgggagggtgaggcaggagaatcgtttgaatctgggaggcggaggttgcagtgagcggagatctgccattgcactccagtctgggcgacagtgcgagactccgtctcaaaaaaaaaaaaaaaagaacaaaatgtttttattacctacgaatccatgaagtaaaggtagcaactgttaagctcgtaatgtgtttctttctttttgtatatttataggtttatttatgaacatttacaaatttttataatttttttcttaatatttcccycttatgtgtttaactatggaaatttccaaatgctgacagactaaactagtgaattatcrtgttatatcatactcattaatctcattattgttattatttttcctatgactgtttcctaaaattataaaactttttattttyatgtcatttgaaacctatagaaaagttgcaaaagtagcctaagaaattcttatttactctttacccacgtttgccaagtgtttacatttttcctgtttgttttgttgatgaccatcagctgaataccactagaaacatacctgtaaccagagacagctgattatagctttctgcagcaaggaagcccacgtaccaggggctgtcttggtaagtagaatttaggaagacctagtatatggtttcacataacatattagataatttcagattgtataccagataatgttatttattaaatattagatatctatccaaagactgctaatagtagtttattgtattatctattatacagtgctagataacatattacctaacttcatgttatgtactctgcagttctatatttaaatttgttctatttttcacttaaggttcttacaagtgtcccctacccatctgccaccaccacctgtgttcacagtctaattttatgcattgcctttaattgtcacatttccataatctttaatcttgaggattctacaccctttgtctttctatgcttgatatttttgaagagtataggcaagttattttggagaaaggcattcatttggagttgtgtctgatgtaattcatgtgcgggttcacattatgcattgttggtagggataccacagaagtggtgaattgcgggttcagattatgcattgttggtagggataccacagaagtgctgaaatgtccttttcattgcaacataacagggtccaagtgatgtcagtttgtctcttcattggtgatctcaaccttgtccacttggccgagacgctgtctttcagatttctccactataaagttacttaaaaaaaattgaaaagaataaagtttcttaggaatagataacattattagtgggcattcagctgtaaaatgaccttctccatttattctttgttcaactacaaatattctatcaatatggccttagaattgactcttaagttagataacgtgtacattaacaattattttttccaacctattgtatcatataacttacttatatcaggtgtacatccagtgatcattagacagtttgctgaatggagtaaccatcaccacaattcggtgatcatttcatgctcatattgatttcctcctgcctacttatggttagacttcattctcactcagatctgaagcaatcactaatcagttttctctatgcattttcctacccagacattttatagaaatggaatcctgcaatatgtggtcttttttaactggcttctttcatttagcaataatgtttcaaaggttcatgtatgttgtagcatgagtcagtacttcatttctttaaatttccaagtaagattccattgtatggatagaccatgatttgtctattcatttacccacaggagggcattttggttgtgccgttttgggtttttatgattaatgctgctgtgaacagtcatgtgccaattcacaatacacatccctgttggtgggtggcatccctggccascttttcatgtctctttttctgcctttcctggcactttgcaggcacaattctgctttcccaggaactgcatcactcaggactctgcaagtttccagaagtaagagggaaaatgaccacrttcaaggtgggtaggacttgcttctattactcttaaaattccctctcagtacttaaattgtcacaagttttcctctgtcttgggaagactcaaggagaaaaacagacatttgaggatctcttgtgtaccatgtacttcctttgttacttttgagtggattttgcatttgtttttactacttgttttcttctatcrtttattctatggagtagacaagattgtaggaatggataattatttcattatactacttctctgctcacacattagctatttttatcctgtgatactcttcctcatgtgcattcataactgtatttgtattggtgatgttaatctaatttaaattgcactctttgtatttaatattatataatgttcatttttaatggttgcaccatattcccatttaatcgatgttcctttttaattactttatacttccagacaccaggaactcagttttgaaaggctacttttgatgtgtgccacgttggctgttttgtagatagagtatccatatgtggcacatcatggcaggctgtaactgtggcttcacacaaggattgctggaagtttccacacaggaagagctagattctctttcccccatgcctgagtcatgccttctatgtcttttacttactggcctttctttactcctttatatactaaggaatttgaccaaagtaatatgtaagctaatttttttttttttgagatggagtttcactcttgttgcccaggctggagtgcaatggtgcgatctcggctcactgcagcctctgcctcccaggttcgagggattctcctgtctcagcctcctgagtggctggggttacaggcatgcgtcaccatgcctaattttgtatttttagtagagacagggtttctccatgttggtcaggctggtctcgaactccygacctcaggtgatccacctgcctcggccttccraagtgctggaattacaggcgtgagccaccgcgcccagcctaacctaaattttttgtgcatgatactagaaaatttgccagtcacttgtgttttgtttcttcatttactcctcagaacagctgaatgaggctgttcttatcttcctcttaaacacatgaaatatgagaaacctgctcaggttcagacaggagaccaagggtccagaatattagttattttagcctttttactcagttgaaagagagagaaaaagaaagagagaattctccattgagggaactgtgccctgtggtgtgggtgtctggagtgtcctgttgagtgatgatgtccacaggtggcatcgctcctccctggacctaccttgggaggggggcatcttctcttcctgtcgtrgtacctcttccatggcccccagcacttcaggcacccaaggacggcaattaccacaattgttatagaacattttaaaattcattatgggaaaagatgccttacacaaaccagaaaatgtaacagtctaaggtgaaaatatttaccatttggatatctaaaacaagatacaatccaaaataagaatcttatgcccagaccagggaagaaaatccaaagaaatacaaataaaggacattaccaggaatgtatagaaggagaaaaacagatgtcaataaatatttgaaaagatggtggtattcatttataatcaaataagtgagaataataaaacaaaatcatggccaggcctgtgactcacacctataatcctggcactttrggaggctkaggaaggaggattgtttgaaaccaggagctcaagaccakcctgggaaacatagcaagactctatctctacaaaaagaaaaaaaagaaaaaaacaatttcttcctaatcagattaccaaagtaatgggaaaattgataacttgcttttggctatgttaagaaaaaccagaataatgtatccccttgaaagattttgaagttagktaaaaaaaaaaattgagaaaacatgacataatcataatattaaatttctgacattttgttatttaaaacttactttaaataggagagtaagatctacctgaaatgttctttattggattggtaatcatggaaaagatataaaattaaatattcattatttagaataacaatagattagttccatggaacactatgcagacatgagataaaatcgacaataattgacaaaaataaaaatagctaatgtttattaagtattcagtcttgctacacacttttccccagtaacatacgtatattccactgtttaatttgaaaactatatcatgtgacgatcattatatagagaggaaagtaatgcattcaggccaacttgtccaaggtcacatgactgggaagggacagagccttatatatgcgctctgaggcacgctggctgcagatcatgacattcagtgttgcaattaatgtatgtagtttttgcctggagagtatagaggactcactgcataactactcaaacatgtcaccataagcttgtcagtttggcaaatgttgaagaaaaacaataacatccagggttcgagtttgagagaggaagacaatgggcattatcaaacaaagtcaggactgaattgctaaatgttgctgagggtgattgtcaagatttatcaaaacatatatatgtgtagcccaggatgccacatttagagtcctagagggttacttacaagaagactcaatgattgcacgaagtaaaaatacaggaagtctttttcatctttgtgtttctggtggaactcagggaaatcagtcattgtcaggatacagacagaatgagtaggaaatctacgakttgacctatgtctctcaagatccaaaacaacttcccacccctcccctctgtctgctcagtgccacccctctcccaggaatcaytggtcatgagactgagattgcatatgtttgatgctataggaggcaatgaccttcaaggacgtggctgtggtcttcactgaggaagagctggggctgctggaccttgctcagaggaagctgtatcgagatgtgatgctggagaacttcaggaacctgctctcagtgggtgaggacaggcaccctctgtaacagaacgtcaggccccagargtggctttgtatcctagggtacaaagtttcaagtcttaattagtaacttgaacctatggttcaagtttgagtgtgcagtaagaacctaaatttctggtaaactttaccttgatattacctagaatgtgttgggattaagcatgtaagtttgcctgtttgcaggacatcaagcattccacagggatactttccacttcctaagggaagaaaagatttggatgatgaagacagcaatccaaagggaagggaattcaggtaagaatcaagcaactgtgaatccctgtatgtctcttccacctgtttcacttctgtccatgctcaaatccattgccctggcctaaatggccaaacctctttcttggattattgacaaccatcttacacctggtggccctgccacccgccttcacatcctgacatctgttctcatagcagccaaagtgatccttaggaaatgtaagtcagattgccattcctcagctcaaaagcctgtttggcttatttttattaaagttacaacctctttaattgacttttagagaccctgtgatctgctcttcatcccctccctgccacctctctaactacatctcctgtcctctccttcttgctctgtctttaccagccactttattctccctgctgtttctctgtcctcccaagggcactgtgttgccttttgctggtacccagtgaccacagactgagcagactgagagacaaacatttattatttttgtgttctttagggatgaagtctgatacatctcactgggcaattatcaagttgtctgtagggcttcatgttttctggatgctcttggggagaagcctttactttagtttatcagtgtctaggcactgtccatactccttggctcttgcttcccttcctccatcttcaaaggcagcaacttgcatccccatagtcatgctccctctgccactcttcttatgccttcctctttcaccttttgggtcccttgtaattgttttgatcactcctggataatccaggatgatctttctgttctctggttaactgactagcaaccttaattgcatctacaacctctgttcccctgctgtataacaacgtgatcataagtcctggggactggatgtggacatcttttaggaaccattattctgtctctacagaagcttctgtctcagcccttacttgctcatctcagtcactgggatactctgtcacctcaaaaccttctggcatctccttcagttattcaagtttcttttcagttttaaagtcatgagagaagccatcctaaaccactctctttataattccattctattttgattcttcttgtgctctcttgtaccaagtctcacatacttctgtttatctgtcacttctacatgctggactataatgtctaaggaattttaactcttcgtggctgtattttcagtgcctagaatggtcctggtacatggcaggtttccaaatttttgttaacctgatatatgagctaatgaatggggtgacttcactgtctcctgaaattatggagagaactaataagtgaaacacaaactacggtgaaagagagatattgcagaacatgttttttgtcttccaatggccatgtatttaattacaatgttcttagattccgttatttgattgccttgtgtgtttacggtggacccacatcccatggaaacttctaagcattctatttattaccatactgagctatatgccttccatatgacttatcctggagcttttcataggaagcatattcatttctggaaagaaatcatttttgaatgarcattctgatgtctactagtgagacagctcttctacaaggggaaaaaattctccattttgtgatgtgtcagataataaccagcttcccagctagctttcctttgagagatttacccatctgcagcccatttgcctttccaaagtctgcatgcacgtcactgaccccaggtttcttcttctcctgggtggggaagaatgaggaagagagcaacacaattcatgcagctaaacattgcctatatttctggtcatctttgttcaaaaatatgtatatttctgcaccttcattgtatacagatttaattgttaaaaacataaaagaatacagattttacaacataatttttcctttattttttagagacctagtgctctattttcaactttataacttggaaggaatcaggaaactgccctctcaaaatactgacatcctgaaagagactctctcttctccccaaaaacctcttaagtaacagtgtgttaaatatatccatattccagcgtgtaccattgggtacatatttacctattactgtttttccaagattcaaccttggaagttaactttccatttgactgacttaatttaggacttggtaatatcctgaccaaagttgtcaacatttttatgattgtgagtcatagtaagaaacacatctttcaccataaccaggacaaacatttttcatgcatgtagatgtctatgggttacttcagtaggcatttcatgaaatgatacctttcttgcttgtcatgaagatgtgatcatttcttttctagttctttttttctaaatgctcattagaaggttttaaatttattttatagctcactttttgtctatattcttccatttggaaataagtataaaggagtatttatctatatcatatattttctgccctcttttttcttctttttttatttttttgagacagggtctcactctgtcacccatgctggagagcattggcatgatctcagctcacagcaacctctgcctcctgagttcacatgattctcatacctcggcctcccacgtagctgggattataggtgtgcaccaccacacctggctaatttttgtatttttagtagagacagggtttcaccatgttaatcaggctggtcaccaactcctgggctcaagcaatctgcccgccttggcctctcaaagtgctgagattacagacatgagccactgtgcctagcctctggtcttttttattttaatgagagtctaatatccccacatggaaccaacccagggcatgacccctcaggcattctttttatcccaagtgttctcaccacctttcattgtctcatcaggagcatcaccctttctttacccctgtcaggtccaacctttcagattcccatcaaaactggttgtctgtttcttacctatctcagttaaccaaattattgttcacatctacagaaaaataaaattaaagatacatgttatgccaaattcttgtgtaggaatattatgaatatgtagatataaacactcctaggcctttgatattattgtgaagagtttaactggctgcacagtttagagcaagagtttacagaagatcgctctcacttcacaccaactgcaagtgtggggatttcccaaaactaccttcacattcagtaattacctagaaagataagcagaactcactgaatgcttttatactaaaagttacggatatttacagggtagagatgcacattacatttcaccaagagaaaaataagaaacagttctgggaagtaccaaatgaggatcttgtattgtattctccccatagagtaggatgcgttaaattcccagaattaaggtgtgacgtagagggtacagcgaatcagggaagctcacctgagccctgtattttttttttttttgagacggagtctcgctctgtcacccaggctggagtgcagtggcgcaatctcagctcactgcaagctccaactcctgggttcttgccattctcctgcctcagcctcccgagtagctgggactacaggcgcccgccaccatgtctggctaatttttttgtatttttagtagagatggtgtttcaccatgttagccaggatggtctcgatctcctgacctcgtgatctgcccgcttcggcctcccgaagtgctgggattacaggcgtgagccaccgcgcccagccgagccctggttttacaagtaatttttgaggctccattacatagccattatttgttgattgattcccatgtggctagtcagtctcctgggccactgattccatgtaacctaaagcctcaccttaaatcacgttgctctttgtgacatagggggcaccgacccccaaaggcgtggccagcyacaaccctaaatcatattgtttcactttccagtgacctagttttactctcaagcaaacaaagacactctcctcaggcataaactcctagacattacctctcagatcctgaggaaaacatctagacctcattttgagtaaggttaatatctttactttgtaaggatacacaatataaacacaaatgtaccaagtcttgattatattacttttgtttaaaattggttttgattcatattttattatatacacaatttattagcttcataatttaccatgcaagattttagactgattaggaaattcactaggaagagtagcaggtataatgtttgtatcatattaattttattattgtcttttatttttattaaaaattttatttcagtagtctttttttattaaagtatatactggtttttggttacatggttgaattgtctaatggtgaagtctgagattttagtgtacccatcacctgagtagtgtacattgtacccaacttgtagctttttatcccttaccctaccttccaccctccccattttgagtctscatagtccattatatcactctgtatgcctttgcatacccatagcttaactcccacttataagtgaaaacacggtatttggttttccattcctgagttacttcacttagaataatagcctccagctccatccaagttgctgcaaaagacattatttcatttttttatggctgaatagtattccctggtgaatatataccatattttctttatccactcattggttgatgggcacttaggttggttccatatctttgaaattgtgaattgtgctgtaataaatataggcatgcaggtgtccttttgatgtaaggacttcttttcctttgggtagatagtagtgggattgctggatcaaatggtagatccacttttagttctttagagaatctccatactgtatttcatagaggttgtactaatttacattcacaccagcagcagtgtataagcgtttcttctcaccacacccatgtcaacatctattgtttttcgtcttttatttctatcaagtattttacatatgatacttggtttagttcgaaattggcctcatccaaaccaaagattatggtgcacttgaaaaatacaaactgaatgttgtctatactcatgagagtttcctgccatggcctaagtgaaatcttgataacactgaacaaaggcttcacttgtcctcatcttttaattctgtattctgataggagacaagatccaaactgagatggagactgtttcagaagcaggaacacatcaagagtggtccttccagcaaatctgggaaaaaattgcaagtgatttaaccaggtctcaagacttgrtgataaatagctctcagttctccaaagaaggtgatttcccctgccagactgaggcaggactatctgtaattcacacaagacagaaatcttcccagggcaatggatataaaccatccttcagtratgtctcccwctttgattttcatcaacaattacactcaggagagaaatctcataygtgtgatgagtgtggaaagaacttttgttacatctcagcccttcgtattcatcagagagtccacatgggagagaaatgctataagtgtgacgtgtgtggtaaggaattcagtcagagttcacatctgcaaactcatcagagagtccacactggagagaaaccgttcaaatgtgtggaatgtgggaaaggcttcagtcgtagatcagcacttaatgttcatcayaaattacacacaggagagaaaccttataattgtgaggaatgcgggaaggccttcattcacgattcccagcttcaagaacatcagagaatccatackggggagaagccattcaaatgtgatatatgtggtaagagcttctgtggtagatcaagacttaataggcattccatggttcacacggcagagaaaccattccgatgtgatacgtgtgataagagctttcgtcagagatcagcacttaatagtcatcrcatgatccacacaggagagaaaccatacraatgtgaggagtgtggaaaaggctttatttgtaggcgagatctttatacgcatcatatggtccacacgggagaraagccatataattgtaarsagtgtgggaagagcttyagatgggccycrtgtcttttgaaacatsagmgagtccacagtggagaaaaaccattcmaatgtgaagartgtgggaaaggattttacwcaaattcacaatgctattcccaycagagatcccayastggagaaaaaccatacaaatgtgtggagtgtgggaagggctacaaaaggaggttggatcttgactttcaccagcgcgtccatacaggagagaaactgtataattgtaaggaatgtgggaagagctttagtcgggccccatgtcttttgaaacatgagagactccacagtggagaaaaaccattccaatgtgaagagtgtgggaagagatttactcaaaattcacatcttcattcccatcagagagttsacactggagaaaagccatacaaatgtgagaagtgtggaaagggctacaawagkargttkratcttgayatgcaccagmrsgtccacacaggagagaraccrtayaattgtaaggaatgtgggaagagyttwggctgggcctygtgtcttttgaaacatcagagactgcacagtggrgaaaaaccwttcaaatgtgaagagtgtgggaaaagatttaytcagaattcacagcttcattctcatcaaagagtgcacactggagaaaagccatacaaatgtgatgagtgtgggaagggcttcagctggtcctcaactcgtctgacccatcagagacgccacagcagagaaacacctctcaaatgtgagcagcatgggaagaacattgtacagaattcattctctraagtgcaagaaaaagttcacagtgtagaaaagccatacaaatgtgaggactgtgggaagggctacaacaggcgcttgaatcttgatatgcatcagagggtccacatgggagagaaaacatggaagtgtagggagtgtgatatgtgctttagtcaggcctcaagccttcgacttcatcagaatgttcatgttggagaaaaaccttagtgatgtgatggtgcaataaagtcttcactcagtcttcatgaatgcagtctcatctgaaagttcacaaaggagagacacattaaaatatgaggcacatagtaagcacttccctttgagtattttatctctgaatccatgctggtgataaatttcacccattcttggaagagggaaaacatttgtttaagataacatcagtgcttcagccatagctcagcatgccccagtagtctcaggaccaccataatggagaatccttgtaaatggtgcaataaagcttcattcagaagtttgataattacagctatcattcaggagacaggccttagaaagagtaagagttcatgaatttaccagactaatggtggacatgtccaaattgatgtccactagaatgtaarctacatgtgtctttgctgctaagtcgtcacagccttaacattgattagchctttgtatgtgttcagtacttgtttgttaaatcaatgaaaggataaaacatatgtatggatttggatacaattttgtgtatccaaaaagggaagcctgcaaaaaataattctgggaaacatgagttgaaatgcagagtaaactcagtactgcaatccatagcaatattttgcatattattattttttcttttaaatttttttcttgatcagatttatcatattcattgaacattattttattgcacttggctcctggcttccccccatcctgtgctctgaagtcagagtattatttgtggctctatgaaatgtccattgcttgtatacggtataaatttaattatcttttgtagtttttctcacagtatagactgaaaaggtttggttaattttgcaataacagaccactgcatatttcacaattaagtgttttcaacagtattaaggcaagatttacagtaacacttttaaagtgccagatgtacattgacagaaattttcttagtcaatcctagattgatcatgatttgtgatttctatgcaggccttggtatgattgccttttaattgctgtacaatttcttttttttttttaacttctctggtataaaatattctaaatttgaatgacagcttttgtcaaccttcttatccaatattcttccaccaacgctatgaaacaggaagagaaaatggagtttggtaatttcatcaaatatattcattattgggggcaggagtaacatttaaatcctcctctttattgctggcmgtaaaaatatgtcttttggagagcagaacatgccagaatgtataaggtgcaactgtttgatatgaaaaccataggataggaaactatgcctatgacactaaaactccaaaaagtagaagaccacattgatgatgtcmctgcattttaaaatggaaagaacaagtgttcaagaacaggaatttgtgtgaattgcatttattcctataataatatgaactcaatgagatgatgacatagacacaataacaaaaggagaaaaacaatgtggctttttttagccttcataacctaatcaaataaatatctttgtgtgttttatgttcttttgagtgtttacatactgtgtaaatgaatatttttactgatctttgctggcaatgagtgtttgcaggcatttttccattttatacttccatgcatttttaatttttttatgccacgatcttttaaacaaccagctcttgtgtgaattaagagtgcgaactcattcattaccatggtggggacaccaatgtttatgaaggatctgcttccatgaccaagcacyttccaatagtcccgacctccaacactggaggtcatacttcaacatgagatttggaggggatacatattcaaactattgtcagatgttaattcatcaggtatacaccatagtaatatcttaagtgtgttaagttaaagtgatatattttctaaggtatagaacaaatagggcttatcacccccctacaagcaaagaaaatgtcacaatgcttagtgtgccatttttgatattggatgcaacttattgtttcgattgtgctactctgacttttatgagtgacccaaaaactttgacttgtcccagacaagagaagtttgtgtaatatgtcccagcttccacgtaagcttctctgccactaaaaccctgtgaccccgggggtccaaaagtgtttgaaatgtccgtggcagatagtatgtttgaagcctatggttggccctaattggagaatcaaaattcagatgcttagtattttgaagcaaatttctgccatcctctgcatatacttactctcctctggagaagaagcttttcattttgctagggtgttttgttttgttttgtttttgtttttgttttttgagacgagtcttgctctgtggcccaagctagagtgcagtggtgcaatcttggctcactgcaacctctgcctcccggtttcaagcgattctcctgcctcagcctcccgagtagctaggattgcaggtgcccgccacygcacccggctgatttttgtatttttagtagagacggggtttcaccatcttggccaggctggcctcaaactcctgacctcgtgatccacccgccttggcctcccaaagtgctgggattacaggtgtgagccaccacgcccggccactaggggtcttaaaacggacagaacacttgaccacagaccaccaaattaacatgtgacttatgctttccatcatgaatcgggtgttgacccctgcacctttttaagttacatgtgcagattagtattccatttggaagtggtatatatgagattgtgtttgtgcaggctctgaagccacaggtaagtgcacctaatattcatctccctactcttgctgtattcagaatgagtgaatataaagagaagtcatctgaaattattgtgtctcagcagcagaaagaagtggaatacacggttggacgcggtggctcacgcctgtgatcccagcattttgggaggccgaggcgggtgaatcacctgaggtcgggagtttgagaccagcctgaccagcatggagaaaccccctctctactaaaaatacaaaattagccgggcgtggtggcacatgcttgtaatcccagctacgctggaggctgaggcaggagaatcgcttgaacgcgggaggcgaaactccctctcaaaacaaaaaacaaacaaaaaacaaccaaaactgaaagctggtaatgaaacaaatacgtatacacgaacatttgtagcaacactgttcactacagccaaaaggtgaaaagaagccaaatgtgcgtcaatgtatgaatggagaaacaaattgtagtataaacataaaatattcatctatgaaaaggaatgaagtactgatacgtggtatgatgtgaataacattaaaaatattatgctaagcaaagggagttagaaacaaaatgttccattcatttttatgatttgtccaaaataggtaatagaaaagagagaaagattcatgtttccccaggaatgggattatggacaacagtagtgattgcttagtgggcatggggttttctttgggtgataaaaatgttttgtaattcaagaggtggtggtttcacaatgaagcagctactttgtctgaggtttaaacccggggttcgtcgttaagcgccagaaaaatttaggacacggacacacaaaaactcctcagtttaggagcggaggtttaataggaagaagagaaagagaaacgggttcctccatagaggaaggggtctccgagcggaaaagggtcggctggcagtgaatgtgctgagttttacagaccagtttgaggaggcagtgtctgatttacataggggtcatagattggttcgatcagttatgacgtttacatagtgcgtggggaaggctggtcgccccaccctaatcttcttatgcaaataggcttcccagttgattggcccatcttgccagcttcttactgtgcacgtggctgacaaagagaagggaagatggagccgccatctttaacatgattggcacaactgctggtatctatgtctgcggcagctggattttacaggctgctcttccttaggaagggaaataatttggggctgcttttcattaaaaagaaaagccttaccgagggctcccataccctatctgcctaagtgatggcttcttaactcgtatatattaacaacactgtattcgtactagatgccattgccattgaattatgtgccttaaaataattttgttttgtgaattacacctcaaaaatattttttaaataataaaacgaccacgttaaaaacgttttgcatagcgaaaaacaagtcaaaggaaaaaagctttttggttgagcaatatttgatacaatgttaatatgagtatgtaaataatacttaacggaggggaaaaaactaaacactcaatagaaatgtgggcaaactatttgaccaattcacaaagactataatagtggcaacggaaaatatgcacggatgttccactttatttacaaaagaacaaatacaaattaaaactacatttagaaaccatttcttaccattagattagcaaaacttaactcctcgaagactgtgtcttctcgcttgttccctttccaataacactcctgttatcattggaggcgtttagacttcagaaattcctgtctattcagtattttctgtcctggaccagggagagagaaggacgactctcaggataacagttcacattccccactaggcaggcgctcgtggctttgggattcgttcccagtgggcacctcggagtggcaacgcttccccctgaagaatgagattttgagcgtttttccttcagcattcggaggagtgtaatccaaatgctctgtggagtcgtacacactggctccagaaggaggatacaagcaattctgggaatggtagtccagacgctcagtggagtagcggtcagcttggctccggcaggcgaatcaggggatttctgggaaatgtagtccagacgctcagtggagtctcggtcaatttgactccggcaggtggatcccagggaattctgggaagtgtagtccagacgctcggggtcgtcgcggtcagtttgtctcaggaattctgggaagtggagtccagacactcagtggagtagcgggccacttccgctccgttactgtgaggttgctgcagttttgtccctggtagtttgggtcagttccgcgagacccttctgaatttcctggacctacgcattggatccttaacgaactggtgatcgaattaggggaaaagaaacctcgtcggagagcagaggtttggcggagcggggccgctgttttcgttctcgtcagtggagccttcttgggcttggggctctcctcgcgtccccggggtgtttgggacttggtcgggtcgcgtctcgcctggttttagggtctccggggctctgagctcgcccactcggcctccctgcaccccacgcgcgtggccacttcctcgcgataaaacgctgggatgttacttaatctccttgggtctcccgttacagttctttaagatggggagtttaggaccatcctaatagaatcgttttgggaactgaaagcggtaacacaaatgagagccttaaagcagcccctgtcacttggtgactggtggtctcttgttaatttcccacgaagcctgtcaggtccccgggtggggtgaaactccagctgcaggggcaccggcccttctccctgattcctgcaagacgctgggtgatcccggacgccttctgacctctcttttaggaaggcgagggttgcatccacttccaggaggggagaggagcatttaacttttatggggcacggcgaccacggtcagagtgtttcacagccttctccttacccagcccgacctttccaaaagagctgcagggagggacttcttggcttctgagggcaaagctctacgtgagtgatccttggcttttttctttgacagagatgctcaccccaaccgagagtgtataggatgtgtcttcgggcatgggtgttgctttcagttgtcatgtttttctagtctttaatcttgaaagatagcatagctttcatcgttttttcttggtattttatccttgttatttttgaagagtatagatgaagttattttggtcaaagatgttcatttggagtttttctgatgtatttcacgtttaacttcaaaatatgcattttttgctggaataccacagaagtggtaaatctctctctctctttttttttcttgagacggagtttcgctcttgtcgcccaggctgtagtgcatggcacgatctcagctcattgcaacatccacctcctgggttcaagctattctcctgcctcagcctcccaagtagctgggattacaggtgcctgccaccacatccggctaatttttgtatttttagtagagaagggatttcaccatgttggccaggctggtctcagactcctgacctcaggtgattcaaccgccttggcctcccaaagtgtgggattacaggcatgagccaccgtgcccagcctgaagtggtaaatttcttattgcaacataacaggggccatatgtcagtttgtcacttcattggtgatctcaactttgttcacttggctaaagtcatgtttgtcagatttccgcattgtaaaattattttgaatttttttttttaccccaggaacacagattcaagttgctctcaatatacactccctaattttttagttaaataaaattttgtaaggagaaatacatttattagtgcacattctactgtaaaggtgaactctcccttctccttcatttgcttattcattcattcaactataaatattctatcagtgtagatccagaatccagtcttattaagttaaatgacatgtggatgaacaattaccaatgctttgtccaactttattgaggtgtattctacatatcatagaaactacccatttcgtgtgtacactttaatgatttttaggaactttgtggagtggaataaacatcaccataattcagtttaaataattttcatcccccattaagcctccttgtgctcacttatagttaatcctctttgtcacctcaaatatgcagagaccacctatctactttctcgttatatacacttgcctactctggaatttcatagatataggatcatgcaatatgtgggccttcctatgtgactggcttctttcacttagcataatgtttccaaagttcatgcgtgttgtagcatgaatcagtacttcattccttttaatttccaaataagattccattgtatggataggccacaatttgtctatccatgtacgcataggagggagtttgttggtgtgcagttttgggttactatgaatgatgctgttgggaacattcatgtgttaatttacaatacacattcgtgttggtggatggcatccctggccacactttcatgtctctttttctgccttccctggtactttccaggcaggattctgctttcccttggactgtatcactcaggactctgaatattccctgaaataggaggaaaaatgaccacgttgaaggtgagtagagcttgcctctcttgctgttaaaatttcttttatggagacttgttctgtcgccaaggctggagtgcagtggcctgattttggctcattgcaacctccacctccggagttcaagtgattctcctgcttcagcctcccaagtagctgggactacaggcacacaccaccacacccagaaaatttttgtatttttagtagagacggggtttcatcatcttggccaggctgttctcaaactcctgacctcaggtgatctgcctgccttagcctcccaaagtgctggaattgcagatgtgagccaccgtgcccggccgtatttcttctcactactcatattctcacaggttcttctcagtcttgggaagacttagggagtacaacagagatatagcatgggacaaacagaatctagctcttcccgtgtgaacacctccaataatccttgtgtgaagcagcagttaagcagttatagcctgttgtgttgtgccaacacgagagccagcgtccacaggtggcactgctcctcccaggcaccattttggggtgatcttctttcttcctgacatgacacctactcagatgcacccagtgctccaggcacccaaggacagtgataaccatagtcatgatagaaaatctttactttcagtatggtaaagggtacctcacacaatgttaccagaaaatataacagcctagagcaaaaatattcactacttgtatatttgaaacagataaaatccaaaataagaatcttatgtacagaatagaaaaagaaaatccaaaggaatgtgaataaaagacattaacaggcaagtttaaaaggagaaattgagatggccaataaatatttgaaaaggtgatggtattatttataatcaaataagtgagactgttaaattcttcctaatatgattacaaaaatcatgggaaaattgataacctgctcttggttatggtaagacaaatcagtgtacacgtatcctcttgaaagattagggtttggtaaaaaattgagacctgatattatatgatcacaattttaaatatgcctatttattgacattttaattttcatttaaaattattttaaataaacagtagtaaaatctacccaaaatgtttttttttacaggattggtattaatgagcatatataaaattaaagattatttagagtagataaaaatagattatcaattctttggaatactatgcagacatgaaatgagataaaatagatggcaacaatgacaataataataaaaaaaattttaaaaagctagtgtttattaggtatttagtctgcactgatcaactttcccaatgctgcatgtatttccttgtttaatcattgaaaaaactataatatgaaaattattagagagggagtaaataggtgaacttgtccaaggtcatgtgaccaggaaggcacagagccttgggatgtgcttttaggcacactgtctgcagatcatagatcaatgctgcaatcaatgtatgtagtttatgccttgagagtacacaggatgtactgtatagctgtcccacacaggttaccacaagctttgttagtttggtggcagatattaaagaaaaatgataacattcagggttcaagtatgagagagaacaatgggaattatcaggcaagactgggactgaattgttaaatgttactggggcagttggcaagattcactgaaacctatatacgtgcagcccaggatgctgcatttagagtcctacagggttacttacaaggagactcagtaagtgcacaaagtaaacctacaggaggtcttttccatcactgcacttctggtggagctcaggaaaatccatcattatcaggatacagacagaatgaatagcaaatctatgagctggctgggcgcagtggctcatgcctgtaatcccagcactttgggaggccgaggcaggcggatcacctgaggtcaggagtttgagaccagcctggccaatgtggtgaaaccccatctctattaaaaatacaaaaattagccaggcatggtggcaggcacctgtaatcccagctacttgggaggctgaggcgggaggatcacttgaacctgggaatcggaggttgcagtgagccaagatcatgccactgcactccagcccgggcaacagagcaagactgtctcaaaataaataaataaataaaataaaataataaaaaaggaagtctgtgtgttgacctatgtctctcaagatccaaaacagcttctcattcctcccctctgtctgctcagtgccacccctctctcagtagtcattggtcatgagactgaggttgcatatgttcgatgctgtaggaggcagtgaccttcaaggacgtggctgtggtcttcactgaggaagagctgaggctgctggaccttgcccagaggaaactgtaccgagaagtgatgctggagaacttcaggaacctgctctcagtgggtgaggacaggcaccctttgtaagggaacatcaggaccaggagtggctttgtatcctagagtgttcaagtttgagtatgcattgggaacctaagtttccagtaaattttacttagatttttttctaggatatattggcactaagcacatgacttttcacgttcacagggcatcratcactccacagagatactttccacttcctaaaggaagaaaagttttggatgatggagacagcaacccaaagagaagggaatttaggtaagaagcaagcaactctgtgtccttgtgcgtgactctcccatckgtttyacttctgtccattgcccagctctgttgtcctggtctaaatggccagacctctttcctgaattattacagctgactttcggctggtttccctgctcccacttttcccaccctgacatctgttttcctcatggcagccaatgtattccttaggaaagtcagactgccattcctcggctcaaaagcctttctggcttcttttttttttttttgagatggagtctcgctgtgtcgcccaggctggagtgcagtggtgcaatctcggctcactgcaagctccgcttcccgggttcacgccattctcctgcctcagcctcctgagtagctgggaatacagatgcccgccaccacgcccggctaattttttgtatttttagtagagacggggtttcaccgtgttagccaggatggtctcgatctcctgacctcgtgatccgcccgccttggcctcccaaagtgctgggattacaggcgtgagccac

SEQ ID NO: 12187 - DNA, 19387 bp, Homo sapiens
ggagggcggctgctgcaaaggctgagccagcagcaaggacttggagccctgccgagtccctggggactcaggggctctccaggggggagcccctgagcccacccatggagggacctcggccttggagtgccccctgtaagaaaaccccaggttcgggtgaagagccaccaggccaattctctgtcactcactttcagtcctccaagagccgcccataggccacaggatgacttccacatttaaagatttcttctccgccaccccaagtttttattatgacacattttattcttatttattttgttttttctttccccccaccccaataccttcagctgcctttatatgatacattttaaatattcaggaaagtccttagagtagttcagtgatcaccagtatatccactgccaagctgcaacatcgttgatgctcagtttaccacatatacttagtctctcttttctctctctgggagatatgcacacacacacacacacacacacacacatatacacactatacacacatatacacatacatctatgtctacacatgcacatatgcatatatataaacacatgcatactacatacacatccatatatacacacatatacagacacatgttacataaatattcatatatatacacatagatatgcacatacatctatagttatacatacatatatatacacactacatacacatccatatatatacacacacatatatagatatgtacatacatctgtagctatacacacatatatgaacatatattacatacatattcatatatatacacatatatagataggcacatacatctatagttatgcatacacatatgtatacacacatattgcatacatatccatatatgtctacacacatttttttcccatgaactctttgaaagtaaggtgatcatgacctttatccctaaatacttcagtgttttatgacmtttatccttaaatacttcatcttctaggaatgaggacattttcccacattacactgaagaaaatcaacaataaagcacgaatatctactataatatccagcccatattcacattttcacatgtccccgctggttcccaaaagatctttttagagctgtttttttcttttcctttttttttttttttttttttttttttgagatggagtcttgcactgtcgctcagactggagtgcaatggtgccatctcggctcacagcaacctccacctcctgagttcaagcaattaccctacctcagcttcctgagtagctgggattacaggtgcgcaccaccacgccaggctaatttttgtatttttagtagagatggggtttcaccattttggccaggctggccttgaactccagacctcaggtgatccacctgcctcrgcctcccaaagtgctgggattacaggcgtgagccactgtgcctggccccctgttttttctttttcttttctgagatagggtctcactctatcacccaggctggagtgcagtgctgtgatcttggctcactgtaacctccacctcctgggctcaagtgatcctcccatctcagcttcctgagtagctggaactacaggcgcatgccactacactcggttaattttttttgtattttttgtagagaggggttttcaccatgttgcccagactggtattaaacttctggcctcaagcgatcctcagacccacaaagtgctgggattacaggcgtgagtcaccgtgccctgacttttttcaaaactaggattcaatcaaggtccgtgtattgcatttggctgttatgtctcttaagcctcttttaatcttaaatgttctattcactttattatttttttaaaacaacattaacttttttaaaaattttggatacagagtctcacttcgttgcccaggctggagtgcagtggcgcgatctcggctcactgcaacctcctcttcccaggttcaagtgattctcatgcctctgccatccaagtagctgggactacaggcacacaccaccacacccagctaaatttttgtatttttagtagagatggggtttcaccatgtaggccaggctggtctcaaactcctgacctcaagtgatccgccttccagggcctcccaaagtgctcacaggctttagccaccacgccggaccaacattaactttttgatgatctgaggactgttatcctgaagagcatctggaaggttccaccttctggggttgtctgattgcttcctcacagggccatttatctttttcctctagcccctgtatttcttgtcaactggtaattaatactagggacttgatttgattgtaggggagcaccttttaaaaaatggtgaaactgtgaatcacatacatttaccattgtaaccatttttaagtgtacagttcagtggaattaagtacattcacattgttgtgcaaccatcactatcatccacctccagaactttcatcttgcagaatggagactgtgtccccatgaaacactaacgcccattcccccacctccagcccctggcaaccacgattttgccttctgtctctgtgaatgtgactattccaggttccccaaagcagtggaatcatacagtgtttgttcttttgtgactggtcctgggtcatggcttttgaaaagaggtcctccgagatgatgccgtgcacttcagattgcatcctagcaggagctcacaggaaccctgcggtccctgcctgccagcctctccactcagctgtgctctgcatctctacccattctgtctctacccacactgtctcagctgttcagccctctcactctgtctgggcctttgcatttgctgtgctccctggcaggctccttcctatcttcttttttttttttttttttgagatggagtctcgctctgccacccaggcgggagtacagtggtgcgatctcggctcactgcaatctctgcctgcctccggggttcaagcaattctcctgcctcagcctcccaagtagctgggattacaggtgcatgccaccatgtatggctaatttttgtatttctggtagagatgaggtttcaccacgtcggccaggctggtcttgaactcctgacctcaagtgatctgcctgcctcagcctcccaaagtgctgggattacaagcatgagccaccgtgcctggcctcctttctatctttgaatttcagctgaaatgtcaccccgttctagaggcctttcccgactgcctatcccaaagctgcttctttgtttcattcgcttcccggtgttcctcccagcctgacattaccttgtttgccatgtttgtctgttgtggaagacaaactccatgagagcaggggcccctgctctcctgttcaggctgccttcccaggctctggcagtgcacttggcacatagtaggtgcttgtatgagcttcctctggctgctgtaacaaatgaccatgaacttggtggcttaaaacatcacaaatttattatccaatagcctgggaggtcagaagtcctaaatcagtctcagtggactaaaatcaaggtgtggggagggataagttctttctggaggctctgggggagaatctgtttccttgcctcttccagcttctccagcccgcctgcatccctgggttcacagttccacgtcactgggacctctgctctgtcatccatcatctcttctgactctgacccacagcctccctcttgaaataactctgtgattgccttgggcctgtctagataatccaataaatctccctctttaaagatcctaggtcaggtatggtggctcacacccataatcctagcacttcaagaggccaagataggaggattgcttgaggccaggagttcaagaccagccctggcaacatagtgagatccccatctctacaagaaataaaaatgagcagggcgtggtggcacacacctgtagtcccagctacttgagaggctgaggcagtaggatcgcttgagcccaggaggtcaaggctgcagtgagctgtgattgcaccactgcactccggcctgtgtgacagagtgagatcctgcctctaaaacaacgacaacaacaacaaaaatcctaaaccctaaacagtcacatctgcaaagtcctttttaccatgtaaggtaacatattcataggttttggggattagaatgtggacatttaggggggccattattctgtttaccacagcgttcaataaatgtttgctgaatgaaggaattggatgaatggatgggtccctttatacatggagtcccaagttctgagttccaggcctggcgtagcctctgtgtggctgtgtgaactgggcaagtcctctctctctgaacctcagtttcctccttcattagatgtgttcttttttttctttctttctttcttttttttttttttttttttttgagatggactctcattctctcacccaggctagagtgcagtggcgcaatcttggctcactgcaacctctgcctctcaccggattcaagcgattctcctgcctctcagccccccaagtagctgggattacaggcgcatgccatcacacccggccaatttttgtatttttggtagagatggggtttctccatgttggccaggctggtcttgaactcctgacctcaggtgatccacctgcctgggccttccaaagtgctgggattacagtcatgaatcactgcacccagcccatgtgttctgagcacccaacatgtgcctgatcctcagagggccctgggaatgccaagaaaaatgaagggagaccccagcctcctagagcttggagtctgacttctagggaggggcttgagaaagagaaaacctgacccagtctgctcagggccacattccaggtcccctagaaggctttgaagtcctgagagggtgtgcttaccaaggacatgacatttcaaacagctttgacgcataagtaggagtttatgtggtagagatgtggaaagtgacattaaaggccagggacaggccgcagtcccttttgaggaagtgtgaggagtgtggtgtgatccctcaggggaaggagaccagtggggaaaggcctgtccggaaacggggccttgaaggccacagacaggagcccgggacctgcctttaggtgaatggggagccacggcagggttctgaagcaggagagagagtgtgtagctctggaccactcacgctggctgctgcagggtggggatggcattgaggaggccagcatcccagcctgaggtggaggtggcctggactgggcaggaacagtggggttggagagaaggagcagatctgagagagatttaggaagcagaatcaacgggacatggacatggtgagggactgagacaggagtgggggagggagagcccggcagccactgggaaggaagatcaggcaggacagaagtgtgggtagatgctttccataaaccgttgagaaatccacgacctggcccaaatgtggacttcacgagaagccccagatgggtcaatgggtccataggcctctcccattgaagagagaccagtaatgccgtcattaagggtacaagacaggcctcaattctaggtgagggttggtccacgttctcacttgatttacaaccagtgaagtcaacagagctgtgaaaccatctcccccatttccagatggggaaaccaagtcccagagacacccagacatggccaaggccacacagtgcagagaccctggggagcacaagcctctaagagggggattttacaagtctgtctgaaaccagaggcgaggacagagttgagggggggtcccctctgagtggttccccgccaaagagaatttctccactttggaggaagtgggaggtagttcttcttttgagatgtgaatgtcaagtgactctgggcaccccggtgactaagaggtaagtaagtgaggcttgtgggtggagccagcaccttaaatagcaggtcttcctatgtccctttgcagacacctgggctgagacatacaggacagagcatggmtcgcctacagactgcactcctggttgtcctcgtcctccttgctgtggcgcttcaagcaactgaggcaggtgaggctggggagmaggaagaccccctacagaggccagggcagacggtggkgtgtcttcctcatgtcttggacaagcactggaccaagagcagaagacctcagtctgctgttggctcttgcggccttcggctagttgcagtgcttctctgggcctcagtttacaagtctgttgaatgggcagtcttgaagacttggagtctaggatctgtctcacctgggttgggggttgtggtgggcatagcctcgggatctcctgccccagaaaactcaagcatagggccctaggggtgtgggtgaggagcttctaagggtcaggtctgagtgggggaaggcagggctggggcaaggggttctcccttggaaagctggtgctgccctcccaccatccattttttaaaatgttattattattattttttattttattttattttattttttgagacacagtttcactcttgttgcccaggatggagtgcagtgrggcaatcttggcccactgcaacctctacctcccaggttcaagcgattctcctgcctcagcctcctgagtagctgggattacaggcatgcaccaccacacctggctaatttttgtatttttagtggagacagggtttcaccatgttgsccaggctggtctcaaactcctgacctcagatgatcctcccacctcagcctcccaaagtgctgggattacaggcatgagccactgcgtctagcctaaatttattttttatttcattttatttatttattttttgagatggagtctctgttgcccaggctggagtgcagtggcgcaatctcagctcactgcaacctcyacctctggagttaaagtgattctcctgcctcagcctcctgagtagctgggattacaggcacctgccaccatgcccggctaatttttgtatttttagtaaagatggggtttcaccatgctgaccggtcttgtctcgaactcctgacctcaagtgaaactcccatcttggcctccctaagtgttaggattacaggcgtgagccactgctctgggctcactatccatttttgtccagaacctgtcctcagcatggattcctgactcctcttctccaccccactctatacttttgctgtgttgggtggaggagtgagcactggagtggggtcaggcagctataaacaagaattgctcccagctgctgggctttctgagtgcttttcatgcattaaagaccctctgaagctggtactgttattacccctttggtcagaggaggaaattgggcctcaggctacagctgatgcttagttgttctgaatccccgctcctagagctgactgtcccagagtgtagacattggaccctaagtggcttctcagaagctccaagggtagggtcttggagggctcagaatcctctggtcaccatccttccacatgagaacagaaaaactgcatctctttcctggagcctggagaggccgagatcaggggctggggccgagggtgacctctctgggctccagcttgtgaattcactggggacccctcccctaggcccctayggcgccaacatggaagacagcgtctgctgccgtgattacgtccgttaccgtctgcccctgcgcgtggtgaaacacttctactggacctcagactcctgcccgaggcctggcgtggtgtgagtagggagctggggccacagggccttggtgggcctgacgggtacagcctgggatggcccaggtgctggtgggtgggacacacccagggatgagaggaatgtggcagggctaccagatgcctgccaggatggcttggctggaagagatggctcagttcaggcttgggtggactacaaacaaaaataatgtgatcgtttagccaatatcctcaggcgcttactaggtgccaggcaacatgtcaggttctgaggatgcagagctgagtgaacagggtgccaccasagtgtgggtatggcagtaggtagtcagtagctgtggcatctagggtatttgggtatagcaggtataggagtatacctagtgccactgagtcagcaaagatgctyccaggttctgggcaaaaatggatggtgaaccaggcgtggtggctcatgcctgtaatcccagcaytttgggaggccgaggcaggcagatcacttgaggtcaggagttcaagatcagcctggtcaacatggtgaaaccccatctctactaaaaatacaaaattagctgagtgtgatggtgcrtgcctgtggtcccagctacttgggaggctgaggcaggagaatcatttgaacctggaaggtggaggttgcagtgagccgagatcgctccacctcactccagcctgggcaacagagggagactctgtctcaaaaaaaaaaaaaaaaaatgctcacaccagaagtgtcttggatcctctccaggctcccagaagtccaaggcagcccattttgaccagaagaataacattaagagctaaaatttccaaggtgcctcccgagtgccaggcactgttctgatcattacctgtgttaactggtttaattctcacaacaatcctacgaggaagttcaacgattcccatggtagagatggagaaacaggcttagcaagggacagtgacctgctcaaggctgcccaggttggagccagaactcactcctggttcctcgttcagggctttcycctgagtttcttgttctcctttgcttctttctctggcttctttgcctccttttccctggcctggggcctgcacctgcacctggctgggtgacaagtcctgccctctctgcggtagcctctctggctgcttctccaactgctcagagcctgctgcctaccaaatctcacacctgggraggctgggtttggggactcatgacccactttgggcctctattatcttctcatcttcctcctccttattgctgacaccatctcttagagggatctgcaggtgaataataaaaaaggctgaagcaggaagccctcccagagttcttgtctctttaactctgagcctcagtttccccaacagtataatgaagtaataacctaaacttatttgacttatttgtatttatcaaacacatagagagtgcttgctaagtgctaggctctgccgtaagcactttataaatatgaactcatttaatccttgaaacaatcctatgcagtaggtgccatcgtgacccccttttcacaggtgaggaaatgagcacaaaaaggttagggggcctcttgagcattacagggcacagtaatagtaagaggaaggtgaagagctcaatgtctggcacataatagatgctcaattgctgggcatgtagtgcttctcagttacttgggaggctgaggcaggaggatttcctgagccctggattttgaggccagcctggaaacttactgagactctgtctttatttcatttttttaaataaaaaaggctgagtgcagtggcttacacctgtaatctcaggactttgggaggctgagttgggaggatcacttgaggccaggagttcaagacaagcctcaatagagtgagaccctgtctctaaaatcaatcaatcaatcaatcaaatcatatgtgatcactggattttgagccagaagggaccctagaaagaatgtgtctggaggctcagagtagttaagtgatattataagactcttggggattctggcttggcgcagtggctcactcctataatcctagcctttgggaggccgagacaggcaggatcacttgaggtcagaagttcaagagcagcctggccaacatggtgaaaacctatctctactaaaaatacaaaaattagctgggtgttgtggcgggcacctgtaatcccggctactcgggagcctgaggcaggaggatcgcctgaacccrggagttggaggttgcagtgagccaagatcgtaccactacactccagcctgggtgacagagactccatctcaaaaaataaaaacaaaacaaaacaaaaacaaaaacaaaacccaactcttggggattctatttcatggcctgatctggaactcaaggctgggattcaagagctgagggtcctggaagtccttgctgcctcttcctctttttttttttcttgacacggggtctcattctgttgcctaggctggagtacagtggagcagagatctgggctcactgcagccttgacctcctgagtccaagcaatcctcccacctcagcctcccaagtagctgagatcacaggcagatgtcaccatgcctggctgacttgtacgtttttgtagagacagggttttgccatgttgcccaggatggccttaaacccctaggctcaaacaatcctcctgcctcggcctcccaaagtgctgggattacaggcgtgaactcctggcctcctcttcctcctgagaaatattcttttcacaccacaggtggcttgtaaattttgaaccactctatttagcagataatgtcatatgtagtaggtgactcataaatgctgagccctgcataaagtaggtggctcataaatgctaagctcccgagggtgtggcatccttgctgcgtgctaatgttgctgcattgtctctggggtctccttcttccaggttgctaaccttcagggataaggagatctgtgcygatcccagagtgccctgggtgaagatgattctcaataagctgagccaatgaagagcctactctgatgaccgtggccttggctcctccaggaaggctcaggagccctacctccctgccattatagctgctccccgccagaagcctgtgccaactctctgcattccctgatctccatccctgtggctgtcacccttggtcacctccgtgctgtcactgccatctcccccctgacccctctaacccatcctctgcctccctccctgcagtcagagggtcctgttcccatcagcgattcccctgcttaaacccttccatgactccccactgccctaagctgaggtcagtctcccaagcctggcatgtggccctctggatctgggttccatctctgtctccagcctgcccacttcccttcatgaatgttgggttctagctccctrttctccaaacccatactacacatcccacttctgggtctttgcctgggatgttgctgacacycagaaagtcccaccacctgcacatgtgtagccccaccagccctccaaggcattgctcgcccaagcagctggtaattccatttcatgtattagatgtcccctggccctctgtcccctcttaataaccctagtcacagtctccgcagattcttgggatttgggggttttctcccccacctctccactagttggaccaaggtttctagctaagttactctagtctccaagcctctagcatagagcactgcagacaggccctggctcagaatcagagcccagaaagtggctgcagacaaaatcaataaaactaatgtccctcccctctccctgccaaaaggcagttacatatcaatacagagactcaaggtcactagaaatgggccagctgggtcaatgtgaagccccaaatttgcccagattcacctttcttcccccactcccttttttttttttttttttgagatggagtttcgctcttgtcacccacgctggagtgcaatggtgtggtcttggcttattgaagcctctgcctcctgggttcaagtgattctcttgcctcagcctcctgagtagctgggattacaggttcctgctaccacgcccagctaatttttgtatttttagtagagacgaggcttcaccatgttggccaggctggtctcgaactcctgtcctcaggtaatccgcccacctcagcctcccaaagtgctgggattacaggcgtgagccacagtgcctggcctcttccctctccccactsccccccccaactttttttttttttttatggcagggtctcactctgtygcccaggctggagtgcagtggcgtgatctcggctcactacaacctcgacctcctgggttcaagygattctcccaccccagcctcccaagtagctgggattacaggtgtgtgccactacggctggctaatttttgtatttttagtagmgacaggtttcaccatattggccaggctggtcttgaactcctgacctcaagtgatccaccttccttgtgctcccaaagtgctgagattacaggcgtgagctatcacacccagcctccccctttttttcctaataggagactcctgtacctttcttcgttttacctatgtgtcgtgtctgcttacatttccttctcccctcaggctttttttgggtggtcctccaacctccaatacccaggcctggcctcttcagagtaccccccattccactttccctgcctccttccttaaatagctgacaatcaaattcatgctatggtgtgaaagactacctttgacttggtattataagctggagttatatatgtatttgaaaacagagtaaatacttaagaggccaaatagatgaatggaagaattttaggaactgtgagagggggacaaggtgragctttcctggccctgggaggaagctggctgtggtagcgtagcgctctctctctctgtctgtggcaggagscaaagagtagggtgtaattgagtgaaggaatcctgggtagagaccattctcaggtggttgggccaggctaaagactgggatwtgggtctatctatgcctttctggctgatttttgtagagacggggttttgccatgttacccaggctggtctcaaactcctgggctcaagcgatcctcctggctcagcctcccaaagtgctgggattacaggcgtgaytcactgcgcctggcttcctcttcctcttgagaaatattcttttcatacagcaagtatgggacagcagtgtcccaggtaaaggacataaatgttacaagtgtctggtcctttctgagggaggctggtgccgctctgcagggtatttgaacctgtggaattggaggaggccatttcactccctgaacccagcctgacaaatcacagtgagaatgttcaccttataggcttgctgtggggctcaggttgaaagtgtggggagtgacactgcctaggcatccagctcagtgtcatccagggcctgtgtccctcccgaacccagggtcaacctgcctrccacaggcactagaaggacgaatctgcctactgcccatgaacggggccctcaagcgtcctgggatctccttctccctcctgtcctgtccttgcccctcaggactgctggaaaataaatcctttaaaatagtgtctgctttggtttcctggcatttgctgtccctgtgagatggggcagggggcaccatgatcccctctatcccactggggaagccttcccattgaaataggtggtgacttgcccaaggtcaccctgtgagtggtgggagtcagggctggacacaagggcctgggaggtggctgcacaggtgctgatggagaagcccagacatttgtcccagagttcccagcccaccttgggaccagctgtcaggaggatttgatgaaaccattaaagcagtccccacatctcgagctttcagcagcataatcactcagccactcagccttcaccttccccctgcacgggcagacactggagaaagggagggagtattagtcaggaaaggctacctcctgcaacaaacacctccaaatctcagtggctcaactcagcagaagctatttcttctcacacgaagtctaatcaagcattctcagtcttaggcaaccttccatgtggtcatttcagggaccgaggccccttccttctggtacagccagcgtggtcacaggcagaggaaatgctaagcacacgtgggcaatcctccttactggccagaaaagataagctgggagagctgggtgggactgggtcccaggggccctggaggtggcggcaggggaggccccctggtcatgcccatcccttctcccatcctggtcctgcaggagtgccccgatctccccatcctcctctccagagctgtttctgtgctacttccagggctggggagtccctcatatccctcaagaacagcacaggctccctgctctctggggcacagggtcctggccacctgagggcttgtggaaggtggggacaaggacacccccattctcaccacccccaccccaccccagaggaaatttttgccgtccagtgctacccatttttttttctcatcattactctagttatccctcagtccaagaccttcccagctctctctggcctgtgaacagcatcctcattcttcactcccgcttcacaattctctgcagttgggcctagccgcagcctccattggagccaatggcatccagccattcctcacccctgaatacgtactgtgccttccaccttggtgaggctttcacctctgcctggaatggtctgtcaaaatcctgcctaggtgcatgtggcagggtgccagcccagcatgccacagctgacttgcaaatcacaaggggactaattcttctataataaagatgtctagcaatcacccatcgatccatcaatcccatccatccaaggaaaattggagcaactggtccatgtgaagtgtacagtattactcataatagattcttgccaagagtatgtagcctgggtctaatcaagcctttagatctaactttcggtttacaggaaataaataggatagaggaacaaattagatgacatcacaaggaaataactaaataactaaattaagaatgagaacaccgtataagacaatggacttgactttgctcttttttttttttttgaggcagagtctcactctgccgcccaggctggattgcagtggcgcgatctcagctcactgcaacctccacctccagggttcaagcaattccctagcctcagcctcccaagtagctgggattataggtgcatgccaccatgcccacctaatttttgtatttttagtagcgacggggtttcaccatgttggccaggctggtctcaaactcctgacctcaagtaatctgcctgccttggcctcccaaagtgctgggattacaggcatgagccaccacacccggccgacttgactcttaagaaagttgaagtcattaaaaaatgtgcaagtggtctgtgtagactcaaaaatacccatatgcagtgcatgaacctagatcggatcctcgttcaaaagataaaagcaaggagggaataaaggaaagaaagaaggaagggagggaggcgccaggtgtggtacctcacgcctataattccagcactttgggaggccaaggtgggcagatcgctggagcccaggagttcgagaccagcctgggcaacatgggaaaaccccatctctacaaaaaaaaaaagtacagtaattagccaggcatggtggcgtgagcctgtggtcccagctcctcgggaggttgagctgggaggatcgcttgtgcctgggaagtcgaggctgcagtgagctgagattacaccattgcactcctgcctgggtgacagagagggaccctgtctcgaaaagataaataaatggccgggcgcggtggctcatgcctgtaatcccagcactttgggatgccaaggcgggtggatcacaaggtcaggagataaagaccatcctggctaacacagtgaaaccccatctctactaaaaaaaaaaatacaaaaaaaaaaaaaaattaactgggtgtggcggcgtgcgcctgtagtcccagctatatttgggaggctgaggcaggagaatggcgtgaacccaggaggcagagcttgcagtgagccgggacggcgccactgcactccagcctgggtgacagagcgagattccgtctcaaaaaataaaataaaataaaataaaataaaaataaatgaataaaataaaaaagaaagggagtgagggagagaagaaaggaggcaggaagaaggaaagagggagagaggagaaaccacaaaatacattttggggacaattggagaaatttgggtatgaactgggtgttagatgacatacaggaattattgttaattttgttagatgggataatgatattacatgtatgtaagacaatagctttattctaaggagatgcatgctggaatatttaggggaaaagtgtcaagcatctataatttactttgtaatggtttggctaaaaaataaaaataaaaaagataaaacaaatattaaaaaatgctaatcattggtggtagaggttttgtttgtttgtttgtttgtttgtttgaggcagagtttctctcttgttgcccaggctggagtgcagtggtgcaatctcggctcaccgcaacctctgcctcccgagttcaagcaattctctcccagcctcccaagtagctgagattacaggcacccgccaccacactcagctaattttttgtatttttagtagagacggggtttcaccatgttggccaggctggtctccaactcctgagctctggtgatccacccacctcggcctcccaaagtgctgggattataggcgtgagccactgcgcccagccattggtggagatttgaaagtctttgtacgattctttcttttgtattgttgaatattttccaaaacagaaattttaaagagacaaagcaaaattctgcccatcttcagatggaaagatcatctctctcacccacctttcttgtttccccaacaagcatgcagttctcccttcctgcccgagcccacagcctctagccctctggtagggctggcaacttctctctcctactgagctacagctcctgggggcaaggacttcagctcacttgcctttgtgtcccccatcccaccacattgcctggcacacaccgggctcaataacagatactaatgcctcctgcgtgccaggcactgtgaaagtccttagttttattcactgtcgtggtggcttgatgaggtggctgtttgcatcccattttacatatagggaagctgaaatgcagagagaggttaagtcacttgcccaagggaacaccccttatccgtggtggagtcctgctgatgtatttatttattttttttcagatagggtcccactctgtgcccaagctggagtgcagtggcatgatcatggctcaatgcagcctcaacctccccaggctcacttgatccttccactttagcctcctgagcagctgggactgcaggcacaggccaccacactaattttcgtatattttttgtagggagggggtttcaccatgtttgtagagagggggttttgccaggctggtctcagattcccgggaatctgcctctgcctcctgcctcggcctcccaaagtgctgggattacaggtgtgagccaccacatccggcctggagtcctgtttagccttgggtctggctagcctgaaagcctggttattgtgtccaaattaaatctaaattcagttcttaacatcctaatgagatagatgggggtgatcattcccattttatgggagtagaagctggacctggggagggtagagggtgtccaaagggtcaaatgaggaaaagcagagccgtgctttgcattttcgcttctattttatgccaggctctgtcccgtaccctatggacataaactcacttagtcttcacattggtcctcgcagtgagggtggaggcaggtggtggaccctactggtcttgagctcagacctcagagccagctggctgggacgaatccaggatccctcatttcctggctggtgaacctaagaaaatgtctttttttttttttttttttagacagagtctcactctgtcacccaggctagagtgcagtggcgtgatcttggctcactgcaaccctctgcctcccaggttcaagcgattctcctgcctcagcctcccaagtagctgggattacaggtgtgcaccacacccagctaatttttgtatttttagtagagacgaggtttcaccgtgttggccaggctggcctcgaactcctgacctcaggtgatccacccacctcagcctcccaaagtgctgggattacaggcgtgagccatcgcactcggcctcctcctctgttcttacatgaacagagcagaaagaacacgacctcagtttttatccctccttgtccctctctgggcctcagtttcaccagttataaaaagagggattggacattgggaatgagaaggctactagcttcccatgtgcacaggccaggacagattctctgagcatgagtggaccttggctcctgccaagggtgttccgctacttcaagaagtatctagcctcctaacccctaaccccatgcaccaggcagcccattgggttgggtgggggggcgggggggggtggttgaggagagagaggtccctggccttgggatctgtggcccctctgcccagcccaactggctcatagcgtgggatgctggctccacaactggtttccctcagattggcagcctggagacaccagtacagctcagtcctataccaaggcagagctgctgactcttctggagtctcagggattgttgccactgcctttagggaaggctgccatgaaggcagactgtgttctaatgtgctcccaaggctggcaagcctctgcacccttcggtgagagcctgttggagggccggtgctgggaagccctctccccattgcactagcccaatgctctctttgggcagatagagaactcaggccccacgagaggcaagccttatccaagccacggctacagagttgaggagccaagagccacagagttatcggggatgggttggcagccaccttgttctttgggctaacaggggccagagcagaggtgggagtgggtgcaaagcagggagcgggagaccgggaggtggaggcagggaggccagggctctctcctgggtcctgagctgtccacattctgctcatcatggtggtgggaggggagttctccactctgatgctgtggataacctggggtggctccgggcctcagtttccccatctatccatatgaagttggactcaatccttctttcagcagaccctgcaccaagcccctgctgacttcaggctccctgctgggctctggagatgcatagatcaacaaggtsccccaggagcttgggattctaagaggggaaatttaggggtccatcctgatgtgggcgaggcattctctggatcaaagaagagcttgtcagacccaggatggaggggccctgagtctctcccggccccttggcgccccgctctctattccacggcctgctggccttttgtgtgttgcccac

SEQ ID NO: 12188 - DNA, 19818 bp, Homo sapiens
tatccaaacacatgcaactaacattctgttttctaatctctttctctagagcttcaagtttattaggtacaagatctgcctctcaagttattgcaggcaatggtttaactaaatgttttgccattgtagagcatggattatcgtctgtccagcctatggcgtgctacctgaccactgtttcatgctttctgttatgatagcactttacttcaaggcataaatttctgtaactgcagatatactgtcatgttgcagtagtatatcttgattagatgcactttttttcttttttctttttgagagagggtctcactctgtaacccaggctggagagcagtggcacaatctctgctcactgcagcctcaacctcctgagtagctgggctcaagtgatcctctggccccagcctcccaattagctgggactacaggtgtgcaccactacacccagctaagttttgtattttttgtagagggttttgccatgttgcccaggctggtctcaaactcctggcctcaagtgatctgccctccttggcctcccaaagtgtggggattgcaggcatgagccaccacacctggctagataccccttttaaaaatgagaataaaagtttttaaaagttgtatttgttaaactaaatgtgtacatttattttatcattattcccagcaatctcatattattatcttactggtttatatgtgcgtgttcacttttttccatgactrttttaagctcattaaggtagagactgtaataatacagtctattgcctgtgctactagccccaacaaaatgtatcatggctccaagcacatatgagggcatgaaaacatcttgctgatttggatgtttgaagaagtatagtattttaccacatttgaggctgtgtgtaactcattgctaagacaacagagtcttttggtatctctttttgtgggctcttggagttgactgtagtcatctcgctgtcagtgtgttgaataatggctccaatgcattattgaaactcttaaagctggtgacagcttagatcatgagtggtatagagccagtcagtgaagggttccaccatagtcagccgtgtgcccatcatatgttcattagtgtgtccctggtattagcacatgatttacattataggaagtgctcaatgaatgctagatgagataagaatctggatctgttgatttagtttgaactcagtgatagccagttaccagtctggcatcctgataagagttgtttttaccccaagggggaaaactgtgaccaaaggtcagtgttgcctcctgcttacataaagaaccattttgttctcccctgcaatctagcaaatcctcttgttttgaattcggtactcttggttccaactgatttattcattctttctttcaagagagctggtatattcttctatgcattgaggtacagctctgaatggaaaagagatcactgaagaaaatgagtgactcaatccactcaatttagtacacatttaaaggtctattgcacatgttgctttgggagcatgagtgatataagcaaagatgaaaacatggctcttgatttcatggagctaccttcactgtgcacatggaaggtcactcctggggaggccttgaaaattctccataagatgggcttagggggttcagtctggctagaaggggttggccaggggacttgagtctgtctttgcatagaatacactgtttaatctagattgtatatttgaggatgtatatttggagaaggaggctggtagagattattgggaagcagggtaaagttacccaaatatatgaagatcccagggaactatcctaaaacatgtatgtgagggcaagatacacaagtattggcacaagaggttgaggaagggaacaatgcctgaaagggtgatttgaggaaatctttttgtagaagttacacttctggttgttccagagagagctgcagaggattgcacaggcatggaggggagcagggtggatggaaggcctgtgatcacagaattttgatcggtttttcagggccttccaatgaacctaagaacaactttctcttcattttcttcatgtgaagaaaatggcaaagagttgttcgaacatgttacgctagaggaaaataactttgccctgctagaatgtgtcctgccttatgaaaagatgatgtgtaattttacccaatcttaatgaatgtaaaaaaagataagttactgttttttggggaatgtctgtgtatctctagggcacaatgcctgacacatagaatgtgtttaacaaatgtttgacaacctgaactgaactgagacaaattaactttttgcagatcatttaaatttcatgtcagagcatttaaacgcttaatttttttccttcaaaaattggaaacaaaaatatggcgctctcatgagaaaagattgtgcagaaagagccttccttcaccctgggttttctcacttatcccagcaggctgggactgtcctcactgtgtagaaaggaaagtttttcacccattcttgggaaattaggctactctactctagttttacttttgattacttgtgtaaaaaaaaaaggcaaaaatcaatagctaataggttatctcttcctaagcatatatgcccagtccagttggacacagatgtggggctcaagtccaaatccccatgtgcagcccaggattaggtggtaccctggaaatcaagtgggtgttcctggctagggattgaagatgatctcagcccctggtcagctggttgaaagcatccaaagtgcctccagtgagaagctgagattacctctttaatgagaaacactttgggtgtggtagggccaaccgtcaactggtaggcagtattcttgccacaggtagtatctggtctagaaactactagatctccaaatcctcttaaggtcccttacattgacaagaatgaattcaagttgcgaaatgacacaccaacttatacaaggtagaggatgtcattaaggcaacagtctcaccaagtccatgcgcagagctctgatcccaccgtctcctcccctcattctccaagtctgcttagttctgcccactactcttccttctcagcaacagttccagcatccagaagtcttgagcagccttctgcctcacaagttgggggtggcccaattaagaaacttcatggcaacttcaaggccaaggaaacaggctgcattggctgggaaggctcgggtcatcactgcatcagaccctttagacaaggatgtgattccttcatcccagatcagctccctcagcacatctccaaaactgttaggatatttcccaggaggtgcrtctggaagggatacttgagcacatcttgcgggactgccattgcccagttgaagatccctgcaatgcacccagccaccaggattcaaggcacactgagctcacagrccctctttccttccggagtgaagatattttttagccattcatttgtcatgaaatacrttccgctagctggaacrtctcacataagggtaagcacggtccctttgtagatgcctcggatctgwaactcctggtacaacttctttgcacagtccaagrttccagtgtacttggtttcccctgaagaaggctgaaagtgtaacaaggacttgatgggttctccaggggtcgcgatgcctgtggtgaatgtaccagataacatcccagctgcaaacagctggggatagctgagcacatcttctgggtgtttctgtcatagtttcttcctcaaaccaaacccaaagaagcacacagcaaagatgggggtgacaccgatgataggggcagccattcccttatatagccctgtgatgtcccttctaagagtctttgggagagagtcaaaggycccagagtacatgggaggctgtctaggcaaactcggtggctgtgtctgcagtcggaccttgacagtgtccagagggtgccccatgaacaccaggcacatgccaccaaagccactggccagcaggttcttgagcaggctgatgggctttggctggtcggctatggtcagtctgcctatccctcagtctgtcagttcctgggccgtcctggctctgctgccccagctgcagtgccagggctgccaatcttgcatttaaaggcttctacttgctaattaattttggttaaaaaaaaccattcttagagatagccaaggtaatgggcatttaagtgttgcatcaatgtgattttacatatatgtatatttgtccatggctcctggttcataactcccacagccctcgttatatcctaagtgataaaaataataagcatatcttttgttagggtatttagcttttttgtctttgtttcctgaagcagcttcagacagcttcagagcaataaaggtgaaaaagacagtcttttattgtaatgttggggcactttaggcctaagaaataggcctcagaaaaaagaatctccctctctgaacttctcctgcccaccttttctccccaagaccatagaaacagaaaatatcctgtcatctaacatcaccccccacaccttttgtcttggagctgaccataaagaaattctttgatttaccttgtctaatcataggccataagaccctcaattcaggaagggtcctcccctctacccaggaggaaggaaggctgctcagagaggccaagaaaaatctgaacaggcaggcctggctgaatttcctcattcaacctgttaatatcaggttataccctttttatccaatcacatttgtttacagttttccatgttgtaatcatgtctgcccaatgaagactccataaaaggcccaagaggatgggatacaaagagcctttggaccgctgaacttgtggaagttctaagaaaggtaaacagtaactcatccctgtgctgggagggtggtgcaccccagctccatgggaaagaacacttctgtgcttgtgaccctttcaaaccttgccctgtgtaccttttcatctggctgttgacttgtatccttaaaaatatcctttagaatatactggtaaatataaattagtgttccctaagttttgtgagctgttctaacaaattaatcaagcctaatcaaactcaagcggtttgtgggaacctgaacttgaggccagtcagtcagaagtcccagaggcttggacctgtgattggtgcttaaagtgggagcagttttgtgggactgagccttcagcctgtgggatctgactctacctacctggagatagcgtcagaattgaattggattagaagatgcttagctggcgttggatgcagaattgattgcttgctggttgatggagataaatgcccacatacatggtcatggaaatcttttgtgttgctggttgtggtgtgagagcagaggaaaacagtttgttttatcaacacaatgaatagtgattatttattaagcaccagtaggagtctaaccatggggttaaaaaataattagttcagggagataacaaaactaccagggtatatcatttctgaatttttcacttatgtcattcatttctttagttttgttttcccattcataaaatggaggtaaagatagtttagtaccaaggctcctctaaggatgagttttctcccatttaaatcacgattcatattgcgtgactggaaagtagaacatatggtccgtgacaagggtgttggcaatttgtggaagaacaaaaaagatttgacaacaatttctaacttggttcatctctgtagtaaattaaaaattttgctctgatttgtgggcaatgggggtggaagtagggtagaaggaaagaaaaatttggtccttttcctgtcatccctttctttagggtcccccttttgttccccttcgggaaatggaataaaaaaaaaaacccctgcattcgtcagtaactcygggtcaaccacaacttaaagacagtaagcaggtcaatcgaaacaggggcaatgattgctataaaactaacaggtactctcattgatagaacacaggcatacacaggaagatacattcacagaaagagcttcctgcacaaagtaagccaccagcgcaacatgacagtgaagaccctgcatggcccagccatggtgagtagcagcaatcattctggtttaaggactgtcatgcctaggatttcagaaaacagaatcctaaggaattaggtttgattggggtctttttggaattacttcttaaaaaacagagatgactttaattttgactcctgtctggtggagaaaaagaaaaaaataactagaaaagttataatggcataamaatgcagctcctggccaggcgtggtggctcatgcctgtaatcccagcactttaggaggccaaggcgggcgggtcacatgagttcaggagttcgagaccagcctgaccaacatagcgaaacccggtctctactaaaaatacagaaattaggtcgagcctggtggctcacgcctgtaatcccagcactttgagaggctgaggtgggtggatcacttgaggtcaggggttygagaccagcctgactaacttgaaaccctgtctctactaaaaatacaaaaattagctgggcatgggtcagttgcctgtaatcccagctactcgggaggctgaggcaggagaatggcttgaacctgggaggcggaggttgcaatgagccaagatcacgccactgcactccatcctgggtgacatagcgagactctgtctcaaagaaaaaaaaatgcagctcctcacccaatggcttttgcccaggtggtgttagtgtgtgcccaggtggtgttagtgtgtgcagtccttggcatcacagacaactagcatgttctttcctgtggccatccattatagagtcaggttggcctgaaattcttatctcatggtgggagcttggccagcactttagggattatgtacatatacattttaaccaaggaaactggggcctcaagaggtttaatgattcccctgagattacaggagtgccctggatggaagaaatgaaatcacccagtgttgactttggacagctcctagagaagggaaatttcccatgtctctgattgctatttatttattttgtaccatctcattcttcttggaggaaagagagatgttaatgcaatgaaaatctagccccagcaggtctggaatcttgcctgacattagtcagataaggcctgagaagaatttactatagaggtacatgaaaacaggggttaggaaatccygcatcatattattggcttagataatttcctttttttctccttttacaagccatacaacttaaaagagcttgaatatcataaaaggttcatggcatatagcaatggtatgttttattttatatttatgtgttattttaaagattacatgtagctcagcaaagtgccatatttaggggcataggctttgatgtcaggcagacctggctccactgcttgctaaatgtaggatttttgggtaagttatttatcttctctgtgcctccgtttcctcaactgtatggtggggataacaatggcatctttctcatggcatttattgggaggattaattaatatctttgagaataaatgagtctatactctgtactggcagatttgtgtatgcttaattttcagttaatttggccattctaataaacaacgactgataatgatagagaaagcattcagtaagtgttaactgttcatattaatattgttattattgtcctggaaattctgatcaatccactgaagtagatgggaatactttccactttatacagatgaacaaaagctcaattaagctatttatttaacattgctggatactgtaagcacaagaactggtacaccaatctaagctttctgtctccacatacagtatgcttttctttggttcagaggcaagatttgtgaatttaaagccattgcatccaagcaattctgttgggtagctttgtgctccatagctatttctaattctagtttccttaaagaaatctgttgggttgtcagcaagaaacataacagtgcaaggagcattggaataggattagaagttgagaggtgcaggcagataggacatcttcaataagtagttgaggcaaattctcatggacctagaggttggccaggtgcatgcttacatgtgtccacacattgctggtgagtatagaggatggatgttcaggttgctcaggtgagctcacattagagtgaggtgcaaagctaggctgagaaggttgttgtcctgttacagctcaccttcacctggtgctttcccttgcccctgtcccctattatacagattgagagcgatatctattcatctgctttataggtggcatataagagttcaagtcatgctctggatttctctgagaggtgctgtttaaatcattcttaagaaccagcaacagcctggttcagagcccctgctytgtattacataaccactaaaatctacagtttcagatcaaaagctttgtggagcaaattggagtatttgcagacatcatctgatttcctgataacgagctatgtgacctacaacacttatgcacatctagtacagctgtcacattacctaaaacacttagctcttctaatgagacaaaactaagattaatgttggtaataataaaaatgaccttcaatgacaatagcactgactactgacacctaggtttgagtccccagactggtactcataggctggtgaacccaatcaagttatttattccctctgggacagaactctttcacctgtctaattgggataattaatactagctctgattacctcaccaggtagttgtgaaaatccagtgtttaaagagatgtaaaagaattttctaatatactctaagaatatataagcaaatgtaataatgacttgttagaagcattgtaattattgctaagtcatataactccaatgtatgtatttaaaagttttcataatgaaaattaatagtgattcagtgagtatgacacagaagaggaaagagaaaacacaaaggaggaatttacttaagaaccctaaatatgtgattggtaggcttgggaagttatctaagaccctctaatataagttggcatcttttaaaaaaaaagtcatagcaggccaggcgcggtagctcaggcctgtaatcccagcattttgggaggccgaggtgggcagatcacttgaggtcaggagttcaagaccagcctgaccacatgatgaaaccctatatctactaaaaatacaaaaaattatcaggtgtggtggcgcacgtatgtaatcccagctactcggaaggctgaggcaggagaatcgcttgaacctgggaggcggagattgcagtaaaccaagattgtgccactgtactccagcctgggcgacagagtgagactccatcaaaacaaacaaacaaacaaacaaacaaacaaacgccatagcagtttgtcaagacaaggtatatgagtgtaaattccacatctgtctagtccactgtgtagtacaatatagagttagcaagagtcgccagtattggatacttatcatatgctgccagtgttcttcataatttatatggatcatctcatttaatcttcacattttttttttttttgaggaaacagagtcatagcttctaagagtcctggaattgagttacagaccctggacttctgactctgaagcccatgccctgagctaccacactgtaaagtcaagagctagttgttgaatgaatgaacgattgtgggggatgaaagttgatgattgctgattatctaaaggcaaatcagcctcattctgactcttctgggtcaatcttgctttcaacttctttttagtgtcagcttcctcagtatggcaaatggacactatgacctttttgtttactcttattgttttttgtctctagtatctgcaaaatatgaaaaggaaggcctttgaaaccaacatgtctaatcaccttccctaccttaactcatggaaggtgtgagcctgaacaacgctaagcctagagaataaaagcaacttattttcagctctttttttttttttttttttttccaagcaggagtctcgcactgtcgcccaggctggagtgcagtggtgcaatttcggctcactgcaacctccacctcctaggttcaaaggattctcctgcctcagcctcccgagtagctgggattgcaggcgtgcaccaccacgcctggctaatttttatatttttagtagagacgaggtttcaccatgttggccaggctggtcctgaactcctgacttcaggtgatccacccacctcggcttcccaaaatgctgggattacaggcgtgagccactgcacccggccttcagctcttcttctgtattatgttgagagttggtgatgggccttgctcatccccagtaagggtcagtggcaatggtgggtgagcaaagcatggttgtgacaaagggaatctggcaagatttgtagcttttcttttcattaggtcttcagtgcactttcattctttgcgcattcctataacaccagataaactggcatttcaacgtaagtataaaaaaaatgctccagagctaaagagaaatagtttccatattctctcttgtggtgcatcattagtgccccggtttctttcaattagcatggataattggaactttgctatcgttggttttgcgtaatgtttttcttaatgcagtgagcttaactatatagttcaatttagctgtatcattttgttcattcattcactcattcactcattcattccaaaagtgtttatggaaaatgtgtaatatgcaggaacttacaatctaatgggtgtagatctgacaggaacacaaatactacatttctagacaattaaaaaatgctgcttgagtgctagatgatcaaagctttataatttaaggataataaacatgcttctgattgaaccattttagggactgttcttagaggagatcacatctgagctgggccttaatggaagggtaggattttgacagacagagtattctaggcagtgtattctaggtagaggggtggctccgaagaaggattttgtgggagattcatgggatatcaagttggaaataaaaacaagagctatcrtttattaagcctctatttttcttatacagatttataggtgttttatatagaacattctatttaatctcattaktagtctcataaagtgagcattattatccagttggaaggaagagaaactagaggctcagcaaggaagccaggataggattttaactcaatctcagacccttgcatctttctgtctcactgtttgggagcttttagactatggagggcttcagttactagctaggctactgagtttagttctcagtttggcaccttgatacctttaggtgtgagtgttcccatttccaggtgaggaactgaggtgcraagagaagccctgatcccataaaaggacaggaatgctgagttccgccagaccatgcatctcttgctagtaggtgaggcgagtctctaactgattgcagcgtcttctattttccaggtcaagtacttgctgctgtcgatattggggcttgcctttctgagtgaggcggcagctcggaaaatccccaaagtaggacatacttttttccaaaagcctgagagttgcccgcctgtgccaggaggtagtatgaagcttgacattggcatcatcaatgaaaaccagcgcgtttccatgtcacgtaacatygagagccgctccacctccccctggaattacacgtaagtgcaaatgagactgattttcacattctttggaaaaatatgttaattcattctaatcataaagtagaaaatgtagaatacatagaaaaaataaaagggaaaatcctcttaacaatgaaaatttcactttacctgggagctcatatctttcttgttttggactaggttcacctttgtggttgatggtcctaatattttgcttccacgttctcatagactttgtgcctttttctgcttcatgtagttctaggatagaattcacaaattttcctgtgttggaagagagggttctttaaagcagattgcataattatctcctcatgaggataaatgggaaacagaaaagtcggtttaaggagattcastcagattagacattatcatttaaggagtgggaatgagtggaggagaaaggccagtctgggaaatgggatgttaggtggagaccttcagggtacagtcttgtaatttggcattaagatacaggttcttggaagaccaagcactccctcatactctccaaatgtaagtatcaaagtagattccagggacaattgaagtgcttctggggttgtcacatagcttctcatgtgagtgtgttatgagaaaaccttgggacggtagtrccccctgcctcgaactgggaagatatggagagatcaaagaatgacttggacaagtccagcttagcgagtggatgagtttattaagacttactatggggcgccctagggccacagcaggacagatctagagatccgctctgcctcccatctctaagctgctcttaagcgaattttctggctctttgcctactgtgtgtgtccaatgggactgttttccttggtaggttctcagatactctctgagatgtttgggttctcrgtggcctgctccttggctgtgcatggtggccttggctcactgcccgtccttcagggttcagacagtggacacacaccctcaagtaacctggtgggggtcctgtcacactacaagtggaatatgtacaatggcaagctggcaggataaatgttgtggtctttatgcctccaggcagaggggcctattaaaggagaaatggagagaaggtctgagattcacagacctctggggctgtggctttcctttccaagcagcaggctctgtagaccgactagtgatggaagactgactagtgacgttcaatctccaggcagagaataaagaattgtaataataataataataatgccaatgaaagatctaatgttaattgaatgctaacatttgtacagtggggtattttatatgtacttgtatcactgagtattctcaacagttgcatgagaaaatggtatatgaaaatccccatcttatagttgaggaaactgaggcttagaaaggtaagccactgccagaggctggtgtatgcttccaggctgtgtggctccagaacctgtgccacagccctgcagaactgcctccctgcaggtgaacactcagtgctgtggggctctcattcgctgtcttcctcccccatgcctcaccattgtgctttggcttgctcctcctgcagtgtcacttgggaccccaaccggtacccctcggaagttgtacaggcccagtgtaggaacttgggctgcatcaatgctcaaggaaaggaagacatctccatgaattccgttcccatccagcaagrgaccctggtcgtccggaggaagcaccaaggctgctctgtttctttccagttggagaaggtgctggtgactgttggctgcacctgcrtcacccctgtcatccaccrtgtgcagtaagaggtgcatatccactcagctgaagaagctgtagaaatgccactccttacccagtgctctgcaacaagtcctgtctgacccccaattccctccacttcacaggactcttaataagacctgcacggatggaaacagaaaatattcacaatgtatgtgtgtatgtactacactttatatttgatatctaaaatgttaggagaaaaattaatatattcagtgctaatataataaagtattaataatttaaaaatacttcaggtgtttgtttgcattcccagcttgtactcacagactgtgtagccctacacattttggaattctatatgcctatcatttgtttttcatatttcctcatcagagcaccagtgttagagttgttttgttattaatgatgcttggaggttggttacatagagagttaaggaaaatggtgcaaacagaactcaggttccctagtgacactttcctgcttcattatcccaactacattattttacaaagcaagtacttcttggccactgtgctagccagtggagacacaaagaaaagtaagaaatgcatatggaagggccatgtgttaatagaggccatccaaagagcccctggtcataagggccatggtggccactttgtttcctcctctgacttctgggccctttaggggtcactgtttgtcttttgtccatctctttaacatcttaggggcacgcaagcttccagattttgatctccatgccactctgaggaaactcagaggtcttctggtgcttctgttgcacaccacattttctcctttacttccagcatgccactaactcagagcacgtcggcaatgctgctgcctcccaggtaccagagagaaagtgggctataagttctcactcccacctaggacttggcttgaggatgggcagtcagcaggagcctggctcccattttgacctgtttagtctgttggtgggtgtggaatgggagtggttggggaggcgaactctttctctatctctttgctccagaatcttgtgcttaggatataaatattgacttttgtacttaaaatgttcaggttcttaacatgtaaaataccttcctctcatagctatcagcttcacaattttgctctgaatttcacaagttcattgtgatgctcacatctgtgtgaagaaagttttctgttcgtttgggcagtaatagctgtaccctaggggtagtgcatgtaaaaagccctctgtctgagtagtgagggaagcataaaggaaatttcagggggaaaagaattgcaccactgagtgtatcaagatattatctcagcccagtgtggtggctcatgcctgtaatcccaacactttgggaggccaaggagggaggattgcttgagaccaggagttcaagagcagtctaatcaacacagatcccatctctctctctctttacacacacacacgcacacacacacaattagccaggcatggtggcacacacctgtagtcctagctacttgggagactgagatgggaggatcgcttgaactagaagttggaggctgcagtgagctatgatctcatcattgcactccagcctcggtgacagtaagactttgcctcaaaaaaagaaagacattatttcacatttcattacacatgtacacatgtactttcaaggcagtgtgccaaatactgtaatcaaggtatgaaatgttaggaagatataggaaattcctggaaagtttcagaaacaagatgacttttgcactgagacgaatatgaattgatttggaggaagatgtgggaaaggcattccaagcaaatgtaacagcatgagcaaaggcaagagatacaaaaaaacctggtatgctgggggactgaaagtagttctatttgctcaggatagtgtggacatggggacgcggtggggaacacataacaaatatttctttaatgaataaatgaatgaattcacttggtagtagacaaagaacagtgggcaaatgggccactcatggatggttttgtaagctccgttacaggaacaacaggagtatcgctatatttcacaagataactttggtgatagagtgcaaaagagatcagaaatctgaaggccagtgagaagatcggagagaaagcaatttcactccgacagcacactcacatttttagagctggatgagcccctgtagatcacctggtcaatctttctcatttgcaaatgtggcccacaggaattaggcgacttgctcaaggtcacttggtagttagtagcagaaacaggttcgttgactccaagttcatgactttgataagggttttgcagcaatgctgtagtgtgtgcaataaagacccatttcagttatttatgtggcctcaggctggccctgggagagagtgcagaaataaccccgcaccgcacatctccaaagacatcgtatgtggtgctctggagcctggggccctgagtcacaaagcttctctctgtggcttctgcactgagggttggctgtccttcaggaaactgcacgtcttctcctgctcacaaggtggcgaactgtgtccagttgttcccagattcctcagtatacgttgaaaggaaagaaatgactgttttatgggtaatttgttttatttggtgactggaagccactgctgaggcagagtgcgtaggctgtgttcttttgctctgcgctcagctttctgggagagcctttgtttttcctgtaggagaagtggctgaagttgagcagtttaggtgttcaaatacaacgttgcttcatcatgtgtggagagagaaacctttctttccacgtggaaacttgaaagcatatagtcttttctttcaacatccagttctttttgatgaatgcttggctaaggggaaaaaaaccaacatattctttctctgtctctgtttctctcttcctttcccgttccctacctccccaaatttggataaaagtcacctatatatataaagctctgtgtgataaattttacttgtaagttacagtgagaaaaatagtaagttgatttttcttcccccactcccttccctaaaaggagaggtagaaaatatgcatttaatatgtagacagcttttggctttgaatcctggttctaccattttctgcttgtatgaatttagtcaattttgtccttctgagattcagcttcttcatacgttaaatgcaatataatatctattttaaagagctctgtgtaaagcaatcgaaattaaaaaaaggtaaattacttaatacagtaaccaggtaatagtaggcttggtaactggtagtcattatttcaagaggcacaggaggacttaggtttcccattttgcttggcccaaagaaactcagaacccatttttatgtctagataccacagtttgctggcagattaggcattcataaaagaaaaaaaaacacagttatattgttcctcatggttttcaaatttgctttctttatttaatttctatacatataataatatagtatagtatatatagtgcaggtatatattagtatatagatcctgtgtataaatcaattttccatctgtgaaaagttaagaaagctgtagattcaattcattaaaaaattccccctggacccagatrtctatcgtatcccactccgctggtataaattggaagaaaaatatttttagctcaattagttttaggagtgatacatgttcagctagataactgtgtgctttaaaaattgtgacctatttctggctccctgccagttcagtgggtactgattttgagaattttgttcagtagtgaagaagaacatatttcaaaactaagataaaaaatgatcacgatttgagcatcaagatgttcttgctggcaaaatgttgatttcttcccttaaatggtacagatgtcatggcaatatcagagagcaaggcataatgacttagtgtgtggacgctggagccagatgccgggttaaaatatcagttctggaccttactagctgtactagttgctaatgatttgggtcttgttacctagcctctctgtgtctctttttcctcatatgtaaaatagagatgataatagcgcctacttcataaagtcattgagagaatagaataataatctataaggtacttggaatagttactgacatggtaggtgtattgtttagtgtattattaagaaagataaaatccatctattattctaccacaataatagatcacattaatgtttttctttctcttctgctcatttgcctcacagatatatattttataaggctgtaactgtaagatacatgcaatttgtatttggtaatttttaacttcacattatactctatgtatttccaatgtttccataaagtattcacaatgatttttagtagctgtgtaattctttcaagttgatgaaccagaatttatttagttattcttttatttttggacctttagctccaaaaataaaagaataattattaactttaaaaagttaaataatgcttgtaactgttttaattactttttaaaattataaactatgtgatacaaacagaagagtttatgtctttgcatatggatagttgccttgaatatcaaaattctgtacgcgtgtgtgtgttttcatatctatggcctaccttggggcaaattagttaatttctctgagtcttagtttcctcaactataaagcggggtgataatgtctgtctcataggattgtaaagtggattaaaagaaataatacatgtaaagcatttagggcagttcccagttccaacgagctgttttagtcttagtggttatgcagagcctgtgaatgaatgtttccacctttaaattcttgttttgaaagccaaagaaatcaatgcattagacaaaaatgagtttatgagttgttctggggttgtggctgtgaacatattcggagccttctgattccactggcttacctctgtggttttgttacgtgctatctataggtgacacaccgcagccctttgtatggcctgaggtgaggaccagactttgtttatagtggtgacaacaccagaagccctgtaaccatttcccacaaccacattctcatggctttgacagaaatcagctctgggaggcactgcttggatggggcgtgcaggctgaacgttggagtgggatctaagtgcgactgtcccccttgtaagggacaccatgctcatggaaaagtgcttagtattctgaagatactaatccatcaggcaagagttccccagggtcccaggcatctgctgatctcacattcctgggcttctcaacctctaagggaaaaaacactcagacttcccacagaccacttgtcaaaagcctgtttgtcttctgcggtcacctcaaaccccaagtgggatccattaagaaagcaaggtttgcttctgccttttgatattgagtgtgtctacatatgggatgccaaacttctggctactgtatttgaaagtacagaaaaaatagaattaaatataaaagaaaacagatctttctgttcggatctgtgttgctgagctttgtgagatctattaagaactatgatttcggtttaagaattggaatgaattgtggttcttgccatatggaaatgagttttgctgggtgaagcaatgatataattacttctactgtacagtagatgagtaccaagggattctccatgattctcattagtactagaatgctttgtgataaaagctaacacttgctcactggttacaacagaaaacacacttctaacttcacatgcatgcacttaattaatcatcatcataactctgtgaggtaggaaatattaaataggcccattgtacatatgagaaaattgtggcacagattgagatagtatctttcctaaggttataatagtgatatggtggtagacttctgcatttcatcaccaagctccattgccttttgtgggagatctgccacaaatcacttccctttgtgagaggctctaaaccatggcatcttttctgaggatcactttttctgtgaatggtcagggagagcaagctacaatatttgcttagtcatacaattacgacattttaagctttgtggaaagctcattagaaagctaaccaatagatccttgggttggccagcttccatcaatatctcaaattataatggccctcatcttgcttgcctatgggaagtccagtcctttaccaagcccttgtccccagggttttctgggaagctttaagcaacatcctc

SEQ ID NO: 12189 - DNA, 15688 bp, Homo sapiens
cagtttaaagtgttcttaccctaccagtactagttccggctgtgaacttccattcctgggctttggctctgataagctgtgactccctgtatctgcccatctattgctctagttttcagggtagcagtttgccctgtgacttcaattctctgatgtacttaagagtaacaaacctgcacgttgtgcacatgtaccctagaacttaaagtataataaaataaaatatatatataaaaaaaagaagagttgttgattttcagttcgttcagcttttctcttgctatgaggatgggggtgatgacttccaagcttcttacaagtcagactggaaacggacttttttacacatggaagaagaagaagaaaaagaaaataagttgcactctgtattggttgaaattcttttaaaagcagagcctgaggcaagaacttgctgcaagtagttaatatgaaaagtgatccctgagggcaggagtgagagattggtaaagtgaatcaggaacaggagaaaagttcatttacagagtatagctttggcctgcttgtttcctgacattggcctgatatgggggtgattaaacactctgcatatgtagggtacctatgttcaccacagccttggaacagagcagaaaaagtcctgcctctgattttaagaccatttgtgctgaaatagaggaggtggctgtcaagaataggagtcggggtctctatttgcagtggtctcaactggtcacctctccagggcttagctttcattaagctcacagacattctttctactaaaaaatatccaaatgattgtctgttgaggcaaattccacatctgaacaatgggcctcaagaggcctgaggcccagcagattttcacagaagctgtgaaacaaacggcccctttggaaacttgtaagtttttattttagttcttttgattttatacatttcttcttgctatttctcagaggttacctttaatctaatctttgccctcctgaatggtgttcttagcaggcttagcccctaggcctgagtagcagttggctctgggtgtcacacttcattttacttcttgtttcaccttttacagagcagttggccaccaagacagaggttggacaagtgtcctggggtaagagctggccttgccagccaagtgccatagacgttcatctctttcagtcagatacccaccaattcttatcactcttgtctagcctcctttcttcccaagcctaaaatgtccccaagaagaacatatttctatgtgttaagttttgtgctagccctatttgtgatgggtcatatgatattccaaaaatgggtacatgcctaaggttccaaaaactgaacttaagccttgattaacccaaatctatcttgacttcagtttttgtaatttgttggactattgcagaaatggcaaaaatgtttcatataccaatcagtttctagtggctgcctagaaagctgtgatgagggaaattcttaagtaacacccagaccccgagggaaaggtgagaaggttgattggcaatgtctgtcttacacaagaaaaggggagagacattgtttgccatcccaggattataagaccttgtagattcatttcagctctgaacggttaagaatctaaattttgctatgccccgcttcttcagaattcatcagtttttttttttttccagctgtctcttagcagttgtttaaccaatctgggataaaccttcaacagttgaaagctcgaaggttgcaactatcacaccgcattccttgggtaagtcattttcttcactgggtctcagtgaaattggaggggctgtcacaagatatctaaggtctctttcaatgaccaagtcccgcaattctattattctggagttacaatgccttggtgaaaacaaacaaacaaacaaacaaaccacccaccaagtggcttaagtacactgtagggttgcagaaggggctgtattttcttcttttccttctctttctttttccgttccttcttggtaatgaggaaggtaggtagtgggcttcatccagccctcaaatctcaaagtgatactgtaaaatatatatttgatcattgactccatttcctggcatacaactcttaaaatccttagaatctctgaagagatctttttgtatgctaatgaaatgacaggtggccggcagctcctaggtcgcttcaggatgagagctggtcgccagaaagttccaggcagaattagagtgttgggactttcagtctcatcccctaatctctaaggctgaagactaagttcatcaccagtggtcatagtttaatcaatcatgcctgcgtaatgaagtctccataaaagctccaaatggacagggttcagacagcttcaggatagcccaacacaaggaggctcctggaggatagtgtgcccagggtgggcttccatgccccttcccatacctttccgtatgcatctcttcatctgtatcgcctttaatacctttataataaactggcacacataagtaagtgttcttctgagttccatgagccactccagcaaattaatcgaacttaaggagggaatcctaatgtataaccagttggtcagaagcacaggtaaaataacatggggctttcaactggccccaagccccagcctgaagttgtaggggaacagtcttgtggactgggccctccacccttgggatctcatgctgggttggggtagatagtattagaactgaattgaataagaggtcatctagttggtgtcctctgcagaattaagtgactgcttgcttggtgaggaaactccccacatattaggttagaagtcttttgtgttgattgctactgagtgacagaatagaaaaagcactttgagtgtgtttcttcaacacatgttacccttaatcttcctgctgaacccccatgcaaaggaccaggctgacctgaacaattgggtatatcaaagggcacacatgaagaagaggcagaaggaaatcatgaaggcatgcaatgcgccggatcaagctaccttttgggaaaaacagagcatttgaggtgtcaggggtaaggggactctctgaaggtacactctgaagatacagaataagtagagtggacttgggatcctaaacccagcggaaagtgaagagaaagggtagagaaatgatttatgcatgggtggagcaagagagcagaacttgaagccaggccctgtattggcactaatttgctgtgtgaccttaggcaagagaccttattcctctgggtctcagttttcttttctcttttttttttttttttttttgagacggagttatgctcttgtcactcaggctggagcgcaatggcatgacctcggctaactgcaacctctgcctcctgggttcaggcaattcccctgccctggcctcccaagtagctgggattacaggcatgcgccatcatgcctggctgactttgtaatttttaaagtagagatggggtttcatcatgttggtcaggtggtctcaaactcctgacctcaagtgatctaccctccttggcctcccgaagtgctgagatcacaggcgtgagccacggtgcccagcctcagttttctcgtgtataaaaattaaagggaaaagggataagttgatttctaagggttttcccaactctaacatcctgtggatccaattacaagttcttagagcttcctatatcatgtgtatagacacaggtatccaggaagggaaggaaagagagagggtgtctctgagtcgctgacagggcacatggaagcctagaaaacccaggaagactgaggctgatcctgtctcagacacagaagctgtagcgggtgttctaaagacctaagtaagcatcctgcttgtcctatctcccctatttgaatttaagccccaggaggacaaagcttactctctggaatctccgcgttttagacttacaagtgtctttaaaggtcatctcatctcaatcccttaccccaaaatgggaattctctgtatcctaccactgaaagacggcccccacacctgtgcgtatttgcccttccacataatttacagagtggagggcagagtttgataatcccttcatgcagctgacctcctgcctcaggacccaggaaatctccctacggttcctctgacactggctccagtgtgccagcctggaacctgaaatgccattctcagcttctcttcagggagtgaggtgggcggacacatggcaggttttggagtcacacagacccgggttcaagtctcacttccactgctcgttaactgaggggatttggacaaagtaccccagctttctgtgcagttaacctgcaaaacyccaagaataatccttcgcgggactggtgaggatacatggggtgtaggagatgagcattaaacacgtgctcccctacgctgctcctaacctccctgtctccacctgggtgtgagcatctgtgggggcaggaattgtttcttagctacaggatactcttttcccagtgccaaaaacagtgcttttgtgtccggaattggtgggttcttggtctcactgacttcaaaaatgaagccaccgaccctcatggtgagtgttacagctcataaaggcacagtgcccagagtttgttccttctgatgttcggatgtgttctgagtttcttccttctggtgggtttattgtcttgctggctcaagagtgaagctgcagaccttccsggtgagtgttaacagctgataaaggcagagcagacccaaacactgcgcagcagcaagattcattgcaaaaaccaaaagaacaaatcttccaccatgtggaaggggacccgagccggttgtcagtgctggctggggcagcctgcttttattctcttatctggccccacccacatcctgcagattggtccattttacagagagccaattggtctgttttacagagagctgattggtccgttttgacagggtgctgattggtgcatccacaaaccctgagctagacacagggtgctgattggtgcatttacaaaccttgagctagatacagagtgcccattggtgtattcacaatcccttagctagacataaaggttctccaagtccccactagactcaggagcccagctggcttcacccagtggatcccrccccgggggcagcaggtggagctgcctgccagtcctgcgtgtgtgcccgcacttctctgcccttgggcggtcgatgggaccaggcaccatggagcagggggtggcactcgtcggggaggcttgggccatgcaggagcccagggtggggagactcaggcatggcgggctgcaggtcccgagccctgccccacagagaggcagctaaggcccagcgagaaatcgagctcagtgccggtgggccggcactgctggggtacctggcgcaccctccgcagctgctggcccaggtgctaagcacttcactgcccagggctgggggcctgccggccgctccgagtgcagggcccgccaagcccacgcccacccagaactctagctggcctgcaagccctgcatgcagccccggttcctgcccgtgcctctccctccacatctcccagcaggctgagggagccggttctggctttggcctacccaggaaggggctcccacagtgcagtggctggctgaagggctcctccagcgcggccagagtgggcaccgaggccgaggaggctccgagagcgagcgagggctgcgagggctaccagcatgctgtcacctctcactttgcctattataaaaaatgagagagagaaaataaaagcgaatttatatgtgaccccagaatctagaacagagctctttatctctctctcagcaaggcctattaactaacacagttttgctgctgtctgttttcagaacaaagacttgttctgtgtactcagtctaaaatgaaggttgaaaaaaacagctcatgtccatacacagaaacagaaactgaaccgaacaccgaaactgaaactgtttgtctcttcctgagaaacgagcaaacctgaaagctactctctcagcttcagagggaaaaaatggttgtagatttctggacttgggagcagacatttcaagaactaatccaagaggcaaaaccccgggccacatggacgctgaagttggatggcaaccttcagctagactgcctggctcaagggtggaagcaataccaacagagagcatttggctggtgagtgtgggtttcycaggcaatagctcttctgagaagagaggctcaggctcagcttagcatgatttattcctctgagagcttgttgaaggagtaaatgtcaccagggcctccatcctattgtggtcatagtactctttagggtcgacatgataagacgactccaaacctccattttgtttaactgctggaagtttcttcttttactaggtttccctccgtaaatatttctggaaaaccctggagaaggctccctattccataaattttcccttctagtttctcaccacgtcatttgttccagactacctctagagtcttttgcagtctccccagcagtcctgaccagcttcccccagctgcaccagctctccaagccttggcactgttcagtacaagcctgggacggagcctttttttttttttttaaatatcttaagaattggctaagatcaagcagttactctgaacattgctttactgaaggcctggggataatagtatagaatgatgttgcaaaaactaaatctaaaacccagttcatggagtaaccaagtaatactcctcccttactcaccacttccctctttaacccccagcaagcctccaggttgcaggaaccagtttccttgaccatgttaggagggtgagaattgctgacctggataatcaaatttatttttaaatgacacacaggaccttcggtatagttttcatctgacctattactcagcttgcctgcctgccccatcctgcctcaggtatggcctactccattccttatggactattagctatgccatgcatcttcagacttccacactcttgttcatggagttctgcttgttcagcagaccctcccctcacccctccctgctcatccttcaaggcccactctagtgcctcctcctcctaaaagcattctctggttctcctaggcagagtaagtattccttcgtatacattcccataagataatgggataagataaaatayatatgtatatgtatacataaatgatatataattatatatacatytgtactatgtatttcagaataataaatttataaataatatatgtattattatatattgtatcaaatacagtatatgcttatttttagctgcagaatctgttgtttaaataaagcctcctaaacgtctccagaacagttctcaagtcacttgtcagagcccgtatagcagtcatgttgctctgctttctaatccagggaaatgtgtaaatatttctgtccacaccagccagagctttttgagggactcatgatgtcttacaacgttttggcactcctccaaacagaaagaaggtgtktctcctgttgggatgatttgatttgattgtcatttcgagatcggaaaagcaacctaccagtgtacttttggaaaatatcaatcagcttttgaaaagcattttgtagtttacaaagtgttttcacatacatcgtctcttttgatgctgccaatataacccttgaattttttttttatggattcaaacaatgagggttatagaagggaagggctttgcccaaggtcttcctgatgtaaactggatcttcaacccaggtatgagggatgcagtctgtttctccaggtgtgagagattagctacactactcaccagaggcaacgtgttacagcaggtaaatgagwtgaatttcagatggcctgagattagcagcatgcctctaacatttaccctgtgtgtccttaagcaggttgcgtatccttttcatgattcagtttccttatctggatattgggtttaatagtgcttacttcacagatgaaatgggataaaattataaagaccaattatattgtatgcatcaaaatagatactttaccaaagctttctatgaccaaaattaggaataagtttctctggaagatggcagacatgattttccctcagaggcatctggagatgttttactagcaaagaggtagacttgggtgtaacatatgggtggatactcagtaggtcacaggaaaaagccttatctgaaacatagtccttcttgttcctgtttatcaatgactgggacaatctaaatcacatgcattttttcaaatggaaaaggatgttagtgacaggggccaagaccattttccctcaggttaacaaccagatgaaggcataatgggtgtcttccttctgactgcaggttccggtgttcctcctgccagcgaagttgggcttccgcccaagtgcagattctgtgccacacgtactgggagcactggacatcccagggtcaggtgcgtatgaggctctttggccaaaggtgccagaagtgctcctggtcccaatatgagatgcctgagttctcctcggatagcaccatgaggattctgagcaacctggtgcagcatatactgaagaaatactatggaaatggcaygaggaagtctccagaaatgccagtaatcctggaagtgtccctggaaggatcccatgacacagccaattgtgaggcatgcactttgggcatmtgtggacagggcttaaaaarctrcatgacaaagccgtccaaatccctactcccccacctaaagactgggaattcctcacctggaattggtgctgtgtacctcgcaaaccaagccaagaaccagtcagmtgaggcaaaagaggctaaggggagtgggtatgagaaattagggcccagtcgagacccagatccactgaacatctgtgtctttattttgctgcttgtatttattgtagtcaaatgctttacatcagaatgatgaaaataggcttgccactktctcttattttaattccatggtagtcaatgaactggctgccactttaatataactgaaaattcattttgagaccaagcaggatcaagtttgtagaataaacactggtttcctagcyatcctctgaaaacagtatgaaacmtgaccaagtacataatggatttagtaataaatattgycgaattgctaaaaagtcttcaatcattcattcactaagtcactcagtgatatcaatatacttagctcagaaagtgtgggaggctgaataatggtgtctcccaacatatgcatgacttaatccccagaacctgtaaacatgttactttacatggtagaatggactttgcggatgtaattaaggaccttgaaatggttagattatttcataytgtccgggtggataagaaccaggattttgtaacagggaggcaacaagctcaaaatcagaaaaaagagatttgtcaatggaacaagaggttgaagtgctttgaagttggaggaagaggtcacaggcaaaaaagtacaggcagcctttagaaacccaaaaggacaaaggaacagattctcccctggagtctgcagaaggaaccagccctgcctgcacatggctttagcccagtgacactgattttggacatctgaccttcagaactgcttgctcataaacttgtcttgttttaatgcactaagtttgtggtaatttattagagaagcaataagaaatgaatatagttatcaatactacagtatgaatcagggaattatgttttaggtatgcttcaggtttgatagaaaaaagagcactttatacattagaaataccagtcagccccatctcctcttgttcttctttctcccctacttaaacccactcaaatatctccatctcaaagagattccctttgatttgatgatccttggagctatcatattctcacttctttcagcattggattgggaatcacagaagaacttgccaatcctgagatcctctgatgcatccttcacctcctattttcatctgtctgctaggcatttctgtgtggctgtcatgtttaaagccaagctcaacgcctctgactctcctgttttaaatcccccaagtcgcccaaacttttcacctcagagtcatcttcaacctctcctgatcagcaacacttattcccttcttttgtcaagttactcccatctcttccttctacttttccttgtcatcctctctcctcacctagttcaaaattattgaaaaacgaggggatttggactttatcccataggcaatgtggagtcattgcaagcatttgaggatatgggcaagttgagtagaaccacatttttaaaataccatctattttttgggaaagaatggagtacagaatagaaatagtgagaagtctgtcttgcaatagaatagtgggaaacacagaaagagggtcctgtacacaataaatatcttgaaagaatttgaagacaaatataagcgaccaaaagacctaaggatgaaaatatctcccttctttctgcccatctcttcattttatttcaggatccccctaccagtgctctctctgtatacataccccctccccaaaccaaaccacactattgaattcctgaattcctcctgttttcttcacaaagaacattggcctggggatctacatgaaaatattatttatagcctagcaatgctgtatgacctcagcaagtcataatcccttccggggccttagtttctccatctataaaataggtgggggtaaaacatggagagttgatcacatatatttacctctgatctctcttgaaaccacactgagtgacagcaaaaggaaataaaggcatcaatagagaagggcaaggagaatggttagaagatagaacactgatggactagtggcaggtaactgacttagcagagtagggtgagccagaatataagtttagtgtggaaaaaccaagatgtgattcatgttgcacaattccagaaaggctccagactgtaggatgaagtagctctgaaagtgggcactgggaaggcaaaagtgggagtgttggctgaaagactataccaaatttctttcccctctccgaggcagcctcgtaaccacactttacccaactgagggagaagaatggaggctgcttctctgaagacatttctcatagggactatggctcagggaaatccttaagagaggaggagccacaagcaatcaaaaagaccatggttgttcacatactgactaatgagaccctcttaccccactatcagcccttggagctgttttataacctacctgcccatccctcatagacacataacagtggaggactccttttctagaaaaatggatctgctcaagataaaagaaaatatgtacattgaaagggggtgggggccccaattccgataacctcagagtgaacccatcggatggaatctcctccgccagagcttgcaggtggctttttaaggtctcatatttgcaccttaaatgtgactggacagactgccaagggattctcaaatgtttgataaagtcccctaatataaaggcaaagaagaaaaaaggttaaaacaaaaaagactctgaagaaatagagatgattacaggataagaaagccaaaaaaacatttaaaaagtaaaactattatacctcagtgaggtaagagagggtataatattcattagacaagaattagacatcatcctttgggataaccctagatgagacagctacctttggctggaatcagatctgtggtagagtctcagctacaagcatccaataggcaatgttcccaaaagcttggacaatgagcaccttagtcctcaaggaagtgatgtgagtggtgcaccacagcctccactacaatccacatcttgcaaaactcaaatctacttgctttgtataaaaagtctacatctggagaaaggtcttctgggattcttttctggcagaaacatacaagaggaaggttagtggataaatttagcccctaccactgcatctggtcttgggacagcagatgtacacccataatctcttttttctacctccagttcttgattttccttatcctaacacctctgctggtttaagtggcttacctataaggctatccaaatgcttatcgtgaggactgtgagccctgggtcaccacgtccttctcagtctgtggcttcttcccttgtccatctattaaatattatcaaacttagggaaataccaagagatgcgccagtgaatcagttgggtgcaaacatattcttcccacacccattgtttaatagtagtcctatttccctctgatgatcaggaagataactcttttttgtttaaacttttattttaggttcaggggtctatgtgcaagtttgtcatataggtaaatttgtgtcatgggggtttgttatacagattatttcctcacccaggtattaagcccagtatccattacttatttttcctgatcctcttcctcctcccaccctctgccctctgggaggccccactgtgagttgttcccttctatgtgtccatgtgttctcatcatttaactaccacttacaagtgagaacatgtggtatttggttttctgttcatgcattagtttgctaaggataacggcctcaagattcatccatgtccttgcaaaggacataatctcattcttttttatggctgcatagaattccatggtgtatatgtaccacattttctttatccattgtatcatcgatgggcatttaggttgattccatatctttgcaattgtgaatagagctgtgatgaacatatagcgtgtatgtgtctttataatagaatgatttatattcctttgggtatataccctgtaatgggatcactgggccaaatagtatttctgtctttatgtctttgaggaatcactacactgtcatctacaatggctggactaatttatactggcatcaacagtgtaaagcattccttttttctctacgaccttgccagcatctgttattttttgactttttaaatagccattctgactggtgtgagatggtatatcattgtggtattgatttgcaataccacattatggtattgatttgcattcaggagcataactctctttcttgtctgctgcactcttggcaaaggatctctggaatgatcagccatagcaagacatagggacttccgctgtgtttcttggtggaaccattcgccatctaggatctctagacctgcagagccttgagttgtggcaatgggaagcacagaaaatggcaagtgatttaatgtgaagcattgtcaacagagttactcctaaaccacctgttgatttccagacccatgtattctacttattgtgagcacagcatcatgtgatggtaattgattcaggttgtatactgcgttctggtggatggtgattcatctttacgagatagcatctctaaattgcaccacagctgcatcttaaagatcattgatctgccattaatctatcaggctggcrgcttctgggaaatgcagtatttggtaaaaccaggaaattccatggtcatattgccacttctgtaactcttttgctacaaattttgccccttggtctaatgtgacattatgtgctatgttagtttgctagggctgtaagagagaatcagtttcctgcctatcacttagcttctagtggtttgctggcaatctttagagttctttggcttgtagaagcgtcaccctaattcttgctttttatcttcacccggtagtctccctgtgtttatatctgtgttcaaatttcccttttttataaggacaccagtaatagcagtaatattggatcgggggccaccggactccagtatgacctcattttaactaattacatcttcaatgaccataatttcaaataaggtcacattctgaggtactaaggtttagctcttcaacatacttttgtttggggggagggggcagaatttagtccattacatgaagcatcctgggcttgcggatcaaatactccacaagtctttggagatttgtgctggccaaagctctacacgcaagaaacacaagccatatgtggagtatgtgctgagcgcagtcaagataaatcactaccctctccatgatggaagggatataatttgccaccaaatagctggtttgattcctcaagggatggtgctacattgagggctcatgtattgttggcagattggacattcagcagtgggattattcatatcaaacttagtgagtggaaactcatactgttgggcccatgcataccttccattcttacctccatggccactcctttcatgcacacatagtgccagtactggagtggcagatggcacagtctgctatcagcaaccggcatagacattctgtctacttaattgtctagtgcctcttccatgatgggtgctttctggtgggaatcaaaataaaatacagagatctttacattttgtgctcacttttaaagacctgtgtacattccttttccccaaactttattatctctaatcttcccaggtttctccttccaggcctctgatcaaccagctgggccatttgtcactgcacatgagtctatacttatgcttactggtccatttagcttttcaaatcaagtggatgaacaggtgcaccaatcaaagctctgcccattgggaggatttcttctctctactacctttcaaggccacccctgatggagggtgtaatgcagccacagcctgttttcagcttttaccacatattgaactaaaccattggttaaccatgattggccttttccttcatctgttggctggttaaaagtgacaatccccccacctgcataccaccacagccacgacatggccagatgtgagctgagggagaggtactaatgcaacagtggtggttgacatgagggctggaccaccggttttctagctcacttgtgttctctagcccggacttatccttctctagcctggctgcactgctcccatattttgatggatttttagtggttttaggacttaatgggccgttttgaacctaggccatgatgggcatctctggccccgttatctctgcatgtctcatggtcatgagttctaactcaaccacagccacatagattgcaggagttgttttttttgaatgacatacaatcctctgatgaagaaggcatggccttgcttcagagcacaagtattatgaactgtattttgttttgcattgggattgtcataaactayacatggtatcaattcccactacagataactaattccagagggtctgccaaataatatggcccatgcggtgaagctgcttacgttgcattgtggaccagctgcagatccctttcctattctgggtcctattcaaagctgtcagctatctctgtcttttggtaaatgggtcagagcagtgtggattatcaggtgttgtgtttccttttagtggtgggagagtccagatgcaataattcgacctttattttggaagtcttttcctggcatgctccaaattactatgcccctacatgttttactgatttggcagggaatctttacagagattatctcacactctctggagtgaatgtgtctttccaaggcttctgatgcagttgccacttttgactcatcaatgatgtcattgatagcataaacca

SEQ ID NO: 12190 - DNA, 85261 bp, Homo sapiens
cttcattttttcaagtaggcaacgagacgcatcaaaggattttaagcccaggcataatgtgatcagatttatgttttagggagatctcttctcagcctcatgaaggaaggattggagcaaggagagtctgtggacatggaggcatttgaaggtgctgggaagagatggactcatatttattgagcatctgcaatgtgctagacacagggtttggcccttcaaataagttattgtatttaatgttcacagcaagtgtatgaggtaggaattacaattctcatttaagagatgaggctaaataacttgccccaaatcacccaactaggaggttgtcgacctaagctttgattccactctgtctgattccaaagctgctgctcttttctttccatttgaggggatgatgagggtctgaattctgccgtcagcaacactgaagaggcatcctccctcccaacagaagactcttaatttagtttcacctcatttggaagcttctccatccacttcatcattctaattgctttaatatgacaaattgaccaattactagcaggttatttataaccatggtggaattagttgcttagttcaatcaagcaaccaaaaagtaactgaattgtaatgactcgatttatcaaactgttccaaatggttggtgtgcacatatataactcatattagtgttagaccaatatatgcaacagaatagtgggggagtatttgactattcacaaatgacagctgaaccaaaataattctaatcccagctctatagccaagtggacaagtcttaactttgaacactaaaagatgttctagagaaagttctgggctcttttttgttgatagagaaactgaagcctagaaagcataagggatttgccaaggtctcccagccagaaaatgccggagcttagacttgaactatttgcattgttttgatgctgttttcctaccatgcctgctgcaccatgacatggagtcacttagcctcttgaatcctcaattattttgtctacaacatgaaaggattggtggatgtatcagttaacttttgctgtgtaagaaaccacccagaacctagcagcctaaaataacggccattttatggagcttatgattctgtggttgatcatggtggttgtcctggtctggactggctcagcagatctctgttggactctcatgcttctgtgaccagctggtrggtctacatgatctgccatagccccattcatagttctagtggttgacagaccattggctggggatcagctgctcgccaactggagcacctcattctccttcacaaagcattttatcctttagcagccttgctcagacttgtacacatggtggtctcagggttccaacacagaaggaaagggcaaatcccaataagaatgctgtttgcaaatctttaccattctcgctactctttcattggctaaagcaagtcacatggtgtagcaggcagcttctgaaatggctctcagtgattcttgccttctggcattcctgccgtcatataatcttctccccttgcatggagctggacctagcaacttgcttctaatgagtagaatatgacaaaattgatggaatatcactcctgagaataggttataaaggattgtggtgctctctccgactcttcttaaagacatacttgttctgataaagcaagctgccacgtctgaactgtcctatggagaggtccatggagatcctaacaaccggtgaaaaacaacagttccctaaggaactgaatcttgctaacatacagtgagtgagtgagcttggaagcagactcttccctggttgaacctttagatgggaaagcagccttggcccatattttcactgcagctttgtgagagacttagaagccaaggacctactgcagttacatctgggttcctgactcacagaaactgtgtgttcttttaatttgggagtgatttgttacagagcaatagataactaatacacacagctaagctcagagtcagtgtgggaggtgactatccaagggtacagttataagaacagtaattatatgaattatttatacatacttgcaaacaatttaccaaagatgaatcttttccagccctttagaaccggagatgaaattattttcactatttcaacaattatttattctctgccctaaatattgaaaacaagatggaaatgttcctgtcctcaaagagcgtacagtttgtgtcggggaagggacacagggaaagatattaattgaagaattccttctttaatttttgtttacaattgggataagtgacctgaatggacagcgtgtatagctcagtctggactagtcagagaaaatggcacttaatctgaagaggtagatgggggattaagagtcagggacagaggaaaattccaggcagagggagtagtattcttttttattttattttattttattattatttttttgagacggagctttactctgtcatccaggcagtgcagtggtgcaatctcagctcactgcaacctctgcctcccgggttcaagtggttctcctgcttcagcctcctgagtagctgggattacaggtgcgcgctaccacacccgggtaatttttgtatttttagtagagatgggttttcgccatattggctggtcttgaaatcctgacctcaggcgatctgcccgccttggtctcccaaagtgttgggattacaggcatgaaccactgtgcctggcagggagtagcattcctttttttttgagatggagtctcactctgtggcccagggtggagtgtagcagtgcgatctcgactcactgcaacctccacctcccgggtttaagtgattctcctgcctcagcctcctgagtagccaggattacaggtgcgcaccaccatgcccagctaatttttgtatttttagtagagatggggtttcaccatgttgtccaggctggtctcgaactcctgacctcaggtgatccatccgccttggcctcccaaagtgttgggattacaggcatgagccactgtgcctggcagggagtagcattcttaaaggggagctggagaggtggtcagcagctacaggacaagttcatatttatgatcaaattgtatgctattatgcaataattatggttagagattttaaaatttcctttagagatatacaccaaaatattaatggatgaaacgatttgatgtttgagattggcttaaaaatgatccagtggacaggttgggggcctggagtgggtggcgctgtagatgaaacaaggttttctaaatgagttcataatcgttgaaactgggtgatgggtacatgggtacatggggggttatcttcatctctctatgtttgtatattttggaaagtttcataataaaaaatttaaaaatcgtatcccaacaacacatcctgaaagctgtgtgtatatatttgagaggtcacagcaattacctcctcccgctccacaccagacagtagaaatcaataacgtctttagggcaaggtgatggaatgagtttcatggtacagaaaatgtaaaggcttctcaacttcaaatcaygtgtctaacctaaaataaggtgtttggataattcatcttgcctcctagctaaagtgctatattgcatgctttctcatgctcattttttactagctgagatggtttatttcatatattgtggaatcttaccacatggttcaccctggggtaaaagtcaggggaaggatcccatacaagtattagttactgaaatacagagaggatgccgtcataaggccttctatgataggggcagtattagagtgagttataggttggagaaagagaaaaatagggtagaacagatggaaagtcccctttgaaaaattgttggttggcttgctgcagtaataatggagtatggatttctttgattaagatttctctgccttttacttccgttattctgaggtaggtcagactgtgaagttaacagcaggggtgcatagattttgtgtcagagatgtattcctttaggatttttttgaggcggggagcagttggggtggaagctgatgagatgattcttcatgtttgcaactgtttcaatgttaggttaatgggggaactagagtttgtgattttgattcagacctttctggaaaatacttttgctgccaaattgagtctctccccaatccctaataaatgaagatttcaccagagtcagatatatgcaaattacatttcccttctcaagccaaggttacataaaagggaaaattatgaaagattgcttatggcagcaaggattttcaagcttgaggatgaatttggttgtttcaaaaccatgatgagtctcttgtcagtgcaaagcaggaaaggcataaaggagaaagtggacctgggcataaacatgttcccacacagtgtttgtgctgaaagccttgttccttgaacaagcattcttctgtgcgtttggcaaataaggagggggtgtcccctcctcttctgtgttcaaggctgggttctggccttgttgcagggaaacactaattcccagcagtgcaccatgggagcaaatggtttgtttcctcttcagtgaatccagcctggggtcggttctcagcagcagagcctggcatggaaaatctatttggagcaacttgtccccaggagggaagagtgcgagccaactgtgtggggaagccgcagccaccacagggtcagtcacacctgctggccagagcaggcgctaacacagaaaggcagagtcctccgcatacatgagtcctgtttgtgtgcccacccactcctatgtaccacacacacccgatttgatccgtatatgccatgtgcacactcgacatgccagatacacgcactgcactgccacacatataccatacacacaccactctgtattactaagcatacccacccccacaacacgtgcacaagcacatgcacgtccaactacacacatatacatattctgcacgccacacacactcaaccacacacacaccacccacactccacctcagttataacattcatttcacatacacacgtatacacacacctcaccagtcacttgcatcacgcataccacccaccatgtaccatgaacacacctaaccacacacaaccacacacgcatacccaccatacatactccaaataatcatacacacgcacgcaacacacacatcccatgcacaccaaactacacatacgcagacacacacacacatcaatgcacccagctttgttgctttcccgctcaacggaggcgggggtgggaggagaagggggaggggctgcggtcccggcgaaggttggggcgggcgcgggaaggcccgggcgcactggcctggggtttggggcgaggcgggcaggggttggcggtgctggcccctgacgcgccctgtggccgcgctggggcaggaggcccgccctgggtggggggagtgcgcgcgtgtgcacgagcgtgtgcgcgcctcccaggggctccatgcccagacacggggaggtgtgtacgagggagatgtgagacgcctgtggggacaggctgtgtgtgtgagatcctcgctacgcgatgcacccggcccgggccactaggaggttcgggtgggcgtgggccaggtgtgcgcagccctccgtggagcgtgtggacgcgtgtgtcagttctcggtggccagtgtcactcggggggaagtgcatatgtaggctggcgtgcatgtgagtacaaagcggccgaggagtgtgtgttcaccacggccctccgtcggggtctttctccgaggaaggagtgagtatgtgaggaggacctcgctgtgaccggcggggacgccgacggccaagctccccagcggcgtgtgtgtgagaaggccgggctcgctgaggaacgtcgcgcggggccgaccggcgcgcgcctgtgcgcgtgcgtgtgcgcgtggggcgcggcgcgcgccgcgccggagggagggaggctgccagcccggacccggtcgcagcgcccggggcggctcctcctcgagcctgggaccgccgcgctcccgccgccgccgcgtgctggcgtgactcccggcccgtgccgcgccctcccgcgtccgcagccggctcggcttcctgcccacccagacgtcgcttctcccgggctcccggtgtcggctccgcgcggagggagaggaaatgagtgcggcggcctcgccggcgtcggagcggggttggaagagcgagaaactagatgaggctcaggccctrgcgcggagttgcgccgcccgcagacccgacttccagccgtgcgacgggctgtctatctgtgccacgcacagccatggcaagtgcttcaagctgcactggtgctgtcacctaggatggtgtcactgtaagtcgagccgcgtcttcccgccttccgccgcggtccgggggacgcccgccgggccgtccggggtcgctgccggaactctgcggccgcggggctccgggctctgccggggctgctctgccggaggctggggccgccgtgggctccgggcccgccggagctttccttgcgccggacggctggggttggcgctgccttgacgacgagatgaaatcccgtggggcgcctcgctttctttagctacttctacaaaagggagctccctgtcccagggaagcgggaatctggttttttttcttttctttttctttttttgaccaaggcgtccaggcggtgttttgagaaatgggagcgagccagctgagttggcgacagctgttggggatgccttttttcaaggttgctggttaaagatgctcctctttttctttctcacttttgtcttcctgggctgctatttaaaagaaggagcccttggatatccaattgtttcccccttgattgtayccaaattgagaaaaagcgctaatgtgggagggattgcttccaagaagttaatattaacagtttggaaggtcgagctccttaaatacccagatgtagaatttagagccaaataaatgagacttataaaattacaaaataaaatgagtgaaagtaagcttaatagtcttaaaccaatttataaaagctagaaccaaatggtctaaaccctttctctgtgtttagcctcctgcctgtgatttttaaatagattaaacttaagtagccatttaattagaatttcacaatttgattagctaatagtatttggactatatccgatgaatcattcattttaagaaatatattctaaagttagtttccacatatatttgtaatagagggttttggagtgcttatttaggacattttccaagtgatcttaagttaaaatgaatttttctttgttgagaaaaaaatagctgacaaccaggaatgcagtacataacaaatccttatttacattaatcgaacataaatgaatattttaaatcgaatttatgaattcaaggatagaggatcattttctttacaaattccaggcacatagaacagtattgatttctggtgttccatttgcttatgggccagtttcttcctatttctcattattcctgttgtgctcagatctgttctcttttgttagtataaagcattgcttcacggtgggacagggtaccgagttggaagtagcaactctaggaaacctgggatgctgaagtgcacaagtagaatctggactttcattcatttcgtgggaaagtatagaatcgttgtgtaaaatgtgaggaatgttcaagatagtccaggttactgtctgtcttattttgacagtgtcttctctaagtacaccgttactgatgggaaccttgcagttttctcagacagcttctcccttcattagccttgactcttaaaatactcttccttatatggagctgaaatcagttactttctaacttctttcttctgctcctatttctgccttatgaaatcatatagaacaatcgaatccttttttagatcatggctgtttcaactcttcatatatacattgctgaatatacatatgaatgtcttgcacatatggactgtcttctctctgtatccctggccattctcacaatgtctttcctgaaataggtttaacaataatgttcattgaatgactgaatgaagctagtgatcatctttctcttaaggcatttctttgtcctatttatacatttccagtcccttctgcctttccttttatggaatagtattcaggctcctaagcatcttggttgttctcttctgaacatgtgccaaggtggttttgatcctttgaagactgtggcccctagaaaggtagacaatattccagttgtggtctgatcagtctagagttgaacaagaccactacctcccatgttcgagatactgctattgctgcagctagcatcacattagcttttctgatatcttcatcacatactgagcttgctgctgtcagattgaactaagcttgccatcaaagccattgagctgttttgtttttttttaacatatgtgacaagccactgtttgcccatctcacacttatatttttggacacaggtactgatcccttagatatcttttcctattaaatttcatttcattagaatgagcctaattttgtgtgtgtgtgtttttagatcctggctctttcttaatatatttataagctgtttgtcctaggttcatgtcatccacatactggataccaacagtagtacagtacatgttcataaaagttactgataaaattgttgaacaagagaaagccacagatagagtcctgaagcttgcgggtagaactgcccttcaggttgatagcaattcattaatgagcacttgttagttatgattgttcaaacaattacctagccacctagttgcactgttatccatcttatatttatcttgtatatkggtgtaatgaaaacctggtcaaataccttattgaaatcctaccaacacactgtttttactgcctctttttgatctgtgacctatctgtacatacactctttttttaaaaaaaaacaagaaattagrttaatctggtaaaactcaggttgattccacaaatggttaccattttcttttctaaatggttagaaactgttttaaaataaataatctgaatttagaaaaggattgacgtcaagtatactggactgtcgttggcagttgtttctgttttttaaaaaatcaggactacagttatttgttcttttccagtctttggcagtcctccggttctccacacttcctccactggcagcagctcagtratcccattcactaaaagcttgacttcatttaaagcagctaggtgctctgttacaatctcctcagttatcctgggaattaattctctctatgctttttagcccaaaataagcagagttaacatgtttgagaagttctcctttctttttggtattcatggagtttacagtatcagtcctaagcagaattcctttaattctgttgaacatatattgaacaccttctctttatgagacattattttggaaactcagaataaaaatatgaatacagctggaccacactggaccccatatggaccattatggaccctatatgcagagtctaaggacacaatcrtactgtatttactgtttttttttttttttttkgggagacagagtttcactcttgttgcccgggctggagtgtagtggcgcgatgtctgctcactgcaacctccacctcccgggttcaagtgattctcctgcctcagcctcccaagtagctggaattacaggcatgcaccaccacgcctggctaattttatatttttagtagagacgggatttcaccatgttgaccaggctggtctcgaactcctracctcaggtgatccgcttgccttggcttcccaaattgctgggattacaggcatgagccaccatgcccagcccatactgtatttacttttgtaattcttttaaaatcacaaatgatagaagtgagaaaactatcagtttgtttgccaaatctgagaatactaaaatgagaggattatcctgatgcttgaaaaaggtagattcaaaacaaggaagttcagttttatgtggttgattttaatcttgtgaaatatatagacttataaaatagaaaaagcttaaaaatatgtacatgtccataaaagacataaagcacatatacattcacagattcagtgcttggtgcattattaaaggaaatgtgtatttgggtaatggcgcatttttgaggatgttgcctgggaggaaagcatcatatgttctgttggtatcactgtcaaaaatagattattaagctgaataaaccatgaatctgaatgtgtaacttaatttttcccagtaaggagtgatattggcttgaattaacgagtgaaggttttcaagaggcgttttgagagagaaagaaatacatggcttcgcgagagaggagggatgggaaagaaatcatatgtaggtattgtaaagtagaattttgtggctacttagaatacttagaataagaaattagattggtggaggtggagataagagtgtatttgagagatatttgaggtgaaatctatagggttaattaaatttggtcgggaagggaggggaagattattaaggttaacttctagaattctgctttatgcagctgtggatggtggtgccattcactaacaacgaaatactgagtaactaggattgggaggaaggtcatgaatctagttttggatctgtaggatttaagctgcctttgtcctcacatggtgatgtcrgtaggcaattagatacagggatgtagaactcagaggagaggtctgggctagaaataatatgtaagtaatttacttacttataggttgcagttgtagctgtgatgaagcgtgagcaccaagggagagactgtagcgtgagaagtaaagaaaaccattaagctttccctttacaacaccagagtgttttcttttaggacatcagagtctgggtacaagaggataagctggcagaggagtctaagaagagatggctagrgaagaaaaatctggaaaatatggtattgcagaagccaggggaaattagtgttttaagaaagagtatgaagatgaaaccagttttcagcaggctaattattagatattggtaaaatacacaaagagtgattttcattattatggagaagagggtgaaaggtttagtcttgcaacagtgacttcaggaatatacttaattgaagcattagtcaaagctgttggaggctcttgaaggcaaaagagaacagagcgttaggagctaagaattaggacacagacaattgttaatatttactgagtgattactttgtaccagaataagcttattatgctgagcacttaatagccaattatgtaattatgtccatttcacagttgaggaagaaggcttagagcttttccacgggcacatagtaaggagtagagcctggattcggatctagctctgttcgattctacacccggactcttaaccatcattgcactgtagagcaatttaaaattagtgagcagaaccaacagagctcagttccattaaagccaatgatggggaaagtttttaagaaatgggtggcaagttgtatcaattgcagtagttaaatccggaagaatgagaactgtaaagaggtcactgtatgtgataggaagtgacattcaagttaagggttaaggaagagaaagtaattagaaggtgacaggtggggctgagtgggtggatgtggtatgatgtaggtgctaccagccaaactcagagttggcttaagaatatcacataagctcagttttctgtagaagaaatcttaaaagattctgtttcaggttgaaagcaggaagagtgggacttgatgtagtctaataggtggtattagcatatctaaagaaagactgtcacagcaaaaggtagatgggcagcatagaaatagagacaaatgggagttggagaaccagaatttgggagtgcttttcaagactgttcagagaagatgttatgctgtctagagagtttaatatctctggtccttatggctgcgctatcgcagcaaatgtttggttacacatttggcttcctgtttatagattttctgtagggagagaaggagttgattagagggttcaactgtcaggactttggggcaaatatacttcttttcgttagtaaattagcattgtgattttgtgttgttctattctgtttttgtgcttctatacaactctaggaaaactcacaaaatcaggttctgacttccacgggaaaatgccacctggttttcctaaaggacttctgattcatatcaataacaatagctacaaaaaacgtgtttaagaagtttgataaatgaaaactagcaacaacaacaaaaataaggagtggtagtttggttggaaaagtcaactaaagtttttttctaagaatgagggttctgccgggcatggtggctcacgcctgtaatcccagcactttgggaggctgaggcgggtggatcacctgaggtcaggagttcgagaccagcctgrccaacatggagaaaccccgtctctactaaaaatacaaaaactagctgggtgtggtggcacattcctgtaatcccagctcctcgggaggctgaggcaggagaatygcttgaactcgggaggcagaggttgcagygagccargatcgcgccattgcactccagcctgggcaacaagagcgaaactccctctcaaaaaaaaaaaaaaaaaaaaaaaaaaaatgagagttgtaactttgtctagtgattgaaggaagaggatacagattttaagaggagagctgtgaggtgaagttctgagtgagtttcctcaaagctcttccagagatagagaacgctgataggttcttccagagatagagaaagctgataggttcttccagagatagagaaagctgataggttcttccagagacagagaaagctgataggttcttccagagacagagaaagctgataggttcttccagagatagagaaagctgataggttcttccagagatagagaaagctgataggttcttccagagatagagaatgctgataggttcttccagagatagagaacgctgataggtgtctttctgtgtagctggtgcttcaatgatggatgcacrtaaacttcarcaataacaaataacacayatcatggctatgtgcaggcacataactttttgtaatcttttcgtatgtgtttgctcatttaaacgtcacaacaatcttgtgaagtaggtactgttactatcttcatttttaagattaggaaatttgcccaaggtcacgcgtagtacccctagctgcctgtggcaaatgtatatcaaaatcttacaaaccagctggcaaccagggctgtcggtttcttggttccactgaaggtatagtgaggatgatttcagctgttttaaattccttttggaaatagcatgttgagaatgctttctgagtttaagagaagggcaattatatgcagtatgaatatttttggaatggttgtgaactctataaaaccatgctttcaaaaacatttaataatgtatttgaatraaataaaattaaaataagaggcaaaaaagactaggcagtttttattatttgtatgatacgaagcttcagtcatgtcttatcctcagctaatctctgactggcacaagccgtttttagaattgtatacacaccattaattattactggcttccaagcctgttgaacttagagatttaaaccacatggcttttgagggcctttctataatttcccacattacaaaatcctcacttcatccgaatttgttctttcatgttatagatctcattaattacaggaaagaatgtttctagggaaattgtgttattaattccaaatcagtataggaacacaggccttcggcaaccagaagttgtctagtagaagatttgttttcttaaaaaatagggaatcgtatacacatagaatgtggaaggcagagtatagtccagcaaagagcacctgtgtttgaactgtgagtcttattgtttgcagggtgactttgggtagattactaaacctcctgttgcttcactgtactcttctgaaaactaggaataacaattctgtttcatccaagcgccatggtgggtgcctatagtcccagttactcaggaccactttggcccaggagcaacattgcaagacccccatctcttaaagaaatcctacctcacagagttgttgtgaagattaaatgacatattgtggctgggcgtggtggctcatgcctgtaatcccagcactttgagaggccaaggcaggcggatcacctgaggtcaggagttcaagaccagcctggccaacatggcaaaacccagtctctactgaaaatacaaaaattagctgggcatggtggtacatgcctgtaatcccagctacttgggaggctgaggcacaagaattgcttgaacctgggaggtggaggttgcagtgagtcgagattgtgccactgcactccagcctgggtggcagattgagactctgtctcaaaaataaataaataaataaacaatatattgcaagcaaagtacttagtgcaagtattcagtaaagggaaggatcagcccctcctccaaaaaaagcaaaaagcagtggaaatactaggtaatgtagatgtcctgatggcaggcactggagtcagacttcgtgtttgaatgagctctccctacttaatagttacatggtttggggaagttacttaacccgtctttcagttttcatgttgttaatatggggataatagtaccagcttcttggtgttgtgattgtcaaagtcggcaattgttttcccccttcctcaaatgtcctggttaatctggaatctaccctgtgaccgtactgatttgttcaattaaacactgaaaaacaacaaagaataaaaatacatgttttgaatattacacttggattttttttattattctcattgtggaaagttctattttgtaatagttcctatgtgttgagtgtgtgtgtgtgtgtgtgtgtgtgtgkgtttaccatagaatcttatattttgctccaattcttactccccagcttcatcctgttttcctccattgttaagcaatggacagctctggttaatcaaatataccaaataatagagagctatcatatatatcacacatgggttaacaagtttcaaaggattcaagtattatagagctcatcctatgttaaagtgaaactgaacatattcaactttggtgctttagaagtctcatcagtgtgtactgaaaaatggcaagaatgctagttaatagaggagtcctggttgctagaatgctgggccagtaaacttaattgcagcccttccaagttattttactcaaattcacaggatttttcctttgcttttctcttatacttcaattttctgatattttaagagtattttgtaagcatactgccaaaaatgtgtaatatctggagtgccaacaatgtataatacaaacacccccccagctgtatctgtacaatgccttcccaagtaggacaaattctttaacctctctagtgcttgtttgtccatttaaaactgggtgttttggtgtaatacagatgtacttctgtatatctctatctcattttaatggatgtttagtgaaataaaagcactaagaatataacaatttggtatttcatggaaaattttatctgttggactcatttgctttatctttccctttttctgactacacactctcttcctcttgtctcgcctttccccccaatacatttagaagaaagttgcagacatcatgacacttcataccaaaatatatcrgtatgccaaaaaaagagaaatatatcagtatgcctgtctcaagaatgaggacatttttctatgtaaccacaatactgtactcacacctaagataattaacagtaattcagtctaccatagttttcttaatggtaaagaaaatgactttataaaaaatccaggggtcaatcaagattcatatatcgcattttattgttaggtaactttagccacttttaatcactctaaagcaatcacactttttttttgatgacttgaattttttgaagagtccaagttaactgtttggagaatgtcctatattctgaatttgcctaattgtttcatcgtgattagatttagattaaacatttttgtcacattattacatgagtgatattgtgcccttctcacagcatcacatgagaaaacacatcatgtgtcttgttctgccaaggctaaggtggtaactgccacatctttccattataaagatgccttttgctttttttccctttggtttttaatgagtgatctgtggggtgatactttgatgctgagtgaatagtctgttccctaacaaactttaacccagtgattttagtattggctgaagatccttgcgtgcatcacttactacgctggtggttgcaaaacagcgatgttcaaattttgtcattccttctaccatttgatgacatcttttataatgaagaggttctctaactgtaccccatcttcctcatgttactgtagacaaattgattctttgtttttgagcagggtttcgctgtgtcacscaggctggagtgcagtgcaaccttcctagggtcaagcagtccttccacctcagcctccaagtggctggggccacagaagcatgccaccatgcctggctcatttttttatttttgtagagaggggggtttcactgtgttgtccaggctgatctcaaacgtgtgagctcaagcgatgcctgccttggcctcccaaagtgcagggattacaggcatgagccactgtgcccagccaaattgattctttttttttcagtgtgttataatcaagtattataattatttttgatgttcagattgtctttaaatttggccagtgagaatgcctgcaagctggcttctatgtctttttcatatatctcaacatttatttgagcatttcccagttttctggcacaagatgtcccaggcttacctaatgatttccctgccccagatcagaaatcatttttctaaggaaaccgagttccttttcatgagaaatggtatggaaaccattatctgggttttgagtctgcttatttttattaagagattattgcatttaggacttttcagtggacaaatttaggaaatgtgtgtgtgtgtgtgtgtgtgtgtttcctttgcatttccccactgcatacttgtacctcccttgtcagtaaaaccctggtttctgatatatcataatactcactaacctattcttcatttctataattttattcccagaatgttagtggaaacatagagtacataaccttttgtgattggcttttttcattcagcataactctctggagatccatccagtttgttggatatatcagtagtttgttcctttttattgctgagtagtattccatggtatacatgtaccacagtttaacttttcacctattgaaggacatctattttcagtttttagttattataaataaatctgctgtaaacatttttatacagttttctacttgaacatagtcttcatttctctggtataaatgttcaagagtgcaagtgctaggctgtatggtagttacatgtttcgtttttttttttaagaaactgccaaactgttttccagagggtctattccattttacattcccactagcaatgtatgactggcctagcctctttaccacatgctcaccagcatttggtgttgtcactgtctttattttaggcattctgatagcttttgtcttagtgagttcaggctgctataacaaagtaccagagactgggtggcttataaacaatagaagtttgtttcttgcagttctagaagctggaagactgagataagggtgccagcatctttgggttctgggaagggttgtcttctgggttttagattgctgatttctcatcatatcctcgcttggtggaaagagggatagagcactttctggggtctttttctttttttttctttttttttttttggtgacaagggtctcactctgttgcccaggctggagtgcagtggcacgatctcgggtcactgcagcctctgcctcctgggttcaagcgattctcctgcctcagcctcccaagtagctgggattacaggtgtaggtcaccatgccyggctaatttttgtatttttcttttttttttttttttttagtagagacggggtttcaccatgatggccaggctggtctcaaactcctggactcaagtgatccatccgcctgggcttcccaaagtgctgggattccaggcgtgagccaccgcctggccctggcgtcttttttataagggccctaatcccattcatgagggctctaccctcaagacctattattacttcccaaagrccccacttcctaagaccctcacattaaggattaggatttcaacgtatgaattttgggggacaaacatgcagcccacaacaggtgtgtattgatgactgattttggttttaatttgcattcacctaatggctaatgttcacgtgcttatttgccatttatatatcctctttagtgaaatgtctatccatgtcttttctccttttctaattggattttttaaactgagttttgagagttctttattgtagatactagacttttgtctagtggtttgcagatattttctctgtagtttatcttttcatcctcttagcagaggcttcccccacctttatttatatgccaaaaaactgcatgattagtttatagttgacccttgaacaacatgggtttgaactgcatgagtccaygtatgactgggttttacaaccaaatgtggattggaaatatagtattcccagggtgtgaaacccatgaataccgagggccaactgtgggacttgagtatgttcaggtgggggctctggaccaatccaatgtgtatattgagggatgactgtgtataatttggtgagttaacagagtcttttgagatacaaaattttaaattttgatggagtccagtttatcagtttttccttttatggattgtgctttttgatgcttttaagaactctttgccaagcttgagatttcaaatatttttattttttttctaaaatttttatagttttaagtttcgtatttaattccatgatccattatgagtaattttttataaggtgtggcttagatcacaattcacttctttgcctatggatgtccagttgctccagcaccatttgttgaaagattatcattccaccattgagttgctgttgtacccttgtcaaaaatcatattgtgtgggtctatttctgggttttctattttgtccctctggtcttcatgtctcttcttctgccagtaccatacaatcttgcctactatagctgtataagaagtctttagttgggtagactgaattttttttttttttttgagacagtcttgctccgtcacccaggctggagtgcagtggtaygatctcggctgactgcaacctctgcctcctgggttcaagcaattctcctgtctcagcctcctgagtagctgggattacaggcgtgcaccaccacacctggctcattttcrtatttttagtagagatggggtttcaccatgttggccaggctggtctcgaactcctgacctctggtgatctgcccaccttggcctcccaaagtgctgggattacaggcgtgagccaccaagcctggctgggtagactgattttttcccactttttctctcgtcgtcattgtcttctttcttgccccttcttcctcttctcctcctcccccctctccccttctcctcctttctgctcctccttcctcctcctccttcctcctcccgctccccctcctgctccctctccctctccttttttgagacagggtctcactgtcgcccaggctagagtgcagtggtgtgatcataggtcactgcagcctctacctcctgggctcaaatgatcctcctgcctcagccactcaagtagctggaactacaggtgtatgccaccatgtccagctaattaaaaaactttttttgtagacacgtggtctcactattttgcccaggctggtctcaaacttctgggctcaagcagtcctcccaccttggcctctcagagtgttgggattacaggtgtgagccactgcgcccagccaaatctttcacctttaagtataatgttagcagtagattttttgtagatgttctttatcaagttgaggaagttcctcctctattcctattttctgagaggttttaaaaaaaatcttgaatgggtattaagttttgtcagatgcttttttaaaatcaattaataggatcatgtaatttttcctcattaacctgttcatgtggtagattatattgatttattttcaagtattgaaccagccttgcatccatggaataagccccacttgattaaggtgtaattattttagtatattgttgatttctattggctaatagtttgttaaatatttttatgtctttatgacaggtgttgcttatagtttttttttttattattactgtctgtctggttttggtgtctggtaattgtaacttcatacaatgaattagaaagtttttccccttctattttctcgatgaaaatgtgcagaactggtattaaattttctttaaacatttggtagaatgctctagtaaaaccatctgggcctggaggtttctttttcttgttgttgttgtttttgagtttaaaaattactaattcaattttcttgttattataggkctattcaaattattatcaaggaatgaatgtagatcattggcattttttcaggaattggtttatttcattctgagttgtcaaatttatgcttgtagagttgttaatagtagttccttactatacttttgttgtctccatggtatgtatgacatcctctgcttcattcctgatactggtaatttgtgctgtttgtctttattctttgtctgtcttgttagaggtttgttagcttcattgaccttttaaaagaggcagctctttgtttcattgattttctttctgtcagtttttctgtttaatgtgtctttgatttctgctctcatctttattacgctcttctttctgctcactttgggtttattttgtgctttttctagcttcttgatggtgggagcttagattactgatttgaggcttttattctttctaatatatgcatttgttactgtaaaaattcctttcagcactgctttagctgtgtatcataaatttttatgtgttttattttaattttctttcagttccatgtaacttttgatttccctcgaaacttcctttctgaccatagattatcccaagtgtttggagatttttctaactttttattaactggtttctcgcttgattctactttgtatgattttaattcttttgaaattgttgaggtttgttttatggcccaggatatgggtcaagtgtcatggacacctggaaagaatgggtatgctgctgttgttggatgaagtgctctataaatgtcttttagatcctgtttattgattttgttgttgagttcttctatatccttgcttattttctgtctatatgttctgtcaattgttgaaagagggtgtattagttcgttttcacgcagctgataaagacacacctgagactgggcaatttacaaaagaaagaggtttaatgggatgtacagttccatgtggctgggaagcctcacaatcatggcagaaggcaaggagccacaagtcacatcttacgtggatggcggtggacaacgagaggagcgcttgtgcagggaaactcccctttttataaccatcagatgttgtgagacttattcactaccacgagaacagcacgggaaagacattcagttaccttccaccaggtccctcctacaaaacgtgggaattcaagatgagatttaggtggggacacaaccaaaccatatcagaggggtttacgtaaattgtgggttcgtcttttcaagtctgttagtttacccacagatatttgtagtttgttgttgttgttgttgttgttgttgttgttttgagacagtcttgctctgtcacccaggctggagtgcagtggcgcaatctcggctcactgcgacctccacctcctgggttcaggcgattctcctgcctcgttcctgagtagccaggattacaggcgtgcaccaccrtacccggctaatttttgtggktttttttgttttgttttgttttgtttttgagacagagtcttcgctctgtcgcccaggctggagtgctgtggcgcgatctcggctcactgcaagctccgcctcccgggttcacgccattctcctgcctcagcctcccgagtagctgggactgcaggtgcccgccaccactgtgggcccagctaattttttttatttttagtagagagggtttcactgtgttagccaggatggtctcgatctcctgaccttgtgatccacccgccttggcctaccaaagtgctgggattgaggcgtgagccaccgcgcctggcctaatttttgtgtttttagtagagacagggtttctccattttggccaggctggtctccaactcctgacctcaggtgatccacctgccttggcctctcaaagtgctgagattacaggcgtgagccaccatgcctggccagatatttgtagttcttttgtctgatgcatacacatttgggattgctgatatcttgttacactgacccttttkttcattatctgatgtccctctctgtatctggtaattttcttttctgtgaagttgactttagttgatattaatatagccataactgctttcttttggttaatgttcccatgatgtatcttttccttccttttattttcaacctcactatactgttaaatttgtaggaagtttcttgtacacaacatatttttgtcctgaattgcaagccattctgtcaatctcttttaattaatgtttttagaccatttatgttttatgtgattattgatgagttatagattatgtctgccattttatattttatttttttcttgttttttatttttcttttctttttcctgccttcatgtgatttatttgaacatttttttgaattccattttgaattatctctaatatttttgaatgtcttctttgtgtatctctttaaaaattcgatttaattttttattgacaccatatttgtatatatttatgggatacatgtgatattttgttacatgcatagactgtgtgatcaagttagggcattttgggtattcatcactttgagtatttatcacttctatatgttgggagcatttcaagttctccgttttaattattttgaaatgtgcaatacattgctgttaactatagttacgctactctgctatcgaacatcagaaattatcccttctgtctaatgtatgtttgtacccattaaccaacttctattcatcccctccccacatctttcccagtctctggctaatttttgtattattattttttagtagagacagggtttcatcatgttgaccaggctgggcttgaactcctggcctcaggttttctgcctgcctcagcctcccaaaatgctgggattacaggcatgagccactgcgcctggcctggttctttatacttcttgtctttgccaagattatttcttttctgaggctttctacagtttcatttgcttgaagtgtgtttgcagttgctcactgaagcattttttttttcatggttgctttaaatttattgtcaaatcagtctaacatctctgtatctcagtattggcatctgttgattgttatttttcatttagtttgagttctccctggtttgttgttatgacaaatgattttcaattaaaatctgaacatttttccattatatgaagagactctgaatcttaattaaataagatccttctgtttttgctggcttttttrggataccattctggcaggggaaggggctgcrtcctcattattgccagatggagctagaagtccagattccacacttgtcctccacggacaccctggagatgaggctcgttggtatctctgggtgggagtgggagtttttgctctcccttaggcctccactgataccaccatggggggcctcagtaccactgagtcctgatttctgcaaggcctctgacacttcctggctagagtattgaggtacctttttagagcctttcaagggtggaagttcatctttggccccagctgtcagcctttactggctggggtaaagtacacaattttttctctgatgtttggctggagtagagcagttattctctgaaagttttttttgtcattttaggttgctccttccctggtccattggctagagagagcaggcattttttagggcttcttttgtctgctgccatttatgtttcctgrttgacaacttttttagccccaagtctggcaaataggaggagaaaaagatacacaagaaaataccagggaactcactaccgtgtggttgcttgggccccgaggttcctagttggtcaggcttcttctccccacctttcagtctttttctgtttgttttatatgtaatgtctaaggtatttagctatacttagtggggaggaatagggaaaagtatctattccattttcctggaaatattagtctccatcttttttatttgactttaatttttgaataggtaaaagttttcatggttcaaaagtcaaactatttggtgttactgtcaccagaataaaaagtcaacctatgtaaaaaagaatactaaaaaagtttcatttgtatcccaatatcttctactgcatttgaatccatctcctctatatatatatgatgtattttttttctttttctttttgagacagagtctcactgtatcacccaggctggagtgtgcagtggcacaatcatagctcactgcagccttgaactcctgggctcaagccatcctcccacctcagcctcctgagtagctgggactataggcatgcaccaccaagcccagctaatttttctgttttttgtatggatgggatttcaccatgttgcccagaatggtcttgaactcctgagctcaagtgatcygcccacctcagcctcccaaagtgctaggattacaggtggcttctttctcatttcttcatgcttgcatgctactttgttgcatatatgtgtaatagatgtgttttgtttttgtttttgttttgagacaagtctcactctgtcacccaggctgcagtgcagtagtgtgatctgggctcactgcatgcaacctctaccccagggttcaagggattctcctctctcagcctcccaagtagctatgattcaggtgtgcaccatgcctggctaatttttttgtgtttttggtagagacagggttttgctgtgatggccaggctggtctcaaactcctgacctcaggtgatccgcctgcctcggcctcccaaagtgctgggattataggcatgagccaccatgcctggcctgtgtaataggttttttaaccaatttcttactgctgagcattttgtttgtttctcatattttacttttacaaataatgtttcattgagtaacttgtgcatctgttgtcaagatatatttggggaggtacatctttaaagtcctagaagtgggattgctggaccaaataataaatacatctgtagttttattagatattgccaaattctgtttcatatgggttgtaccatttgccctcccaccagcaacatgtaagaatgcctgttttctcatagcttcaccaacagagtgtattgtcaagcttttgagtttttgccaatgattataagtgagaaatggtatctcagtggttttaattttacatttctcgtattatgaatgaagttgagcatatttttgtttttaactgttctttaaagatattttcactgactgtgacagtatgatagacttccagtatattgaagatcataccaccatcttctggatttctttgttgctgtgaagaagtcagctgtcagttgtcattcctttgaaagatatctgtctcttttgccattcctttgaaagttatctgtctcttttttctctagctgcctttaagatagtatctttgtttttggtgttctacatttctctgtgtgtctgtattggaattcttttgatgtatcctgtttagaattaatttagcttcttcaatctgtgcattgatgtccttcatcaattttagaaaatacctgaccacctgctcttcaaatactgtcctttccccattctcattgtcttcttcttctggaactttgattagatatgtattatacgttttcactttgtcattcattttttaacctttattttatattgtctgtttcatattgaatctctttgtcactctatactgccttctggagaatttcttcggatatgctttctgctttgttcacagatctgaacaaactaaagtggaaggcatatctgaagaaattgtccagaaggcaatatttaatgcattgagtttttaatctttttttttttttggtattttacagatcttctatttgattcttttcaaatagtcattttgaaaaagacttcctcatttttaatagttacttgtttttactcatatcttcactttcttttatttctgtgaacacaagaaacatacttgttttatgttctgtttctgatagttccaatatttgaatctctgcagatctgattcactggattttactaaatgccttgctcatttttatgtttcacaaatttttaactgtgagctccagtttatcccgtggaatgttatcccatggaattccttcagatcggatttgcttttgttttctccagatgcctagggacactattactacaggattgctttagactaaacaaatagcttgacatacctggaccagcctggaagtctgaagtttggctggaatctgtggaaggacagcttttgcttgtgagttacaatttttcctcccctctttcctcatgtgtcctgagtttaagctatgtaaaacccctgtaggagttggtttatttgtaatttactcttacactgatgataactttttggagagtttctttttacaatatctgtaggaagccttaagctttatttcatgaaccttgaccttctaaaaggttacagaaaccaaaaagccaaagtttacctatcccagcaaatatcctcaaagtaaacattatgctcaattttccacttgcttttctgaatttctacttttacttgggtttctgcctgaatattccttatttttgtcagttcatcaatgtagtgaggaatattacaatttttttctagcatttctcagttgcagaaggattattcaggttgcctggtataccatttggtcagaaaaaagtctgttacaaaaatcctgctatattgtatgtccctttttaaaaagttgtttcaaagtttgttttgaacaacatggaatataaatacatgtacatatgaattcagtaaaataagagrcaataaatatattaatactctgtttaaccggatatcagacttcaggcaaactctattataacaagatattaccacttggttactttttgttgagtggtaagcacctccattcaaaacactgcagaaatgatcacctagtcatagagttctgacagttaatgtacaggttaaattacaacagcttctgtaaaattagtttgatttggctaaggtggatattcttttaattgtttactatttttagactgcaccatttaagaattacattttaaagccgtaatgaataccacttcacaccagctggcatggcagtaatcacaaagaaagataagtgttggtgaggatgtggacagattagaaccctcatgcattgttggtgggaatataaaatggtgtaaccacgttggaaaacagtttggcagttactcaaaatgttaaacatagggttaccatatgacttagccattctactcctagataacccaaaataaatgaaacatatgtccataaaaaaacttgtatacaaatgtttatagcagcattaatcataatagccaaaaagtagaaagaacccaaaagtccattaattgatgaatggataaacaaggtatggaaaatacacagatggactattatttggcaatgcaaaggaacagaatgaaatacagacacattcagtaacatggatggaccttgaaaacatgttaaaggaaagaagccaaacacagaaagtaacatatcgtatgattccacttatatgaaatggccagaataagcaaatttgtagagacagaaagtagatgaggggttgcgatggaccagggaaggggagaatagggattgactgctgtggccaagaggtttctttttggggcagtgataaagttatgaaagtagatggtagtggtatttgtacaactttgtgaatatactaaacccactgagtatatacttttaaaggataaattttatggtatgtgggtcatactaataaaaattatatgaagaatagtttatagcccaggctggagagcaatggtgcgatctcggctcactgcacgctctgcctcccgggttcatgccattctcctgcctcagcctcctgagtatctgggactacaggcgcccaccaccacacctggctaattttgtttttgtatttttagtagagacagggtttcactgtgttagccaggatggtctcgaactcctgaccttgtgatccgcccgcctcggcctcccaaagtgctgggattacaggcatgagccactgcatccggccaatatatttatttttagcccaaactttagtaaaatatttttataggatgaatttgtgaataattgacaaaacatggaataattttctaggaagaaaaggaaacaggaaaaatagaaagaagtaatactatttcaccttaatttaaaggattatattacaagagatacactggaacagaagcctggttgttattttagttgcttattttgagaatatctctaagccaaaatgtcagtgattacctttgattatttaaccatagtgaaaatattacttatgctttagtctgtttattgtaatataggctttactttttggatgctgtgttacaatctgctcttaattcaaaatgaataagcatgttataattttcttttgtttgaatataaatattttggtaatgggacaagtttaacattgccttctattaaaaagtcaagaaacaacagatgttggtgaggctgcagagaaaagggaatgcttctgcactgttagtgggaatgtaaattagttcagtcactgtggaaagcagcttggagatttctcaaggaactaaaaatagtactaccatttgacccagcagtcccaccattgggtatatacccaaaggaaaaaagacatatgcactcgtgtgatcaccacagcactattcacgatagcaaagacatagaatcaacctacgtgtgcccatcagtggtggagtgaataaggaaaatgtggtacatacccacatggaattgtgtgcagccataaaaaagaacaaaattatgttttcttcagcaacatgcatgtagctggaggccattatcctaagtgaatgaatgcaaaaactagaaaaccaaatagcgcatgttctcacttgtaagtgggagctaaacaatgcaaacacatggacatgaacatgggaacaatagacactgtggacttttagagggcagacggaggggggccaggattgcaaaactacctgttgggtactgtgctcactacctgggtgcagtatacccatgttaccatcctgcacatatgtaccctgtatctaaaataaaaactgtaattttaaaaagtcatgtctaatgtatttaatagtatttgtctttgactcacagaaaaaaataataatttaaaatttatgttcatagragcttttaaagagaaatagataattgawtttttaaaattatcaacatgctgggcactcaaggaatatttgttattaatgattaaactcagatattaatcacttgattaaatccatacattcatgctgtgatagaaattacctctaagttctctagaacttaagaaagaaagcaccttgagatcgtctgtttcatagtttttcaaattatgcgaagacagagtttcacagaagcgcgtttgatagaaggaaattcacagtgaaagtgacctgtgctgggtcccccattctacttcaatcaggcatctgtttatctgttttacataaaatgaggaaactgaagaaattgtcaacattatcataaaacaaagttatgtttttctggactaagtagccttcaaggttaatcagatacaaatccatttattttcagaaaaggagttagaaaactcaaaaacttctctgatttcattagtgggttttgttkttttttttttttttccgaaacagtctcgctctgtagccaggccggagtgcagtggtgcgatatcggctcactgcaacctctgcttctggggttcaggcgattctcctgcctcagcctcccaagcagttgggattacaggcgtgtgccaccatgcccggctaatttttatattttaagtagaggcggcgtttcaccatgttggccagactggcctcgaactcctgacctcaggtgatccacccgcctcgcctcccaaagtgctgggattacaggcatgagccaccacacctggccgattttcactttttacctggtggttttgttatgttacaaaagcactcactaaagtcttcagggctgataccatccttaaagaatctatgctgtagcagtgaggaccattgtcaggtttcaagcagcagttaactgtctaaaaatcagcattatttgtcatactaaattaatgttgcccatttgatgattattggctttgctgcttgcgtatttaatttgaaaattagtttctgctttgcagttgtataagaactataagcataagaggtttatgcttaactttgtgtttgttttagtgaatccacactaatgaaaaaattgaagctgttcttgaggggaaaatctcctgggccaaatcatcctgtaaccttaactcataaaagttgtttttcaacgtctcaattttttaaagctgttgtatctactctagattgttcacatgttgattatatggatttgctctttttgagggagtcggtttactcggacaytaaaaaaacaaatagtggcyggtcatggtggctcacgcctgtaatcccagcactttgagaggctgaggcggatggatcacctgaggtcaggagttcgagaccagcctagccaacatggggaaacctcatctctaataaaaatgcaaaaattagctgggcgtggtggcatgtgcctgtaatcccagctacttaggaggccaaggcaagagaatcgcttgaaccccagaagcagaggttgcagtgaaccgagatcgcgccactgcactccatcctgggtgacaagaatgagactccatctcaaaaaataataataatttaaaaaaagaatgaatgtctaggtcttagttcctttcttcaagctaatctataccatatatcttctcagggagttagaaattagactttttcttamaagttgagataaaattataaaaagtttacagttctgcaacaacatttagtttttcagtaacaccttatttatctcatttttaggcccagtctttaaactgattaatatcttcccagctgttagcttattttagttctgtcaaaatgaattagttttttttacttttactttttcatcctatggttctagatagacagcccaaaatgatattcaggcatataaaagggacctcttacaggaggcagtggaacgacattttcagattttcctggatatgagataagggaattggggaatatcaatagaaaagatggaaaacagattaactggagatctttgctgagacagtaaagtggatttttaaaaagctatagaatctcctttggggattttaatgtgaagattttgaataatatttttatcaygtgattatcattgcagtaagggaatggacaagtgatttcttgcatgtttaaaatttgtcagtgggctgtaccatctctccagggcttgttttgtggccatacaactgtgcgattggagaggtcccactcttagaagggccatgtgctctgtaagttttgaacaaggggccagcattttcgttttgcactaggacccagcaatggagtcagtcctattttttccccatgattgtttcacttaaagcaaagaaacccatgtcattaatgtaaatgaagataatatctatttcttgggtttatgataagacgaattaaaacgtggaagtcggaagtccattttgagtttcctcagtatgcattgtaactttctgttttttatattatttctcacgtatttcttcctggctgcttgtatctagaggcacccagggaagttatttgggactctgtactgacagtaatgatgctgttctatatctgttttgtcatatatccctgaatttcacttgtctgagaagwcagatccttcagtctgtgactgacatccttttctatcatcttgcaacaacttctctaggctattttacctaggaaataggcctagagctttcagctgtcataagttgttagctatacaaagacattggcagcctgaacttagacactatatcgtttgatacttgttaaattcaagagaccaattaagttaaagagcaggcttgaaattatatataaaaaactgcttagaaaagttgaacattatagaattgttagcgatttatcatttttaccttcattttttcatcgacatcctgttgtacttgccatgatccttttcttttttaaaaagtcaggcttattaattataacttacatacagtacaattcacacatttttatttgtacagttctgtgcattttaacaaacatatataattgtgtaactatcatatcatcaaagtgcagaatattcctatcatccaagaaatttctttcaactttatagtcagtcatgtattcccatctcacccccatccctggtaactgctaacctgtttttatgccctagagttttgtgtttttcagaatgttttatacatggaatcatatgatatgcaacctttttattatactttttataatattccaggatgttatataaatggaatcgtgtagcatgtagctttgtccacttaacataaggatctcgagattcatccmtgctgtcgagtatatcagtagttgattcttttcttttgcagtttagcattccattggatgtaccacaatttgtttaacattcatcagctggtggatatttggattgtttctattttgtctgttaagaataaggctgctataaatatttgcatgcattttttgtgagaatgtatgtcttcatttctcttgagtaaatgcctaggaatggggactactaggtcacaaaagtttatgtttaattttctaaaaaactaccaaactggtttttgttgttgttgttgttgttgttgttgttgttgttgttgttttggagatggagtttcactcttgttgcccaggctggagtgcaatggcatggtgtcagctcaccgcaacctctgccttccgggttcaagcgattctcctgcctcaagcctcccaagtagctgggattacaggcatgctccaccacacccggctaattttgtgtttttagtagagacaggttttctccatgttggtcaagctggtctcgaactcccgacctcaggtgatccacccacctcagcctcccaaagtgctgggattgcaggcgtgagccactgcgcccggccaaactgtttttcaaagtggtggttttattttgcattcccaccaacaatgaatgaatataccagttgctctacatccttgccagcactcgacaatgtcagcgcttaaaaaaaagtatcaatttaaatatatgtgttatagtatttcattgtagttttaatgggacttctctaacgtaatgatgttggacatcttttcatgtgctggtttgccatctgtataatctttggtgaaatatctgttcaaattgtttgctcacttttttaaaaaaactttttaattttttttaactctttctatatactggatatcagacctttgtcagacatatgtttgcaaatattttctcccagtctgtggattttcattttcttacactgtctagtgaggagttttacattgtaatgatgctcaatttaacatttttttttaacggtttatgcttttcgtgttctgtttaagaatgacttgcctcatccaaggtcacaaagattttctcctatatgttcttctcgaaattttatagtgtaagtttcatgtttacgtctctgactccttcatttctaggactcctttatttacaaaagtttgttatttacaaatttgtgtctatcctttcaccagtgccacattgtcctaattaccatagctgtattggaagtcttgaaatcaggcagtgcgagtcttccaacttcactgttcattttcaaaattgttttagccattctaattcctttgtctccatatgcattttagaatcagcttctctatttggactgcacttgcattgaatttgtgtatcaatttggaaagatttgctttttcttcatgtacagtcattccttggtacctatgggggattgatttcaggatcccccygtggataccaaaatctgtggatactcaagttccttatataaaagggtgtagtatttgcttgtaacctatgcacattctcttgtatactttaaatctctagattatttataatacctaatacaatgtaaatgctatggaaacagttgttatattttattgtttagagaataacgacaagaaaaaagtctatacatgttcagtaaagacaaaactatccagtttttccccgaatattttcagtctacagttgttgaatcaggagcctgtcataattctgacagacaaaattccagacagtgtaatcctgaatgttgaaattctgaaagatcaaaatcctgaaaatataattctggaaaaaataatttaaaattcttcaaaggacatttgtttacatttagaagtgggatttatttgagaaacatgtaaaaacatgacagaatacttcataggccagtttacacaataaaataggcaataatatatatttttgtaatcataaatattcaggtatagtaacaacagtcacatatgtatcacaattatgagcagacaaaccatattcataaagaaataggtcataaagatggggaccatggtgtgtccctataatcccagctgcttgggaggctgaagggggaggatcgcttgagcctaggagttcaagtccagtcttgacaacgtagtgagacctcatctcttaaaaaaaaaaaaaaggaaagaaaaatatatcaaaaagtgaaatgtataaaggcactatagttggtaattgtgtgtacccagctttgtaactgtagtcacccaaaatatcatgatgttcaatctaagtgttttgatgagatatatcaaaaaccacgatgggtcaccactacatatgtcctctttcaaagagccgagatctcaagaaatttatctttcacaaatgcaaatgtaaaaaaaggactttttttatttgttaagtttcagcatttttatgcttacacacacagtcaacattgtgataatgcagtttcacagagtsaattttttttttttttttttttttgagatggagtctcggtctgtcacccaggctggagtgcagtggcgcgatctyggctcactgcaacctctgtcctcccaggttcaagcgattctcctgccttagcctcctgagtagttgggactacaggtgtgtgccaccatgcctggctaatttttgtatttctttttctttttctttttttttttagtagagatgagatttcaccatgttggccagactggtcttgaactcctggcctcaggtgatccacctgcgtcggcytcccaaagtactgggattacaggcatgagccactgcgcctggcccatggagtcaattttttgatgtccaaggagcggaagaaaagcctktctcagctctcagagaccaattgccttttgtatttgttctttcctggccctcagccagttggatgatgcttgccgacattgaggtcagatcttcctgcctagtctactcagactcacacactaacctcttctggaaacaccctcatagacatacctaaaataatgctttatcatgtttctaggtattgcttaatccaatcaagttgatccctaatgggaagtccataagcccatctgtcatcaccttggcacccatatgcatctccttaaaccatacttaatttccaaataaagacaataacaaggtaatagttccactttccgtgatgcaactatcctcggatggtgatttacaggattttagacactcggggctttcgactttagggattttgatcttttaagatttcaacatttgggattatggcatttggggttgtcttttgagattgtgatccaarcccagttgaatccacaggtacagaacccacggatatggagggccaatggtattctgagactctattgttaggtttatacatatttaggcttatatatgttcttggtcagttgaccctttaccattatgtaatgtctttctttatccttggtaatattactggttctggaatcatctactttgatatttatatagtcactctagctttcttttgattaatgtttgcatagtatatttcctttatactcttgcttttttttttttttttttgagacggagtctcgctctgtcacccaggctggagggcagtggcacgatctcggttcactgcaagctccgcctcctgcgttcacgccattctcctgcctcmgcttccctagtaactgggactacaggcacccaccaccatgcctggctaattttttgtatttttagtagagatggggtttcactgtgttagccaggatggtcttgatctgctgacctcgtggtctgcctgccttggcctcccaaagcgctgggattacaggcgtgagccaccatgcccggccatgctcttgcttttaaccaatttatttctttattttcaaagagggtttcttgtagatagcctatcattgggccttgcttttttatacagtctgacatcatggctttctttgattgtcctgtctgacctagccttactacttctccaacttcacatgtctcattacactctctctcctctactcttctcccatcagattaaccttaattcagtttgtagaactagtgaaattcttgctcaagaccattgttcttgctattgtctctgcgttgagtgttctcataccctgtggcatctgccatcctccccctttcagcctctcatgctataataaatagtcctcttgtcatgtctcttcttaaacattacctcttcacagaaacctttcctggctatgctatctagagtaggctctccctgttctttctaacagaatcatgcttcttttttttttttttttaatttccatagattttggggaacaggtggtaatttggtaatttgtgagattttggtgaacccgtcacccgagcagtatacactgaatccagtttgtagtcttttatcccacatccccttcccaccctttcccctcaagtccccaatgtccattgtatcattcttacccctttgcatcctcatagcttagctccatttatgagtgagaacgtatgatgtttggttttccattcctgagttactttacttagaataatagtcttcagtcctatccaggttgctgtgratgccattacttcattcctttttatgctgaccagtattccatcgtatacatatataccacattttctttatccacttgttgattgatgggcatttgggctggttccatatttttgcgattgtgaatggtgctgctataaacgtgtgttcaagtatattttttgtataatgacttcttttcttctgggtatatacccagtagtgggattgctggatcaaatgatagttctacttttagttctttaaggaatctccatactgttttccatagtggttgtactagtttacattcccaccagcagtgtagaagtgttcccttttcaccgcatccatgccaacatcttttttttttttttttttagttttggattatgaccgttcatgccggagtgaggtggtattgcattgtggttttgatttgcatttccctgatcattagtgaggttgaacatttttccatgtttgttgcccatttgtatatctgcttttgagaattgtctattcatgtccttagcccactttttgatgggattgtttttttccttgctaatttatttgaattccttgtagattctgggtattagtcctttrttgggtgtatagattgtgaagatttcctccaactctgtaggttgtctgtttactctgcttattttcatctttctttatttgccctgcatatctatttgtttactatactgtctactttcccctcctagaatgccaacattatgaaggtaaaggaatcttgtccgtcttgttctttattgaatggctagcattcagtagtacagtgtctggcagatagtacatatttgttgaatgaccaaatgaataattttcaaaatttgcttctttctaggacttacatagtcttacatgcttgtacattttcaccgttagacagaaatgtatttatacttgcgaagttaccctttacccattagcagtcatatacatatcttaagtgatttgtagtgctgttattattatatgaccaagtatatgatctttgtaagacacttttttctttttctttttttttttttttttgagacagagtctagctctgttgcccaggctggagtgcagtgtcacgatctcagctcactgcaacctctacctcccacattcaagcratcctcctgcctcaacctcgagtagctggaactacaggcatgcaccaccacgcccagctaatttttgtatttttagtagagatggggtttcactatgttggccaggatggtctcgatctcttgacctcatgatcctcccaccttgtcctcccaaagtgctgggattacaggcgtgagccaccgcacccagccctttttcatttttttaaaagcaccccaaattccctaagatgcaggtaaaatgaggaaacattaaactgaaaatagattagtgatgtacttttctgaaaaattcggagattaactgaaagaccaacataagctttattatttagacatgscttttcagttcattttcacatttacatatgtaatgagatatagtatactatttaaatttaacattaggtgactaactttaagctctgttaaaatggctgtatttttagtagagacggggtttcaccatgttggccaggatggtcttgatctcctgacttcgtgatctgcccacatcagcctcccaaaatgccgggattacaggcgtgaaccaccgcgcccggcttctcttagcacaaatttcaagtgccatatataacatattattattaactrtagtcaccgtgctgtactttaagtccccagaacatactcatcttaaaactgcaagtttgtaccctttattggtcattaatttgtttcttgaaaacttggtatgttcttggtttaggagaggcaacctcatagtactaaaatgtgggcaaatgtgtagtcatttgtgagctgtgatggaagcaaacaaataacataagcttccatcctgatattgttttaattatgcccactaaagactcattggaaaaacatttaaatgtttcaaaactctgaagggatagatcatgtattaagaaaatggaagttgccttagcaaccaactcctctctttcaatatgggaatccaggagaaatttacagacatcattaccatcgtctgtaaagggacaaagtaatttgcagggrgagtttttaagtttaagtgtcttttcagtagtagagtaacacggtagagtggttcttgagatcatattattttaaaatgacttaacttgcgtagagtacaatattcaacttttctgttttcctagaagtcatacatgaatctaaattgttttaaaatttttatttagtgttctgatacttgttttaaatttaaccctggaagcatgacaaggaaaatagtagtttaaaaaaagtatgcaattttttttaggttattgtcttttctgaaaaaattttagtgtaatttaaatgttagggctttatgtcaagttttatctttataatgttttcactataaagtagtgaggctgtgttacaaagtgcaatatgtgtatattcatatgtgttcaggcatttactgagtaccccctctgtattaagcactgtgctaccaacaaggtatataaagatgaaagacacagcccttgtcattaaggagcccatagtctagtggaagagacagataagtaaagtaaaaactatagtcaagtatatatgccgtataaaaatatatccaggatggtttgtcagcacagaagcagagtatctaagacttagggcatcaggaagacttctagaacgraggatgcccgagcttaaaggaaaacaggaattggctaaagaaggaaagaaccatcatgtcccatctccagtaagacttgcagatatgaaagaacattcatttattcatttattcaacaaacatttgttgagyatctattatatgccagacatatacaatgtaatactgccttggggacatattagaacatagaactagacacactcctgcctttttaggcatatgaagagaataatacaataatcacaaaaaattgtaaaaactatagttgtgataaatgcagtgaaggagaagtccagggtgctgtgagaatgtgtaatagagtggggattggggcagtattccctgaggaagtaacactaaacctgacaactgaaggatgggtccataaacaaagattatacaaaattgtactgatttcacttttactgttagaaaatgtaggttcttgggtatctttcaagatcttcaatgagttcagtctagctagaacgtagcgcacatgtgggagaaggaaaagacaagctggagaagtaggcaggaacaagatcatggaaagccttgtatacctttctaggaaaattgccttttatcttgaaggtgatcgatattgtgaaccatttgaggatttgaagccaagctgggagaaacataatcagatttgtgttttagaaggatcttcttgagaaagattactgtggaaggcaaggctgtatctacttgtttctttgctaagtaatacatgataggttctgtgtttttaaattttaataccatatttttgttccttcagttctgccatatcagtggcttttctctctctctctctctctctctctttctgtgtgtgtgtgtgtgtgtgtgtgtgtgtgtgtatgtgtgtggtacacaaatggtgagaaccagggtttttaccctaagtgatgggcatggcttctaaagatttctcacagatcttacaataactgaattggaggaaatatattttacatattttaaagtgatatggcacttacccagaaataaataatamtaactgatgttttcagtagaaaaaaaacaattgggaaattcctagattgtgctatttgcatttttattgacaaggttgctgattttaaaagtaagatagaggttctgtttaaataaataattggtaataaatgttgattttccataaatgtggtttctcatttgaaaatgtagagggtcaggccgggcgcggtggctcacgcctgtaatcccagcactttgggaggctgaggcgggcggatcacgaggtccagagatcgagaccatcctggctaacatggtgaaaccccatctctacttaaaaatacaaaaaaaattagccgggcatggtggtgggcacctgtagtcccagctacttgggaggctgaggcaggagaatggcgtgaacccctaaggcggagcttgcagtgagccgagattgcgccactgcactccagcctgggccactgagcaagactccgtctcaaaaaaaaaaaaaaatgtagagggttagactaactgacctctaaagacctttctatcatagtctatgattctgtgtttgcttttcaacaggtcatttttcaatagatacatacctttgctttgctgtactgacacaacaaattaaggcagtggttctcaacagtggataattttgccacccaggggacatttggtaatgcctggaarcatttttggttgtcacaactggagagttgcctactcatttctagtgagyaagaggtcagggatgctgctgaacatcctagaatgtagaggatagctcttcacragaattgtccagcctaaaacgtaaataataacagraaccctgaattaaggcaagattgataagactacctttggttaatatatagtccttgagtagatatgacattctatctgtactataatatttgttttttcgttcactcattcattctaaacattgccaaatgacgttaaacacatcatcttcgtattccatgtgccattatctaatacagagtaggtggtgttgagatccctgaggggtaccaataaatagcattcttcctttgctgagttgtgggccagttgagaaataaaataagaatattcatctgcaagccaaaatattaccgtctgtctactaaacactgaattagaggatgtagcttgtatttgctagcatatgggcttccaaattctgcacctcagaagacttatccacctaggcatagcagcactggactgggacaagctccgttgcagagaccatctgcaagggactgaatgtttggtcccccaccgtccaaattcatatattgaaatcctaatccccaatgtgatggttttaggagcggtgagacctttgggaggtaatagttcacgagggtggagtcctcatgaatgggattagtgccgttatgaaagtgactccagggatctctttagcgctctttttgccgtgtgaggtcacaatgagaagtcaatgatctgcagtccagaagatggccctcactagcatccaaccatgccagcaacctgatcttataaacaatagatctcttttgtttataagccatacaggctatggggctttgttatagcagcctaaagtgattaagacactgtctttagagaactaggtcagaacttgcattacctttggttggctcactcccaagaggcaaaaggagggtgctgagccaagcatatgtagttttgtttttttccaaatttgccagccaagaagctattctctctctccttgaccatagggaggaaaggcatagagaggggccaagagttttatgccacttgagctctctccatatggaaggatacatcagggaaggagaggaagccttctccataatgggtcccaataaatgctgacagattatgatgtagaatctactgtaaagtctacagggggaatatcagtttattttttttctgggtttgtgtacttttattgtgtctaatctgtccatcagttaaccagtagccaaatgactacagccaaaacaggggaaaattaattagaattttagattataaaagggaccttaaagattatttagtgtattggctctcagtcttggttgtacattggagtcacttgagaagcttttaaaaaaatatatgccagagtaccatcccagaccgtgtaaaataaaatcttaggtgggaggaagtaggacctgagcatttattattttgtaaaataccccttagaggattctgctgcacacccaagattgagaatcactgatctattctaaccttctcattttataaaaaattaaaccagagcgtttgagtgaattgcctgaggctgtaattagtgaaagttagagtaagaatctggccttctgcctcagagtttagggcttcttattgaaaacaaagtgagttccctttttttccccataattttagttcaacaaaagaatttgcaaaagcaatagtcttacgtctggagatctggattttaatctgattctggtgttagcttattaagtcattcggcctcattttccttcttttttaaaattaaagaattagactagagcatttccaaggttttttcagtcagtaaaaccctatgcttctatggtttcaaatataaagaatgagctttattgctccttagggttaattgttgttttaatttttagtaagaatccactgtctagcaagaatgatgataggtgctttcatttacattcattccttttaatggaaacattttaggataggtttctgatggggaatctttaatcattaaaatcaagattctactgctatttaaattataataccttgagctgggcttcttagtttcattaatttactgaagatgtggactctaaaaacatatttacatgatagagactatctggaaaaatgctgttaattcttggatatttccaagtgtggatatgttcacatatctgaataattacttgactccttttaatttaatctgaatatttctgaatatttctcaacatataacaaaacaaagttaccatttatggtatttcagttatttttgtgttcatttggttattttctttttttggggggtgggggcggagttttgctcttgttgcccagactggagtgcaatggcgtgatctcggctcaccacaacctgtgcctcctaggttcaagcaattctcctgcctcagcctcccaagtaactgggattacaggcatgtgccaccatggccggctaattttgtgtttttagtagagacagggtttcttcatgttggtcaggctgttctgaaactcccgacctcaggtgatccacccacctcggcctcccaaagtgctaggtttacaggygtgagccaccacgcccggcccatttggttattttcttagagcaatcaacttagaaagtattctttgacatttaagttgttaatttaaattgttacagattctgactctaaggacaggacctattatattccaggtactaagccatgtacctcccccttccctgttccacatagctctgtctctggcacttaagaagtatataataaattttggttggcttatttactattttatattctggcattaatagcccactgtgtctttttttcatatatatcacaactggaattttacttttggcactatctagcaattagttataatagaagccctaagactaatgaataggattatttcaagaaatgcttttactagtgttagttatttataggtccttctatgcttgttcattattttatgaccggataagttttcctgactttttcttcctgaataaacctcaggtgaggcaggaatccagacacttactttcagccatgttcgaagaaaaggaaaatgctctttaagcagtcttgtttccttcagcctctattcttagaattctatccagaaaaggtatggcacagttagttctttacaagtctcatctgttttattttacattgccattaactttctttttttcttttttgtattttttagtagagatggggtttcactgtgttagccaggtcttgatctcctgacctcatgatctgcccgcctcagcctcccaaagtgctgagattacaggcttgagccaccatgcctggccctacattgccattaactttctacatattgtagatcttttctttagtatagataaaaacttctatttgaaggcaaacattagatggtcctactttattttcattgcaaatctctatgggatttatgtgcatgtcaaatggcaattattattttggaataaaaatgttaaaaatttaactcatgttcagtgactcaagtttgaaataatgtcatgagaayttttactgaacttgcattattggttattatttattgtatactgagagtttggtggcatgtaatattcaaaaaaagaaaatattaattagtttagacatgcaaagtccagggatatagtgaaaaatacattaggtaaaagttcaaaatagaggttacctcttactgtgatagggtaggaggagggaggagaattagattgggtatgaatatgcagagacttcaactatattgatagttttatcttttaactagatggtgggtacatgaagtacatagagtacaaaaataacttatatacctttgtgtgagaaagatatttcataattttttaatggtaaaaataaatgaatataggttgtgcaaacagcataagtgtaatttttagcctatcaaggaatgctgatatgatttgttgaaaaacttggcttaaataaattttctagtgaaatttgaaaatcgtggaattatttggcaatagaagcagagtgtttcaagtctaaatggatgggagaaagcaaaactagtgaaattatgcttgctggggaataggaaaatgagaaccaggtggcaaatgaccagtcactcaaccagtttcttgttacagtcagaatatagtcagaaaatgggccaygagtgacttctatttattttttttgatacagaatctcgctctatagctcaggctggaatgcagtggtgtgatcttggctcactgcaccctccgcctcccaggttcaagcgattctcctgcctcagcttcccaagtagctgggattacaggcgcccaccacacctggcttatttttttgtattttaagtagagacaggatttccccatgttggtcaggctgatctcgaactcctgacctccggtgatccacctgcctcagcctcccaaagtgctgggattacaggcatgagccaccacgcctggcccagccccatgatttctgtttggtgttttaaaagtattttctatctctttgtttaaatgcttacttcatttatgcattgttctcttgacttcagttagcatttctgttcagtattttgaattctttgtcaggcaaataatataattacatttcattagggtcagtttctggtatttatcttgttcctttaaaacatcattgcctgattctgtttcctttactctctgtgttgatgtctacatattagatagaagagaaccctctcctagtccttactgactggacttgcaccttcaccaatcagtgtggccagagatcctggggtcctctatcaactcttccaaattgtttttcaaaatagttttcccaagcagctgtataccattttacatccccactatcagagttccagttctccacagtcttgccaaccgtttttattgtcttttttattgaagtcatcctaatgggggtgaaatggtagctcattgcggttttgttttgcatttatctaatggctaatgatgtgttgagcattttttcatttgcttattgaccatctttaaagacatatytattcaaatccttttgatcattttaaaattagattgtcttcttattgaattctaagagttctttatatattctgatataaatcttttgccatatatatgactggcaaatattttctctctttctgtgggttgtcttttttcactttcttgatggtatcttttgaagcacaatgattttttattttgatgaaatcaaatttactttttctttcattgcttatgctttaacaaaacattctctaattcaagatcataaagatttattcctatgtattcttctaaraatttatagttttagctcttatgtttagttccatgatgcattgtgagttgctttttgtacttagtgtgagacagggatctaattttctttcttttgcatgtgtgccaagaacagctcagtcagggagaccctaacccrgcagcgctagaggaattaaagacacacacacagaaatatagaggtgtgaagtgggaaatcaggggtctcacagcctgcagagctgagagcccgaacagagatttacacacatatttattaacagcaagccagccattcrcattgtttctatagatattaaattaactaaaagtatcccttatgggaaatgaagggatgggccgaatgaaaggaataggttgggctagttaactgcagcaggagcatgtccttaaggcacagatcgctcatgctattgtttgtggcttaagaatggctttaagcggttttccgccctgggtgggccaggtgttccttgccctaattcccataaacccacaaccttccagcatgggcgttatggccatcacraacatgtcacagtgctgcagagattttgtttatggccagttttggggccagtttatggccagattttgagggggggcctgctcctaacaygtcccccttattcgatttgcaaatcrataaaagcaagggcagctttgtcatggtgagctacttctcgcaggagtcaggatccacatctgcagactatacaaagacaaacaacacagattaaaagcacaatcgtcattgaaatcacagagcttccaagtgtttttatccattttaacaggttactagctgctaatttgtctgcagctccttcaagcactccagttcctggcattaaggtcaggtgtgcctgggatactttaaatatttgttctttaattttgcaatagccaaagacaagtttgtagagtgtctttctagatgcttttttattctttaccaaattttgatcttattaagagctattaatagtttccacaaatctttgtgtttagctcctacagcgggccatatcatatgaggttgaggtgccactataccaccatggttccagataataggaactcttgtcatactttttatcatttctgccatccgacsgttttgttcagaccagctgaacatagtgtggccgtggcatgcagactgacaggtgcaatttaagctaaacatctccttaggggaccaattaataatgattccataggaatcgttgtgtagcacctctgtctgttctgcagtgcaatcttcctaaacaagtacgttcattatttctggccaggttcaattttgtttacaaataggtttttgagggtggtatgcctcaattataggagcagatttattatggtaaatactgagatcagaaagcgtgtgtaactgtgtcatagagtgattacatccaggcattattgccagccaaaatggataaatatgcccaataagtataattgttctctgtgtcagcccttgttgaaggaatactcayggcagtggtgataaccrctatcatagctaccattaaattattcattgtgactgactgtccccctttcctccggttttcttctgccatctgtgacagctttttgatctgtccccagatgagtggctgtgttcgacgggtgttgcttgtgtcagttggggtcctcctcagcatcagcctcsacatggctgcaaccggggggtccttgggatcctcccagaatctcttcctcggcatctggctcatgataaagtttcaggtgtcttgatggtatccaaatcagctgttgattttgacctggagaaacgcaagcataacctctaccccaagttattattttatctatgtcctaactttttgttatcggatctctccaccaaaccaattgttttgcttctgtctttgcagctggtttctgtagttgctgttcagctgctgataacatctggcctttgggcaggctcaaaaaatttaaagttaataatgccagattcagttgcatctgtggggttccatattctctgtctccccctttctgcttttgcaactgctgttttagggagatattcattctttccactatggcttgtccttgagaattgtatgggatgccagtaatgtgtttaatattccacrtagagaaaaatgtagctagagcttggctagtataacctggggcattgtctgttttaatagaagctggaatgcccatcaccgcaaaacactggaaaaggtgacgtttaacacaggcagaagactctcctgattggcatgtagyccagacaaagtgagaaaaggtgtccacacatacatgtacataagctagtctcccaaacgagggaacatgtgtgacatccatttgccaaagagagttaggttccagtcctcgaggattaactcctcctttaaaagatgaggaatgtaccatttggcaagttgggcatcactggataatagctttagcttctttccaggtaatgctgtatctgygtttgagactagaggcattaacatgggttaaattgtgaaagtgtctagcattaratattgcmttagcaactaggcgattggccatttgattcccttcagtcaaaggtcctggaagaaagaggtgtatgagccctaatgtgagtgatgtaaaaagggtgcattctaattctaactgctgtttgcaattgggtaaataaagtcatcagttgttcatcacttgtatgaaattgtaactgagcattttcaattaactatgtggcatgaaccacgtatgaagaatcagaaatcacattaataggcatatcaaaagcagtcaatacctcaattacagctacaagctctgctttttgatctgaagtataggacatctggaaaactttactttttgagccagaataagaagctttaccattgctagacctatctgtaacattttcagcaccttcarttggtttaaatttagttattttagggagaatctaattagttaatttcaaaaactgaaacagttttaagaaaatgattatcaagaatacttacaaagtcagctaaatgggtttgccaagtaagactatttatagaagcttgctgtatttgtgccttcgtgagagggacaataatttttctaggatcatatctatgtaatttaacaatctgagttctccgaatccctatcatagtagcgatttgatctaaataaggagttagagtccgtgaattagtatgtggaagaaaaagccactcttactaagtcctgttcttggacaataacacctgtaggtgaatgctgagttgaaaaaattagcaaatctagagtctatgactattaaaggccaattttttggaattacagcaggagaaggcaatcctggctgtaatgctcacataggttgtataactgaattgatggctcttaagtcagttaacattctccatttacttgattttttcttagttaggaaaactggagaattccaaggggaaaatgttggagctatgtgcccattttctaattgttcagtaactaatttctctaaagcccccagtttctctttacttagtggccattgttctatccaaattggcttatctgttaaccattttaaaggtgtaggttctggaggcttaacaatggccaccatcaaaaattatttcctaatctttgtcaggaactttgtttttccacttgaagtggttctttcaaaccttgcaaatttttttctagtcccataccagggacataccccatttcacgcatcatatgttgcctttgagggctatataattgttctggaattagaacttgtgctccccattgttgtaataaatctctcccccatagatttataggtacggaagttataattggttgaatagtcccaggttgtccatcgggcccttcacaatgcaagatataactactttgatatacttcaggggctttaccaactccagctatgttaaattgagtaggttgaattggccacgtggacggccagtgctatagagaaatgattgaaatgtccgctcctgtatctaccaaacctttaaatttctttccctgaatagttatttcacaggtagggtgtttattagtaatttgatttacccaataagctgctttgtcttgtttatttgtgcttccaaatcctcctgtttgtttaatttcacttttccccatgtccacatacggcacaatcaggagctgtgctatacactgtcctggctctgctttccagggaacagaagtagatgtaacaatttgaatttcctcattgtaatctgagtcaatgactcctgtatgtgtttgcactccttttaaatttaaactagaccttcctaaaagtaatcctatcgtccctgctggcaagggtccacagagccctgttggaactttttgcggggggttccccaggcagaaggctcacagcttttgtgtagcatagatctactgcggcactaccggctgtggcgggggacagacattgtacaggggtgagggaatggcctgagcyggaaaggccccggtttagaatggggcctgggacgggccctcatggtgtttcccaaaatcaggttcccatctttatcaaacttagagtgacactgattagcccagtgttttccttttttacattttggacatatttcaggctcagcagttttctttttttccctcaactggcggcctgacttgctgattttttccacattcttttttagtatgaccgtgcttcccacagttaaaagaagctccaggaaatggagtatttcctttatccactctcagtcctgccattgcctgtgctagcagagtagccttatgcagattacctccaataccatcacaggccttgatgtaatcaactaaatgtgctttcctgaatttaaaaggaaaaggctcaaatgtagctataatatttccctgttgatctggggggtgtattctaacagggaactgccaagcctctaaatcactctctcatctagcttgctgaattcctgcctgaataaaacttagagcggttgctcgaggcgctgctcgaacaatcactggggcaactacttttcacccagtgtcctctggaaaagaaagatatggagggtctttttcttcaaaataataatgagggggtgcagaaggatagggatgaacctctccttcctttgccactttagctggtaaataaatatgctctgtaacctcttctgttactttgctatactctccttcctcctcatcatcagtgtgaaaaagttccaaggtggaacaaaccacaccccacacttatcccattgttaccctgacgcttccaagctccccttcttactcaccacagggattgctttaagagtactctggtgtcctccagctagttccacattctccaaccatcgctccagcgacccttcracctggattcgagcccccacgatggatgccatttgccgagaccagctcggttggggagaccctaacccagcrgcactagaggaattaaaaacacacagagaaatatagaggtgtgaagtgggaaatcaggggtctcacagcctgcagagctgagagccccaaacagacatttacccacatatttattaacagcaagccagccattagcattgtttctgtagatattaacttaactgaaagtatcccttatgggaaatgaagggatgggccgaatgaaagkaataggttgggctagttaactgcagcaggagcatgtccttaaggcacagatcgctcatgctattgtttgtggcttaagaatggctttaagcggttttccaccctgagtgggccaggtgttccttgccctcattcccgtraacccacaaccttccagcatgggtgttatgaccatcatgaacatgtcacagtgctgcagagattttgtktatggccagttttggggccagtttatggccagattttggggggcctgctcccaacacatgtggatatccagttgtcctaacatctacttaacctrttgaacatatagaatacagttgtagtcattgttttagtatatttgctaattttaacatttgtgtcagttctgggtagattttaattgatactttctacattattagttgtattttctccttatttgatatgtctggtaatctttaattggttgtcagcattgtgaattttaccttgttagttgctggatatttattttttaagttcaggggtatgtgtgcaggtttgttataaaggtaaatttatgccataggagttygttgtaccaattatttcatcacccaggtattaaacctagtacctattagttatttttcatgatcctttccctcctcctaccctccaccttctggtatgcagtgtgtgttgttcccctctatgtgtccatgtgttctcatcayttcacttccactaagaacatgcggtatttggttttctgtttctgcattagtttgctaaggataatggcctccagctccatccatctctctgcaaaggacwtgatctcattcttttttatggctgcatagttttccatggtgtatgtgtaccactttttctttatccagtctatcattgatggrcatttgggttgattccatgttgttgctactgtgaacagtgctgcagtgaacatatgcatgcatgtgtctttatgatagaatgattttatattcctttgggtatttacctagtaatgggattgctgggtcaaatggcagttctgtttttaggtctttgaggaattgccacacagttttccacaatgattgaactaatttacaytcccaccaacagtgtataagcattcctttttctctgcaacctctccaacacctgttattctttgactttttaataatagccattctgactggtgttgaaacaggtcagggttactggtcttgttgtcttaaggtgttacccaarctcatcatctcacaaccaagagaattaaggagcatggacacaaaggatgaggttggagggaaagtttaataagcaaaagaagaaagctgtccacagcggagkggggagccagagtggattgccgttttacagttgaactcaaaagcttttataagaaactcctgtcatctctgtagctgtttgagtaacttctcttatctgaaaagctgtctgcataactctcccttatctgtgtagttgtgcgtatgtctctaggcatgcacaaagcaccctttctcttgtytgtataactgtgggtttcttttaggtaagtccccctcctccctgtgcaggttcccacagagcccaccatgtatatgcctgaaagggacaggagcctttttcctgggagcccactaatcacacaaagaacaaaaggcttctgtgttggatcttacctgcttatctctgcaggtgcagcctgagttttccccaggctgctctatttttgcctgtagccatgatttttcaggcaggctgcttctccgaggaccagtcttaactgtttacctaaatgatttttccttttcttctccctcagtgtgagatggtatctcattgtggttttgatttgcatttctgtaatgatcagtgatgttgmgctttttttcatatgcttgttggctgcgtgtatgacttcttttgaaaagtgtctgttcatgttttttgcccactttttaatggtttttttttcttgtaaatttaagtttcttctcgatgatggatattagaccttcgtcagatgtatagtttgcaaaaatcttctcccatgctgtatgtggtctgtttactccgttgatagtttcttttgctgtgtagaagctttctaattaatcccgtttgtctatttttgcttttgttgcaattgcttttcgtgtctttgtcatgaaatctttgcccgttcctatgtccagaatggtattgcctaggttgtcttccagggtttgtttgagacagagcctcactctgtggcccaggctggtatgcagtggcacaatctctgttcactgcaacctccgcctcccagattcaaatgattctcttgcctcagcctcctgagtagctgggattacaggcaggtgccaccacgcctggctaatttttgtatttttagtagagatggggtttcaccatgttggccaggctggtctcgaacccctgacctcaggtgatccactcacctcagcctcccaaagtgctgggattacaggcatgagccactgccatgcctggccgtcttccagggtttttatagttttgggttttacatttaagtcttttatctatcttgagttaatttttgtatatggtgtaaagaaggggtttattcagtcttctgcatatgggtagccagttatctaagcatcatttattgaataaggattcctttccccattgcttgtttttatcaactttgtagaagattagatagttgcaggtgtgtggccttattttggggctctattctgtttcattggtctgtgtgtccgtttttgtaccagtgtcttgctgttttggttactataaccctgtagtagagtttgaaatcaggtagcatgatgcctccagctttgttctttttgcttagcattgccttgtctattcgggctcgtttttggttccagtgcattttaaaatagattttctagttctgtgaagaatgtcatttgtagtttgataggaatagcattgaatctataaattgctttgggcagtatggccattttaatgaaactgattctttctaatracaagcatggaatgttttcccatttgtttgtgtcatctctgatttctttgagcagtattttgtagttctccttggagagatctttcacctccctggttagctatattcctggttaattttttgtgtcarttgtgaatgggattgtgtttctgatttggctgttggcctgttkttggtatataggaatgctartcatttctgtacattgaatttgtatcctgagactttgctgaagttgtttattagctgaaggagcttttgggccgagactgtggggttttctagatataggatcgtgttgtctgcaaacagggatagtttgatttcctctcttcctgtatggatgccctttcattctttctcttgcctgatctgcctggactttcaattctatgttgaataggagtggtaagagagggcatccttgtcttgtgttggttttcattaagaatgccttaccttttacccattcagtatgatgatcgctgtgggtttgtcatagatggttcttattattttgaggtattttccttcaatacctagttaattgagagtttttaacatgaaggaatgttgaactttattgaaagcctttttctgcattgatatggtttggctgtgcccccacccaaatctcatgtagaattgtaatccccatgttggagatggggcttggtgggaggtgattggatcatggggctggtttctaatggtttagcaccatccccctagtgttgtctcgttgacagagttcttaccagatctggctgtttgaaggtgtatagcacctcctccatcactttctctcctgccagccatgtgaaaatgtacctgcttcccattcaccttccaccatgattgtaagtttcctgagacctccccagaagcagacgcctgtwcattctgcaaaaccatgagccaattaaacctcttttctctgtaaattacccagtctcaggtagttctctatagtagtgcaagaatggatgartgcgtgcatctattgagataattgtgtggttgtctttagttatgtgatgaatcatattttttgatttgtgtgtgtatgttgatccaaacttgcattccagggacaaagcctacttgatcgtggtggataagcattttgatgtcctgttggatttggtttgcgagtattttgttgaggatttttgcattgatgttcatcaaggatattggcctgaagttttctttttttgttgtgtctgccaggttttggtatcaggatgatgctggcctcatagaataagttagggaggagtccttcttccttaatttattggaatagtttcagtaggaatggtaccagctcatctttatatatctgatagaatttgcctgtgaatccctctggtcctgggctttttttaattggtgggctatttattaccgattaaatttcagagcttgttactagtctattcagcaattccatttcttcctggctcagtctcgggaggatgtgtccaggaatttatccattttttacaggttttctagtttatgtgtgtagaggtgttcataatattctctgatggttatttgtatttctgtgagttcatttgtaatatgccctttgccatttctaattgtgtttatttggatctactctcttctttattagtctaggtagtgatctattttgttaatttttttttttcaaaaaaccaactccaggacccattgaggttttggatggtttttcatgtctaaagctgttttagttcagctctgattttggttgtttcttgtcttctgctagctttgggattggcttgctcttggttttctagttcatttagttgtgatgttaggtttttaaattgagatctaagtttttgatatgggtatttagtgctatacatttccctcttaacactgtcttagctgtgtcccagggattctggtatgttgtatctttgttttcattggtttcaaagaatttstttttctgcctaaatttcattatttacccaaaattcactcaggagcaggttattcaacttccatataattgtatggttttgacagaatttcttagttttgatttccagtttgattgctctgtggtccgagagtgtggttgttttgatttcagttattttgcatttgctgagtgtgttttatgtccgattatgtgattgattttagagtatgtttcatgtggcaatgagaaaactgtatattctgttttggggtggagaggtaatgtagatgtctatcaggtccatttgatccactactgagttcaggtcctgagtatcttttttaattttttgcctcggtgatctaatactgttggtggggtgttgaagtctctcactattcttgtgtggaagtctcagtctctttaggtctctaagaacttgctttgtgaatctgggtgctcctgtgttgggtgcatatacatttaggatagttacgtcttcttgctaaattgaatcctttaccattatgtaatgccctttttaaaaatctgtgttggttgaaagggtgttttatgtgaaattagggttgcatcccctgctttttctgttttccatttgcttggtagatttttctccatgcctttattttgagcctgtaggtgtcattgcatgtgagatgggtctcttgaagacagcataataatgggtcttggttcttatccagcttgccactctgtgccctttaattggggcatgtagcccgtttacattcaaggttagtattgacatgtgtggatctgatcctgctatcatgctgttagctggttattttagacttgtttatgtggttactttatagtgtcactggtctgtgtccttcagtgtgtttttgtagtggctggcaatggtctttccatatttactccttccttcaggagctcttgtaaggcagatctggtggtaatgaattatctcagcatttgcttgtctgaaaaggatcttatttctccttcacttatgaagcttagtttgcctggatatgaaattctgtgttggaatttttctttaagaatgttaaatattggcccccagtctcttctggcttgtagagtttctgctgagaagtccacagttagtctgatggacttccctttgtaagtgacctgacctttctgtctagctgcctttaacattttttctttcaactttggagaatctgctgattgtgtgtgttggggatgatcctcttgtgaagtagcttactggggttctctgcatttcctgaatttgaatgttggcctctatagctaacttgggaaagttctcccggatgatatcctgaattatgttttccatgttgcttacactctccccatgtcttaaaattaaaattggtcatattggattatagtgttatggctatatcttamcactgcaggtaaaatgagttccactatattagtgttttccagagaaacagagatagatgggtattggctgatcgtaaggaattggctcrcgtgattatagagactggtaagtccaaatctgcagtgtgggccagcagacaggccggagaccctggagagctgacagtgtggatgacgcccacgggaaatcactggagatttttctcttgcttgggaagctggtatttctgttctattcaggccttcaactgtttggatggggcccacccacattatgaagggcagttggcttactcagacttcactgatttaaatgttaatctcattcaaagcaccctcaaagttgacatataaaattaaccatcacatctaccacacagtaaaatgagtagttttgaaattagttctcagacagtatgatatatgaatacatttttttctctgtggattcataaaaatatcaactgtaaagggagatgctttctgccttcatcacattttgtaatcctttgagattttatgggaaaactrtagattttctgagttattagcattaatcaataggctctaggacctacttgtttgaaatgtgccctgcttgtattccagaccaaagtaatgaaatcctaattaatgtctttgaaaccatccatgagatctcatctggcattttaggctcatagtctgtaaaggattcacagaaattctatttggtttttattagcaacattaaatgtattccccaattggggattagtagcattttaatacatagcatttattatctattagtataggttaagaacagctggggacctctttgagccagccatctgcatggataattcccaggatagttttagcctaggcatatccagaacagctgtacctggacaggcttcatccttgctgtggggctggcgtctctggcagtgttttttagccacagcctttcccctgcaggcttatggctttgtctctctgcaagggttatgtttgtgctggtggtaccttttatccattatattgtcaagtgataatcttaaaaaccccatcatgcatggaaatcttatttggtcttgaaaacctacattgtcatattacccaatctcattgatattatcaggctaaaaccataaagttatctgctgtaattgtaagtttctacacacataacgtggacaaataggtataaagctccacagcacccaacccagtgccgaatgtcttaggttttacatactgctccagttttgtctagaacgtcacatgtgaatcagcatttcttttctcacgtggttgtttctgccttctgtgttccacatgcgttataggcaggggtgcttcctccctgtctcttttctcttcaagggcttattccaggttcctgggaaaagagctgtattatccttggccagccatgatgctctgctctcattcataaggctactgaatgttactgtcacctagctgctaaagtttttcactctggaattaagattaacatgtgttcatctattatgaagactggattcacagttcttttcctaagcttgttctttcaggaaaagcacttttaactcagtagttttatatgccattcctttgggggmgaataatcaaggatattcagtaagctctcttggcttcacttagttatttttgatattattgagatagaatattcaagtaacaaagacaatgttctttaaaaaataggttttagtatacattcttctaaagtcttcctccgttaatattaaacttgttaatatgtccagttataaacatctaaagaattagtagcattttaatatatgacatttattatcttattagtataggttccaaatatataaactacttcttaatgttattttctcagtagacaatcaaaattactactgtaagaaatcccataccttggtcattgaatcaatttaagaccaaacaagagatggaaaccacacagtggattaaatggggaggaagtttaatakagagtattattaaactctgagaaattaaggaaattctatgcagtcccscagggccttgggagaatacccaaggaaagacaaagtgggaaggaggtcctttcaccaaggctgggggttcagcccaaaggacagcagagaaacgcactgcttccccaggttgtactggtctgcagttgcttggcaagcaggaagcggccctctgcagtgcaggtgggcacaggcaatcagcaactaatggtgtggctgtgtagagggagcagaagcttagtgtgggcaggaggtcttcagaatattggttgccttgtggagagggcatggggaggttatcactaggccaagccaagactgtaagtgagccaaggaaccacaygttctgggtgcatggctggagcagacctcccgcagacccytcacactgtcagcagccagcagcggcagagccccttcctcctgcagagtcctccgcaccctccaccaagaaagtgtcatcacgttcactgtaaagcaattctgtccattacggcagagcatatatggaaggcaaaatttggagctcagtggcagtgaattgacagctagcacattcatagtcttattgtactctggaccccttttttctctttactgtttaatgcttactgtggaatgactccctttatagattttacaacccaactattgtaaggaagaggtggttcaggaacaaagcttcaagttgaattttggtaccatcatcttagttttcttgtccccattcaggagtagttagacagacaatgaagtagacacactagttacctgtaaatattaaactcattacttcccctaatgctttggatttcctcagtggcaccaattttgaaattggctggtttaactacagtttcaggagaaatgagaggtaattattaaagaaaaawacagaagtatattttctttgattacattgggaactataattcatgtatatgttaataatagctcattgatacttgaatgtgtttattatggttattaaaaaatgaagttttggccaggcgcggtggttcacgcctgtaatcccagcactttgggaggccgaggcaggaggatcatgaggtcaggagatcgagaccatcctggccaacatggtgaaaccccgtctctactaaaatgcaaaaaattagccaagagtggtggcacgcacctatagtcgcagctattcgagaggctgaggtaggggaattgcttgaacccaggaggtggaggttgcagtgagccgagatcgtgccactgcactccagcctggtgacagagcaagactccgtctcaaaaaaaaaaaaaaaaaaaagtttcagaatgctatattggcttgttttatattgaaaatgaggttcttgaataatatacagacacgttcccctacaaaagttttaactaagttaatcttttaaaaaaccagtaaacatgttgagtctctgagttcctgtgctgagcacagatgcttcaagatcttctttttcttaaatcaggctgacttgttagcacccttttcttgtaattttctgaacttttcatccccttatcaataaataaatgtgacagatgtcttttactggttcccttagcttactctgttagcagtatctgtccattgacttaatggctgctaataacttgtttggtatctgtagaactctacagctgtgtgctagagcaatggcaggaaactacacgagaatcatcgtgttccaggctctactttgctgcccctcccccgatagggatttcattgttctcaaaatggattttttcagactgcaattttagaaatctgttggtcagtctagtaactcaacccacgcactagtgatttttgcagagaaggacaggaggctgagatggtctcataaaatgtccataaggtcaagccttgttattaaaatatcaaagataataatggtaatgaaaatgaaagacattaagaaccatctttagatttgaaaagcagtggtacccatgcagtttttctctccttgtaacaacagtagcttctgcagtcagccactcccctatttatgcctctttccccgcatcacacttctctgcactgttttcctacactgcagagtgcagacacttaatacagacgggctgagtctgtgtgtgccctgtcagcagccgtcctttttctgagcatatggttttcatgcttcatctcacccccagtgacctctccttgtgagaaggctccctcagctctcttttctaaccaataactgtattcagctagctctgcagaatagctccaggtggataagtatgactttccaacttacatggaaacaggcagacatactcgctatatgaaacccttatttggccacctaataggaactggaagcctaggagattttttttttttttaatctaccagaagtttctaaaaactctggccgtaaaaggagcctctctcaactggaattagccgtgtctgtaggttcaagggctccatcgtgctggtttattcagcagaatagctcttactgtatcccgtctcccttggcaagggaagggttttgctcttaccacgttatagtgggctcttcatatccaccggctctgcatccggggattcaaccaatcattaattaaaaatacctgggaaaagaactaagaaataacaatacaacaataaaaaatacaaatagkccgggcgcagcggctcacgcctgtaatcacagcactttgggaggacaaggtgggcagatcacttgaggtcaggattttgagaccatcctggccaacctggtgaaactcagtctctacaaaaatataaaaactagccaggtgtggtggctcatgcctgtaatcccagctactcaggaggctgaagtgggagaatcgcttgaacccaggaggtggaggttgcagtgagcccagatcatgccattgtactccagcctgggtaacaaagtgactccatctcaaaaaaaaaaaaaaaaaaaaaaccccagrgtataactcattacaaaccatttactttgtattaggtactataatctagagaggatttaaaatatacagaaggatgtgcataggttatatgcaaaataccatgccgtttatatgagacttgagtatctggattttgatttctgttggggtggggtggtcctcgaaccaatcccctgaggatcctgagggatgactgtatctaggtaaagagactggtctcaggtcataggagagctccattcaggccagtcacctcaccatccctcaggcatcccatacgtccccccgccccccattattgttgcacaaggcatatcactttactttcttttgttcaggtcctcgctctttttaaatttacattccatgttttctgtggagccttttctagcccttccagccctcacttttctctaacttctacaccatgtatcatctatacccacagcttaatacttatatttcctcttgtggtgtccgtggatgtttatgtgacccaaactggattgtaagggggatgcattctacacttctctttccccctagttgttcactggtggttgcttgttaaaatacacaataatttgttgcatatatctgtcccttaaaccagatttggcttcaggtaggactaaatgtggttaaaaagtgtagagccttcattatctctaattttcagattggctgttgtgaattcctaagtatggcaaacagcttctctattttagatttatggcacttacagaaatgttatttttaaggctggtctcagggttaagctgcccatacttgagggtgtcagagtgtggcctggagcagtgtagcttgtagacatctgttggtaaagggctcctgccctgtacaggttgcttggtggtactttgttccaccacctccattctctcttacttgactgaaatccagatatcagcatgatactgggagggggttggtggcttgattgctgaagtcagtttagtgctttgggaaacctgaaacacttcagatcccaggcatttcagataagggatactcaacctgcactatacattgtccctttcttttttttttttttttgagatggagtcttgctttgtcgccaggctagagtgcagtagcacgatcttggctcactgcaacctccaccttacgggttcaagcgattatcctgtctcagcttcccaagtagctgggattacaggcatgtgccaccgcacccaactaatttttgtatttttagcacagacggggtttcaccatgttggccaggatggtctcgatctcctgacctcgtgatccgcccacctaggcctcccaaagtgctgggattacaggtatgagccaccgtgcctggccccaaatatataatttctaatcactgactttactttcttaccactttttgcctatcacttttattggttttaatcatttatatcttttcatgtgagatttgaagtatgcatactgtcctagagtgtaagctccatgaggacagggttgtctgttttgcctgctgtttttaccccatgaacctagctcagtgcctggcatataattgaggctcaataaatattagtttgaaaaacagagtgaaagcaaactctagggtttggggggaggtgaggtaggtggcagagatctggacagagaggagtttatggaagcaactgaatcaggaagctgggtaccagaaactcaggaatgggagggccctgggcttgggcagggatggccaaatgcagccaagaaaagctctagagtggcttggagacacctcccaggcagccccttgccttctgtcaagcagcaagaataacagaatgtgaacagtgcaccagagttagagggccagctctgaaagcagtataaagataaaccacacacccgccagggggagaagaggtcacaagtcccgaagctcgagggggctggaaatctcagattaccactgtcgcaaatgacaaacaggccgggcaagtggctcatgctgtaatcccagcactttgggaggccgaggcaggtggatcacctgaggtcaggagttcaagaccagcctggccaacatagtgaaaccctgtctctactaaaaaaaaaaaaaaatatatatatatatatatatatatatatatatatatatatatatatatatatgtatgtgtgtgtgtgtatgtgtgtatatatattatatatatatatataatataatacatatatagctgggtgtggtggcaagtgcctgtaatcccagctacttgagacgctgaggcaggagaattgcttgaacctgggaggcggaggttgcagtgagccaagactgcaccactgcactccagcctgcacaacagagcaagactctgcctccaaaaaaaaaaaagtaaaatggctccaagcagcagagctgggattcatatccaggtgtgtctgactctacagtctttgtcctaactcccctgggctctgccaccttcacaagatgtgtctcctcctcttctaagccatgggacttagaacctcatgcttaaaaatctgtagcagcctcttaactcccatctcttctctttccagtccatcagcacacatttaccagaccacattctcttagagccctccttttgtcattacttgcttcctcagtaatctgtagccattcaccactgctacccaaatctgaaccccttggcttagcattccaagccccatccagcctcagtcttcctcagaaactttatcctcctttgcccttttgatcgactgtctaaccccaaatgcagagctgatayattggagccattctgcttgctacaataccggtctctgtcttctaatatccatataaaaatccttcaatgaaacttggaatcctgttccactgcctggtgaacgcccttgcatatatgcctatagtcttattcaactcttgttttacttatcttctgtatctatctgaaagctcctatagaagcatgactacatactctacttcatyttatttccccatagcatctgacttagtagcataaacatggtagatatgcaataaggatttgctagctgagtaaataagccatgcgtctggtggtctgtctcactagatttgctttacaatatgttccgccacactaaagaagttatacatgcaattttaaaatgaaggaactaggatcttgcatatatttctgattgagaatttcagcttgttgggaaatatgcaaacttyagcgtcctcacagctcaaagtacaaaaatattggtgtattgactgccagtggggcagaatgaagggccaggccacaaaaaatattggctataataaatactaagttcatttgcttttggtttgtgatatgctattcagtgaaaaatgaaccttccagaaatttctaaattagaatatttarcattactttcaaaataatgaatgcccttgggaataaaataaacataattataattcaaaatataaagtcaaagaactgaactgtgcatgcaatttacctcaggccactcattttttttcagtagatttacctttctaattatattttgcttgcacaaatatttaaattacttygcattccctgagagcagtatacttcttgtgtcaaggaggacacacatttaacaaccataaaactatctgcaaaagcaaaaagctcattttccccccaaaggagctttttaagaatcaaagcgtacaactgatcaaatagttgagcaaggtacacacagtagcttagcagggcttatacatttattttattttctatatttgtttgggtttattttttctttttcattccctttgtgctctacaaccaagagaaagaaacatcttcaaggaattatatctgctatgtaattatacagtgctgcaaattgcaatgttagctgaagttaagggcagagaatgacagggtaactaatagagcatgatctaaacctcattaagtaatgggtatcttcctgaggaaagaatacagggttgtctcaaggctgagtctaagaattgactcctatcttgttataagagtttgagaatgtaataactctttgtttcttttttcaaccaaagagccaggatgagaatataaatctttgttagtgtttcattgaggcattgtgaaaaggcatattattgccaaacagcaaagaaggaaaacatcataaatattatgaatcaaaactttaatagtggaagttacttatttgtggtttgattggcctttgaaaaacaactgacagtattgattcatgtacctccaccctcaaaaaattttatttttcattttctggtcacagttggtttttgtgttagtcatgttgtatgatcacttccattattgagaaagtgatttcagctccctttaaaaagattaaagataagttaatgagtttgtgatatttttatattatttttaaaatgggtactggatactataataaggtattatcttcactttcctatggatgagctctgagagtggtttgaatgagtcattagcaaactaagattccacttcacaggagtattttaacaacaatctgaagaatgtgtgtaagttcttaataaaaggaactagggctccttggagaaatggctgcagataaagtacaaataaacgagtaatgtcttctactgccagaaagtaaagaagtcttcagtcaaggatgggaatagttgaaaggacacaggtcccgagctaaatctggaacaatataagtaacaaaataaatgatagtaacaggtagcaatacacagaataaatatctgtgggtccatgcttatataaataattgaataaataaataaataaatgagggagaaggagcagcttttggtgcttgtgtcaaccaagaaaaaaaaaatgaggaaaaaagtctccaaatatgttgaatttatttgggaattataacgcaagttggcctcagtttatcagtggagatgccgttactgggcaggtgttctttcgtgggcatcttatccgaattgctgcagtcctaaagaaagaatctcttagagttattttagaaagtccttgagacaagtctttatctcagacatagcacaaaccctcccctcttcaggctctgctggcttaagtttgtttgggtctgacaagatgtgatttcatcccagtatcttcaatttcacacatagaattccaattaataaatgtagaaggaatgacgtaaatagaaaatctgaagaatcatggtgtgtggtttaaaaaaaatcagtttggcaaacaccacagtaatatttgttgcagacaagagccacctatccatgctaaaattggtgaaagtatggtgacaaacaggatatttgcacagtcctaaaatatcttacaaagagaaaaatagtaactttataatgragaaacctagacaggcaccacaaagttaataaacatcacctgtaacgaagtttatcaacagcatgtacctcctaatacaatacaccaaaaaagggtgtgtcatcacatctatggtgattatttccctgttgttttagattatacattttgaaaaaaaatcatagatttatataaaattttaagaaatacagagccgtcatgtgccctttgcctagttccccccaatggcaattaagttgcaaaacagtagtacagtgtcacaaccaaggtgttgacatgaatacaggcaagatacagaacatttccatcactgtaaagatacctcagtcttactcttatgtagccacacccctttttaagaaaattgggttgttttctcattatggagtggcaagaattctttaaatattccagatcatatgggttttttccctgtagtctgttaatacagtgaattatactaatttaaaagtatagccgggcacagtggctcacacctgtaatcccagcactttgggaggccgaggcgggtggatcacctgaggtcgggagtttgagaccagcctgactaatgtgaagaaactccgtccctaacaaaaatacaaaattagctgggcatggtggcgcatgcctgtaatcccagctactcgggaggctgaggcaggagaatcgcatgaacccaggaggcggaggttgcggcgagccaagatcgtgctattgccctccagcctgcgcagcagagagagactccatctcaaaaaaaaaaaaaaaatgtataaaactaatttaaaatacataaagtcaaagaactgaactatgcatgcagtttacctcaggccactcattttcttggtaaattttggtaaaatatacataattaccatcttaaccatttttaagtgtacagttcagtggtgttaagtccatttatattgtgcaaccatcactaccatccatctccacatctcttttcatcttgtaaaactcaaactctacccattaaacaacaactccccatccccccgtatgcccagtccctggcaaacaccactcttgctttcggtttctatgagttgactactttagatacatcaagcaagtggaatcagagtatttgtcttactgtgacaggcttatttcccttagcatagtgtcctcaaggttcatctagttgtagcatgggtcaggatttccttccttttaaaggctaatatattttacgtgtatatgacctcttgtttatctgttcatccatcatggacacttgtgttgcttccagcttttgcatattgccagtgatgctgctgtgaacatggatattcaaatatccctgagactctgctttccattcttttgggtgtgtacccaaaagtggaattgctggatcaaactgatgctccttttgctctctttttctctgagccctcactctgagtatcttttccttttagagctttaggttttaaaagttctcatccatttattctttaacacagtaaacccttaattacgattgttcagagaatatagtggttattgaatttcttggctaaatcgccagaaacccgtttcaatccttgctgtkgaagaagtktgttcattttattctcatagtaaacataattgaatctgataattcaggatcttgcagtgcctcggagctatgtgaacatggattctcggcctaggataccccagggatataagttatcagggactggagcaaagcactaacccttcacagccctataaaactatatctttgagtttaattatttctgtgtttataaacaatatagtattatgtaatgattgatatttcaaaggtgattactaaaggttgtttttttatgtggccatctttactattttcctcctctctttctttgcatccccatatcaccagataataggctctcaccctcgctctgagtaaacacatttaatagacgtaccttgtagaaagaagtggaatctggttcacatcttcctcacccagctgcatttctctcttactacatgtcctggtcagtttgggctgctataataaaataccacagactgggtggcttaaacaacaaacgtgtatttctcacagtctagaagctgagaattctaagagtgaggcagaagtcastgtctgatgaggacgctcatcctggtttgcagatgctgtaccctcacatagaggagaaagggatctggtctcttcctcttctcatagggcactaaaccaatgattagagcctccaccttctaaacctcatctaaacctaagtactcctccaaggcctcacccccaaataccatcacactggggattagggtttcaacatgaagttcgtggggatacaaacattcagtccacagcactacactttcaagaaagaaaaacagagctttggatgagtggggaccagagaaagagtagaaccaagaggaaagaaagcaaagaaattatgaagaagcataaaggaggggaaggaaaaaaaaagagatggagtgaggaaagtcccaaagccgggcttcaccttttccctctatctttggacaaataaagccttgttccctctggatctgaggatggttctggaaggcatgaatcaactacgaggatcctcctgtggctgtgacagtggataactaaaccacaggttacttagggcaggatgaacctaatcagcatatacaacaagcacatcttgactgcctgccttccacagcctcctgagctcagtaactaccagccaagaatgaaaaagacgaaaccttcattccgcgttttatttaccactctgtggacagaagagtagttccccaggttctctaagtccgttctctatcccgtgcccatacattgctctaatcctggggctggagggtctggagggaggcttaaaggtcagccttctttagcccttcagccgatagtgtccacagtgcttaggggcagaggtcctaccataccacctcttacatctgacctgattttaactctgcctgacaagtagtaattaccttttaaagagctggagaaatgaagacgcctggtatattttaaacatagttcccccaggcaggtgtgactgggttcttctcaatgcgtttttatcagactgcggggtttgcatgaggtacgtccaggcttggaagcaccctgggaacccagaggcttaacgactttaaatgtacttttttcatatggtaccccaggatgaaaatgaaggtctttttagagtaatttggttataaagaaattgtggtacctgagtggcttttttgtgcaggagtcaaaaaacaaaaaatataagcaggcttgattgatcttaagagattactgatgttgcatgatttgtggcctctttactacttcatttctaatctgaaattgctactctcctgtggcatcattaacattataaaacctaagctagttttccttacaaatgtgattcctgtcctaggatttccagtctgacaaagaaataaacaggagcaagtaccatacacatgagtaattcgcctgcaaaaagatgctcatgaagataccataaatcactggttcttaatcagggtgatttcacccgttggggaatttgtctcatttgagaaggagctgctactggcatctagtggggagaggccgaggatgctgcctaggatagacagcacccctccccaccacgatgaagaattatctggtccaaaatgcaggtagtgctaaggttaaaagccctgtcaacaatgtgcagaagatacaacatgaaccggtaaattggctaaattaggaaaaattcaaaatgatgcccacaattgtggctacttgtctctgggatttttaggascccccatcyctgctttagctttttgttttgaaatcactttagacttacagattggatattttcagccctatttccttagcgtgtgggaggctttgctagatgttgaatgaaaaatgggatgaggaccaaatccatttaggttttacttccatgtcaactatgtgggaaacagttgagggctcagagcagagaggaaggcttggagataagcttgtgggcttcctagaaacatccagcagggtgtcctctgcatccctctgtgtgtttgccctttgcttctgcttggcttaggtcgcttagtgccagtggaattggtgtcggggaggggtgcgggggagacacctcctgattaggccactgatgagctttggtcctcagagaaaccatttcccaccctaaactttaccccagtcattgagggtggccgggacaatccagtgggccactacctattaaataaatatgtaggtgtatgtatmttataattagaacatagacacctggaaagtgaaaatctcccataattctgatgataaacttacatacatttaaaaactggaaaaatatatacattaacacaaacattattagagataaacatggaattataattttacagtacattatactgttttacaacttggttgtttttttttttgagacagggtctcactctgtcgcccaggctggagtgcagtggcacgatctcggctcactgcaacctccgcttctggatcaagggattctcgtgcctcagcctcccgagtaactgggattacaggcgtgtgccaccatgcccagctacgttttgtgtttttagtagagacagggttttgccacgttggccaggctagtctggaactcctgacctaaagtgatctgcacattacaggcgtgaaccactgcgcccggctgtacaacttgtattttttaccatgctatattgtggaccttttttgttctagtataatgagtaaattacttaaagttgtctgtaaaataaggattatagtgtctatccacctacttcagagatatcagaaagacacaaatataaattgagatttagaaagtcgattgagtcttttagatgaaarttattatataccatgctgactttttcattgactataccaatgttgaatgattttattactagtttcttttgaggtgttactgaaatatttttaaagacattgagtcctcagaaaccattatggccaygttaatatagtttgtgtaatatagatttcaagtgtctttttgtgtcttcacaggcaaatacatgtatcagcctatgacccctgtggaacagcttccaagcactgagattcctgccaggcctcgggaacccacaaacaccattcagatctcagtctcgctcaccgaacactttttgaaatttgcatctgtcttccagcctccccttccccctgactcaccgaggtactgtatgatttcagacctttttattgacaactatcaggttaaatgtattaatgggaagatgtgttatgtgcagaagcagcyrgcaycacattcccacagaatgagccctgaggaggtctctgcacacgatgccttaatttcaaaagagagcaatacaccaaaaatagatcactgctcttctccctcaagttctgaggactctgggatcaatgcgattggggctcactatgtggaatcgtgtgacgaggacacagaagaaggagcagaactgagttcagaggaagattacagtccagagagcagctgggaaccggatgagtgcacccttctctccccctcgcagtctgacctggaagtgattgaaacgatagaaacgactgtgtgagmgtccagacaggaagccacagcctcggacccacgccgagcttttgtacctttgtctggtggatccttttttccaatgctgttgatattttctacccaccccgccccgctccaaccaacaaccgtagcagttcagtggtatgctgattagcttctctccgtcttacaactaagacattctttttattataaacagttttcttttgtatcctgacttactttctatgtagcatctggtgtcatgaattgtgaccccgccttaatttcactgggagatttgaaggcggtgaagtgatggtcgcagagaatcttggatcagattgaggaggtaccgaaagggaaggagccggtgttttctcggtagccagtccttcacagagactcttgccattccctttggcatgttcacaggcactcccgtcctgtcctgcttgtcctacgcaagtagcactccctactgagtgtgcactggtagatgccgtttcttcccttccccttctccccacacctgcactgggtctggatcagagctgcctcggcttacttctgggaggtcactggaggccagctcagcccatggtttgtggccagtgtctgtacaaggctccgtgactggggctgagctaaacattcacatgagaagagatgacctcatctgtctcatgctcaatccagccttagctgagcacctgtcccctgcagggggctgtggggacacagcatgaataagacctgattcccaccatgaaggggcccacagtcctatatatgacacattcaactcatggcacccaaaaagctctgggaacccaggggaaggatgaggtttacttggctggggctagctggggaatgtgtttcagcatttgagctggcttcttggtgggttccccaacatttttctgcttttaattgttcttcaagtctgggaaaaactcttaggaagttatataggtatcacatttaggtggcagccacatctgacatcttaaggaaaaaaaataaattaatagttttagttagcatggaaatgctacagacagaagccctttagggattaggactgaatctaataggtttgattaattctgcttcatttggttgtatgaagcattcgtatggtttaagtgaggaatggattagaattcagtgtgatgcatggatttttatgcagctgcaaaagcagttgaaatagtttgctgctaagtcaggagaaaatatccagtgtaatagccattcactttcccacacagtctgtctgttgtatgtgttctctcccctcacatgcacaaaatagtgactaattctttcttatttagctctcttcagaattctacttctactctccatttataccaggtattcttgtgagtcagttaactgctatttctccaaaccttctatccatgaggcatagtttcaaatcctggaaattttaagtatggcctaatgagaacatcagagttggagacagaacagtacttccatcctaactatccagaagcgcrctctcaggccattgtgctctgagattcccttgtgctctggcaccattatggtacatctctacgtcacattaatttttttttttttgagatggagtttccctcttgctgcccaggctggagtgcagcggcgtgatcttggctctctacaacctctgcctcctggggtcaagcgattctcctgcctcagcctcctgagtagctgggactatgggcacgtgccaccacacctggctaattttttgtatttttagtagagacgggctttcaccatgttagccaggatggtctcgatctgaccttgtgatccacccacctcggcctccccaagtgctgggattacaagcatgagccaccacgcccggccggatttgtaagaaaaagttgtgttctcccctgaagcctccatttggcatcattcacaaactactcaaggaagaatttgctttcccagttgtatgtataatttaagtcgtttactagatagaacttttttttaggtttagatggccaagacatctatatggtttagaaggcagagtatacattttcctttgcaaacagtatgagttaaaactttctatgctaaatgagaatgcggcataaagtctccacttactgaaatttaaagattcaacaagacaaaccgagaagggggtcagaggagctctaggaaaggcccaggagagggcagttggaggcaggtgtgagcatgaggagctkccccctgccagggcatggctcaggtggcacagggacatctgatgaaccctgcccgaggttctcggtgcctcccgtgcatgagtggctcactgaaggcaggtgtggaagccaaatgcctgcaagccgtgtgtcaggccacagcagtgcagtcatgcatcacgcactcaggtttgtaacagcaacaccagggccctgtctagattcaccctgtgggtgagcccgttctccagatgggcgtataaaggggctttctcctctacaccgttcctgtcaatgttccgtacaggcccacattcccaccactaagccaatggagtcaaccagatttctaaagccatggatatacgtggtcacggggccacatttctgcagctggctcagtggcaggcttgggccgtctctcagtaccatctaagacttctgtctaggttcctgtttttttagamtcctgaactgccattctgattagacacaattttaatggaatttttggatttaatratagttgataatcaccttatgtatttgcacaatctctttataattaaaaactcgctaagcttcacttgctactatctactatatagaattagagacattccattggattctaagcatcagacactcctggatctcaaaatgaccttttctaaataagcacaagatttatttttgtcctagcactgttgataacactctgaaatatgttattgaactggaattgtttctttatgcttgcattccaaaaccaactgaaacagattgtagtttcactttaaattctaggcctgttctatattatrtgaaggaattctctgtaacgctgatactatgttgctaatttgtgtacttacagrcactttagaaaatgtttagactgcaacatgcactataacattgaactcagtcacatgaagtggttaacacttgcacactgactgacagatatgaaagctgtatactttggacccagtaatatgctcattggagcaagggttgggctgtgtggatggataaactgctttcttgggtttacatggaaacctggtaccactcctacttttggaaagttggtataaaagctattaggtagaagcttaattccactaaatgtagaatttagttttcttctctaaccaagattttagaagtttcaagtttcaaatatgcttataacttttccaagaaatgatgattacagtgcttttgtggttacaactgtttggtatattaaaaaataagggtttactatcacatctaggtcttttttactatgtcatttttaagatatgaaataagaatctgaggacagccctgaagaacagtcctttcctgggaggggaagacttgtaattcaaggkcatacaatacaaaataaaacaaaaacaaaagcaccaagagcagaacaaaacaacgtagttgctttcctgaaatactttttggatttgattctatcttgggagtggtggctttacttttttttttttttttttttttttgagacagagtctcgctccttcacccaggctggagtgcagtggcgcgatctcggctcactgccagctctgcctcccaggttcatgccattctcctgcctcagcctcctgagtagctgggactataggtgcccgccaccatgcctcgctaattttttgtatttttagtagaaacggggtttcaccgtgttagccaggatggtcttgatctcatgacctcgtgatccaccctcctcggcttcccaaagtgctgggattgcaggcgtgaaccaccacgcccggccggctttacttctaatcctccacttcttggtctatttgaaccatcacaagtattttgggaccgataacaaaccccttttatgctaatttaattcttgacttgggtaataggtgcacctggataatttataaagctgtccatagatctaagtttagtggtacagatactactgggcaggagaaaaagcacaagttaaaatatttctacagtcagctcttaatattcccacatcttgtttgcaaaattttatggtcacgttctggcttttttacatgaggaaaacaaagttttaacagttttctcttctgtccccttctccagaggaggtgtgaaccagaactgaggaggccagttatattttaggcttttcagtagtacgattttgtcctctcccactgaggaggagggaagaagggggaagccagtgggagttccacacacgtggtcagtgctgtaagttcccggatatcagtgtctctcacatcaacacagaaatagggcacttctcaacattaattttggaattattcaccatttaaaaattgtcactgctctttttcattactgtagataactgagagttagctgttctaggaaaaggccatgtttcagttagtgctatgacttcttttttcgattaaggttgaagcagtgttctcttagtagcctgaacacttctcaaagcgacttatcactagcggctttaatattgagcttctatatcgttgtgtccacctcactttttaaggctgttcatacctggcaatattcacttactctgctatttttaaaaactattttaaagttttaagcacaatgttgactsttctgtaatttcctaaaattatattgttttcctacagacagctcaactttccttgatatgtaacactctaggaaaataactgccttgtaaaataaacgtgattttttttttcttttataccagaacaaatctgctgttttggagtgtacccaaccccaaaaccaaaactcacgtttgcaaagtgtgaaacatttatatatcaggtctttcctacgtgctaggaaatagcgtatggccattaccccattaaacctttacaagacctcaatgaggtgcagataaactgtactgtccgcagtatctactcagagtcaccactcatgataactcccagaactctggctacattgggtttatagcaaataaaacttgataccccccccccaccaccaccaaatagcatttatttcacacgcagttacagcctttctgttcggcttacacgtgtcatgtggggcagtgttggctgcagttctaactgaagatcaggcatcgagggaggctgctgcccggcagagcttgggggggtcgcttggtcaccaagactcaggggccaggcctcagcgcggcaagtccatactcagaaaagaacagcttcaagggttggagtctattgaacaaccttcctaggaactgctaaataaagtcattatcagtaataaaatccttgttaatattaattatagttcaatggctaccttaagctttctatgcataatctccacagcaaccctgtgagggagattaaagcagccccatttcacagatcaggaaaagagctcaagaagtccacatctttacccagtgtggcacagctcgtacatgagtggcagtcagggtttgaacccggtcactttggctctagagtccgcactcttggcccattgtctgcattactccatccccctaacccagcagataccttcccacagactagtgcctcgtctacctcagtgcacctggtcccaacacagtggaggagaaacactgacaggcttccctctttgtccccttctctgtcctccatackytgcccccccaccccgcaccctataccatgtctctgcaaatatctctatgctctgatgaggccattgcttcttccatgtttaatcacctcttgactagcattcaagactagctctgcctttcctaaagctaactgatcttttaaagtgattcctgcagacagcgcatctcatctgcgtgtgcactctactgttttaactctctacctaattgtattgccaagtcctagaaggcatctcattgtagcctcttacaaatgctgactgcacacacttttattctgcaataaactttaatttagcatctcatcctcattacaattcagtcactgggaattggtaatgcccttaacccttactgtcccaccctagttctatgctgaatgaagggagtaagaaggatctctggactcagcctccctgcggtagggtcaggaaggggcagttagaggtcagatggaattcttcaggaatcagggagatacgggaaattgatggaaataaaaaggcaaaaggaatgtgccaagattaatagtgtttgttttaaattttctacttttctgaaatgaagatacaattacttttacaatcagaaacgacccagtaagttattttgatgatgtcaactcctaggacagtgagtacacatggagtctgattttgctggatctgtgcctggaagtgggttgaggccgtggccaaacctgctcatgcacctgctggaagagactagcagctgggctgggagtgtgcgtcatgaaactaatgggcctccacggaggagtgacccctttcgtggctggagagttcatgggccaggtgggttggagaaaggggtgaggcttcatttcttcctgtcttccccagtccccagcctgaagttgtgtgtgactcgagataggagatgagaaagcttgggatccggggggaccatcctggccctgtatgacacctagctggtcacctgttgtcaaaccccagtgattcctcccaggacaaagatgatgacaaaatacaaggcatcgtggatcagcagaacaccacaatgtctgaacagggacctgcagtttacgtagcatcttcccagatggcagcttatctgctagacccatcaactctgtgtggtggacagggcagggatattggcgagtttcttgcgaagcagccaagagttaactttaaaggtcacatggcaggaagtggcaaggtcagagccccagacttctgattccaaagccagccttgctgctttaccacttgttgagccgctgcaacaaaaccctgccctgctttgcagcccattttctcttcgccccacagctgaggccacgagggcatcccttgcctcgagggaactacagctcagccctcaggtatcgcccgaggttgcccttggtgccacatcactctgtgcgccagcctggcttgacctggatctgagtctgtccggagaacaggcatgacctcgtgctcaagcgtggccgctgggtctgagaactcatcctgggaattggcctcgggtcggcctttttttttatttttatttttattttttgagatggagtcttgctctgttgcccaggctggagtgcagtggcacaatctcagctcaccacaacctccacctcccggcttcaagcgattcttctgcttcagcctcctgagtagctgggactacaggcgcccgccaccacgcccagttaatttttgtgtttttagtagagacggggtttcattatgttggccaggctggtctcgacctcctgaccttgtgatccacccacctcagcctcccaaagtgctgggattacagacgtgagctaccgcgcccaccaggtcggctctttcagcagcagctgctcctgtctccctccctcctacctccattgggattgggacctttgataccaattgcttccctcaactattgcatgtcctcagtagcatccgctttggacttgcctctcgggccagtctacttcaggcgactgtgtagatcctgactgtctgattacctggccacgagtgtctcatacctgcctcaaccaggactgtgtgcagtaaacaagagtacatttcagccctcatgtttagaagctgcctgtgtgagttgcaatgccaaaattcacagagcaaatataggcacacccatttatctgcagaaggacctggaaaagccatcctggtctatgagcatcaccactccaagcggtcggacaggactccggagctctcgggaaaagtgggaaggccacacagtaccaggaggggaggttcaccgtgggccaggtgtgagctgaacaggggattcccagagcgtgttttccctgagaacctggaataatgaggcaattccagcctaattcagaggctgcactgagtatgtgggaagcacgtcagatatttggggttcccggggaaaccaaatgaagatacctcgggaaaccaaatatctggatgaacatggggcacacagtggagatctctgacgagtcaccaagaggccagtggaagatcagccagtccagctagaattcactgaggtcctttcacatcactgggggtccaaagaggtcagtcctatcccaaagggatttttgctgtccccatcatcatttccaagggtcacaggcagtgaattgctagagctatccagtgccttctgagtcaatcagggagtcacctgggcccacattatgccacttagagagggactgatggggtcacggagaggccagcagcggtgagtataaagggaggcagttacctggaaacctcatctcatgtggagatgaggcaggggtggtgtgggggtgggggctatgggcatgctggaggaggatgggccgactcattcatctagagagaagaggctgggctgggcacggtggctcacgcctgtaatcccagcactttgggaggctgaggtgggtggatcacgaggtcaggagattgagaccatgctggccaacatggtgaaacagtacctctactaaaaatacaaaaattagccaggcatggtggcgtgcacatgtagtcccagctattcaggaggatgaggcaggagaatcgcttgaacatgggaagcagaggttgcagtaagctgagatcatgccactgcactccagcctgggcaacagtgagactccgtcttttcaaaaaaaaaaaaaaaaaaagaagaggctgggttgggcaaaccatcaggcccaagtttgctaggggctgggatgtggaccccaagactactaggacccaatgctgacctttgagataggcaaagcacagggatctgagggaacagatgtctggaatgggggactacagcttctctcataagtgcttcaatgtgagcccagcgtggtggctcacacccgtaatcccagcactttgggaggctgaggtaggaggatc

SEQ ID NO: 12191 - DNA, 120087 bp, Homo sapiens
atagagagttggagcaggacccccatggagatggtttctgctgttctcttcccattcctgaagtcacggtgtgtccttggccataattcctttgggaaattgctggaaccatggtgagccagtcctcccttctgtgtttttggtccctctgcagataacagcaggcattgtcctaggtgctttattccagtaactcactcagccctcccacacacacgcacacacaagcaccactgatcatgctgcagatggagaagtggaggtacagagagattcagtaacttgccaaggtcaccccgtacttcagtggcagagagtgaatttgatccaggcagctgagatctgggtttgtgctggtgaccacaatacacttgttctcaagctggaggctctcccagttgctgtcttctcatcttcaccctctgggcactctggagggcatttcctaagggaggctggaggcccagccaaggtgcctcttaatgtcaagaatatgctttctctttggttcttctgtggcacctccaggaggtcacacacgtgcccttggtcagccatttggggtcaaagttcttcaccagaactctgaaaaacttaataatggtacattgagaatgcctggggtgctgggcatggaggctcacacctgtaattccagcacttgggaggccgaggtaggagaattgcttgagtccagaagttccagaccagcctgggcattatagggagaccctatctctactaaaagcaaaaagcaaaaactacaaaacaaaaaatttagccaggcattgtggcctgcatcttctagcactttgggaggctgggaggtggaggatcactttagcctgggagttagaggctgcagtgggctatgatcaagccactgtactccagattaggtgacaaagcaagaccctgtctcaaaaaaaaaaaaaaaattaaaaagaaaaaaacccagaatgtcaaacgtatcaataaccaccctggagtgtgccattaagatgaaggagaaccaggattcatgttcataggtgcactgatggctgccagcagtggtttgaacagtgggctttttgcaagaatgagttgcaatcctttagtgggttaggactaactttagtatgctgggaccagcattctttaaacataaagacacagagtagattgagtaggaagtgtcagagtgtatcacatgaaatatgggtgatatggtttggctttgtgccccacccaaatctcatcttgaattgtaatccttgggtgttgagggaggaacctggtgggaggtgattggtacgtgggggtggttcaccccatgctgttcttgtgatagtgattgagttctcacaagatctgatggttttataagtgtttggcaagttcctccttctctcattctctctcctgctgccttgtgaagaaggtgcctgcttccccttctgccacgattgtaagtttcctgaggcctccccagttatgcggaactgtgagtcagttaaacccatttcctttacaaattacccagtctcaggtagtatctttacagcagtgtgagaacagactaatacaatgggtaagtgtatgtgtgtggatatatatatgggtcatgacataaaatgtatttattgtggtttgtagttaaaaaaatgtttgaaaaacattgggcttgagtactatttactgtgctggccacccagcacagtaacattactgtactgtaattacagtacagtaattactgtaatgttttgttttctcatgaattgctgtagctatgtactgatatactttaaatataaagataattgtggagtgcattggcactgtatgtggtatgctgcagatctaaagctctggccgtagatctgcttgaggtaatgatttgaggggtctgtggcaggtaggtgggagtcaaagctgcaggaagttggagctctagcaaaagcacctggggaggctgtgaatgagtaaggaaagagcccagggcagaacttgggaaccacctaccttgagggcaggggtgtaggaaaaagagcccacaaaaaacactcactgtaatgcaatagataaagaggtaggaggaaaatcaggagggtgttggtacctggagccaagacaggagagagtttgaatagtgaggaaaggttcaagattgttaaatgtggcagaaggtcaagttatataagcgctgaaacgcgcacctgtgcttgagcaacacagagctggctggtgacctcagtgagggcgcagggctccacgatgagatgggaagacctagagacgtgggggaagggacacttcctccagaatgtttggtggtaaaagcgaggagcacaagaggccattggctagaagggaggataatttgctcctctagaaacaaatttgaacctagtttttcagaaggagacaatataccccacatgttaggcttactgaaatgggcagaggtatgtaatttttgtttaaagggatggacaaagctatggtttttttttcacccatttttcatcatgtctgaacagtgaggtgagaacttacgttagtttttgagacaaaattttagacttgcaacaatgattgctgttgctttttttttttttaatgcaagcaacggccaaattattttggaattacgatcctaaattgatcccagcctgatacaatcaaaggtccagaattagaaggagaaaaagtggagagtgaaacagtagccaaaagaaaaacttcactgatatactgtcaacagctgtgctgttatcactctgtaaagaacaatgaaatattggaatgaaaatggaaaatgctgtgggtaaccaatggaatcctgaaagacagattaagtttcttcaacatttataatgaaaaccagactgaaaataatttttaatttgtctttttgcttcatcaaatcttggagaggattcggatataggcatcttatcatttgacatttattactcaagataagaagattatgttcaggtttgtgggtctccaggatgcaattataacattgtcaaagtagattaccaggtgttgcataattattgtgccgtttaaggaaatttgcatctgagtataaacatgtgtatttaattattttcctggggggtgacaaaagttccaggactcctgattaagtcatccatcctgtctaacaacctttgggcataaagatcatattcagagataaaggacctatataattcctaaacaaacaaacaaaaaactttgtccaatttgggaagcaagtaaaacataaccaagctaagaaaacacaaaactacgaagaaaaagattcaaatgaaacatccttaggctgccctctcatagcagggagtaattgccttcaggtaaaagttgattccggaccattcaattcactgaaagctattcactgtcttagattaaccagcacctaaaaacacttgactaaataggctagaaataaaaatgttttccttgaataaatgtatatattattggttttgtagatgagaaataccactggttttgccgaatttaaatagtcagctatgtaaagggtctctggactaggaaaaattcctttattcctaaatattttggcttcaatatttgaaatctgcaaaagcagtatttctatctgtcaaaatgaggccattaagttttgattattcaaacctggaatgaagtgtgtgtgtctgggggtagaggagatgatatggacttcactttgaatataaattacgtactgggtggagcaaatggatttaaagaaagaggaaccctggttcaattctatttgccagtcaaggtgactcacttgaacatctgaaggccagcgtacctgtggaaagagactatttcctggattttcttctgtgagtcaagatgcttaaaacccatgtcttttagtatctgtcattttggagttgtaagggaaaattgagttttaagcataaaggaaaaagcatcttatgctgtgagaaaaaaattgacatcagaatttctcagaaagaacttagtgaattttttaaaattatttgacgttatccttgaatgactgatttcgttgtccaaagacttaaagaaaggagttggaattccccagactttgccaaactgtgggatggcacaataggtattgtcaggtcccagggccagaatgaggtagagattttatgtagtttctcctttgttaataacatttaagctgttttcgttctgatttgcattctcctgattagtgcagttggtcaaagctggtgctagcggacttggccagatgtctggagccatataagctgattctgtgtgggagatgctggggctggttcctgccctcctttcccttcctccttgcagacagagttccattttgaggtggtcactctcttggctgtgtgttcggggtttacagtgacccaccctaaaggcagaggggcagaggtggtgcagagactggtcatcggtctctaggggcaatcaaggtaattcatctcccttgtccctgataggctcggtgcaaaacccatcttctaaagggcagctggcctcttctagcggggcagagatcgttcagctttgacccctttgtaattatggcaggagtccagggccccacaccagccaccctatttcaatctccgcagatccttccccttcacattgtgaggcttgacatgtccctgtgaagagccgcaggcatggaacactttgggaaaatccctattcaggctctcactggaaaaccccagactgagggtacaaaggcaatggatcctaagcctgggtagagcagagctgggcgctggtggatcgcagagcctgaagcgccaggagaaacctgctggttacttttattttgtctttgtagtgtcagtctagaaccccacacaggatcttctccatcataggaaagtgttccgaggaatttgacttggtatctattttatctctgagaaacttctttgagtagctgccagtaacctttagggctcttttatttaaaaacaacaacaacaacaaacaaacaaaaaaagttcatggccaggcgcggtggctcacacctgtaatcccagcactttgggaggcccaggcgggcggatcatgaggtcaggagttcgagaccagaatgaccaacatggtgaaaccctgtctctactaaaaatacaaaaattagcttggtgtggtggcgaaagcctgtaatcccagctcttcaggagggtgaggcaggagaatcgcttgaaccccgaagtcagaggttgcagtgagccgagatctcgccactgctccccagcctgggcaacagagagactccgtctcaaaaaacaaaacaaaacaaaaccgttactaaaagccgcttacttgtattcattcggacgtctctgtggtttctatcagttcctgaacaggaatgtattgttgtgtacaagaagaatatgttagtgtctccctaattttacacatgcagttttctgtttacaacttccctccccaccttattgtcctaacccttctgagaagctccttcatgtgtaactactaggctgtgatgttttgcagtagagtcaggcagtgctgttgccctcctgggtggaaggggctgtttggaatgggatggagagaaagctggcagtgcacgggacgcaacactagaaatgtgaaaccaggaccctgtcgccgaccctcttagagaaatgtttactgtctggatgcccccagacgccttgcctgagcgccgtcacgctttctgccctttggatacgaagatatccgaatgctgtgcccatgattaagcagacgcttagtaaggaaagaaaacattggtctggaaataatttctcaagcgccgtgactgccttattgcacaaacatcgcctcttcgatgtttctcacaatccagagaggaagtggcatccatcgtggcatgaataggaatgtgtgtttggagccgtggggcggggctggaggggaggggacgctacccagccaacagaggagacggtggggctaggaaaacctcctgggggagcctgcggcgcggtcctttcctgtgtccccttcgctgcgggtcctgcccggggccgcgccaggtggaggccccgagaggcggcgcgtttcctgcgctccgggattgcgggagaagcgtgagtccctgtctccgagactagaggccacggacacccgcgcaggagcatcccctggcaccccgccccacgcccgtccttccggagtctacacatcggcgacctcccgtgtctaggcgcacacatttcccgccccgcggagactcccacgccccgggccctctctgccgcaggcgccagatcccgcctctgggggctggaccgagagggtcctcggcggcttctttaaggctgcggtccccgccccgtcgtcctccccgccctcctccctctcgccgcggctcctcccgccctcccagagcagccgggcggctgggcgcgcgcggcgcagagcaggtgccggggagcccttcgcatgcggctgccgggccggaggtggtagcggcgccgggcgcgctccgcccgcccctcctccgggccgcactgaggctcgggcgcgcggggacatgtcggtggcgacgggcagcagcgagrcggccggcggggccagcggcggcggcgcacgggttttcttccaaagcccccggggtggcgccggtggcagccccggctccagcagcggctcaggctcctcccgggaggactcggcgcccgtggccacggcggccgctgcagggcaggttcagcagcaacagcagcggcgacaccagcagggaaaagtgacagtgaaatacgatcgtaaggagcttcggaagcggctggtgctggaggaatggatcgtggagcagctgggtcagctctacggctgcgaggtacctgggcgcggggctgggagggtcggggacctctctagctcctctgtgcccgcgcagtaattttcccgggctccagctccggggcgcgcatgtccctgactcccggggaccaagtgccaggagcgaggcgcggcgccttctctcccccgcggtgccctctggcgtcgggctcagcggttgggacgcccctgtctgggttcggctgccggtgcccggggatctgcgggcccccttggtggccgtggggagggttgggtcccgcggagcacagtgcttttctccgagctccgggcgcctctgggctccagctgcagctgcgcaaagcggggctcggaggggctcactccagctgcgcctcagcagcggttggggatacagcagccaaagagagcagcgctcactgctgggatccgggcagccctgatttttgtggagaacgagcagggaaggaaggaagctgcctcgtggaaaggagaggttctggggatctcagaggcccccttggttcttgaaattccccgtgaaaatcctgagatggaacgctttccgctttccagccagccccgacggtgtctccataattccgccctgcattatcagagctgcacacgttgtgctttgttgaagccgtagtttttcctctctaagctcagttactcccaytgatgggcgcagaatgagcatctggggcaacctcgacgggtgcctcggtggaagggcgggagccctgcggrgggcctgcgggatcccgggatctgtcagcttcaggctcccagctcccctctcctccacgacatcgtgacttcccaaggtccagggactaaggtcatacacaagtctcagggacgtgtatacatttgatttagggagaaatatgtagaataaactgcagcaaaacgactgaagccaaaatgatctctcatgagcatcttgaataacagttattaattctaaatgaagtgacctcctcttaagggagtggagtttggaaagggtggaagcatgaaggggttaataattaagaatgtggcttctaagctaaagctaggtttgtgttcattcaactgttgtgctcttcaacagagatgacaaccagatgaactcacaggctttaccactaatgtcgggtgttctgtatttgacacatttcatggcctgttgtgaagacaygttttcttaaacaccctcattgcacaagaaaacagcatactcgttactgactactgataaatgattataatataatgaagcttgactgtatgactaatggggttgtaaaaatgtgttgtttctccagtccagctcttacaaaaagctaatttaattgcataaataaaaactggcaaacataagaagtattcatgagatttttataggaagttggcaaaactctgtaaagaaacattatttgatgtagatgggattactgttggatgagtggatgtgctcagtcctgcctctgtagaatccagttaattttcatttatttcatactgttttttttttctccatttgggatttggaaaagattcgaattaatagaaaaagcattgttgaaattaacagtgcaccagcatggttctttttgtgggagactaattaggcttagattgggaagctagaaagagctctacccactgagtagcctgataaacaatatatttaaaaaatacttcagaataattagaaaaaatggaggtttgattgtttcctgtgtggaacatgtaggttaggtatatattttaaagggtaaacatgagcttgaatcttttccttgtattgtacttttcttcttgggttttaaatcttcaacccgtagcaaacagctagacatttgaaagggaggtttttgtggtgaaataattcaagatgctctatatgctgcctgcatgtcattaacgtggcaagtatttttcttcaagttgtttgttcagtcattgtaggctgaaggaagagaaataattaggttgttggcaattwgtaatcactatgctggtggtgtacctccatttaataataaagaaacatgggcaaataagtagccaaataaaggcttgtctctttgyatctatttctctgctgatagtgctctatttttagcattgggttctcttgttgagtaacctttctttgttgatagcttcaagtatttcagcctctggtttgtgaatcaagaaggacgcaccctagcttacagctccgaacttcatgcatacgaagattaggaaatgtcctttttrtacttaaaagtggtaattctttcaaatgtttagcccatgaaagtgacacagccaatttcccagccttcaaacctcaaacctgccaaaggcttgagttatctgctgagttggggtagaatatgaacacatctttaatttcagaagaacttgacccaagcaggttaggaatcagatgacttgaccttttcagaatagaaaataatcttttggagcagtgtaaagygatgtatttagaaagaggaagaggaaagaagaaatacacagaaccactttctgtctgtgtttttttctggaagtgtgcagtgactaatcagttttgtatgagaataatgtcataggggaatttattacctacctactaggtgactaggtgctcttctaggtactttgggctaattcatttagtcttcataacaaccctataaagaagatgttctttttatccttgtttaaatgtaaataaagaagtgaagactcagagaggattaaaaggctgcttcaagctcatgtagctggtgggtgggttggggttgaggatgaacccagtctggaatctgagtccactgtatacccatgaggcctgtctgtaccgtgcaagagagcaaatgtaggtctacaagacatctgtctaaatgtttaaaacttatgagttaaactaacaacatttgtataaaatttcttctgtccactgatcttgacagctacatcttcataatgaccttgaagtctaggtttgcattttgaattcaaaatgttacttcccagagtcatgaactgaaatgcagttaggagactgccctggcctgggtttcttcccttttgcttcccatccttggtacagtcccacctggtaaaggacactgtgtccactcgcacgcccagtcttggtatgcacctgccactccttgaccatgatgcctctgcacacaccagtggtgatgtccccctaggcmagaacagatctgggaggagcttgttcatgccctagaagctacttgggatttgagaagggaattctggggacccggatcacagactaaaaccaagtggaggggcactggttctggatagatgtgtccactttgtcctaggaagtcttcaggaagacaggttatggcaggagtggggcccggagatgtggtcccctcttacccagtctaagggcagcactgtaaaataccacgtcaaatagccttttgaatacgtagataagtgcttttattggattccaaaatgatttgttatgtgcttatagttcttttccatctcatcttctcttgggaaggcttatacaggtacattttcagctaggaatttgattataatgtaaccattagactaaatctacatctacatccacatttaaggatttctgtttaaagaccttttttttttttttttaatctcttccaaaccctggtgggttttttttgttttgttttgtttttgtttttttgagatgaagtctttctctgtggcctaggctagagtgcagtggcgcaatctcagctcactgcaacctccgcctcctgggttcaaacgattctcctgcttctgcctcctgagtagctggggctgcagatgcgtgccaccatgcccggctaatttttgtatttttagtagagacagggtttcactatgttggycaggctggtctcgaactcctgatctcatgatccgactgcctcagcctcccaaagtgctgggattacaggcatgagccaccgcgcccagccaaccctggtggtttttaagagcatttgaaatctggcataatatctactttaacaagtactgcaagatgacttactggataagtcatatgaatatttccaagtttgcccagcatcaagataacatctgtacttccagttttgcaattcaatttgctttggaaataaaaacatgttgctaagctcagatgattgcaatgcccgtagcatcctagccataaacaggcttgtgtaccttgggtacttgctgtgttgttctgactgtcaccttagtaggtctttccctttgcttccagtgtctgctttttataaaatggttcctgacttattatacctttcagtcttccctgactccccattacccccattttataaaaactgtcttctgagagatggtggtgacacagaaagaaataccctgttgattgctgcctgatacatctggatatatagattgctgcctgacacatggatacagagaaacagagagtcatagggtaccacttaatcttactgtatgctaaggaaaaatattataaaagtaatctgaaacataacgtcattagtgtttaaataccatgttttattcctcactttctgaaaaatgattttatttttctaaatttgtttcataatgcatttatgagttgtgacctgcaattttaaaagtactgcttctgaaagggagaagcctaaacatgtgtaatagagttagcagacactggccgagtacttagcacgtactaggcaaggttcatgtaatcttggcaacaactctgagacccccattttgtggaggtggaatcaggcacagggaagttaagaagttgccccaggactctcagctgggatgtgacagaacaaggctgtggccagggagtcaggcacaccttaacaaatggcctgtcctgcctcctgagacagggcagagcctggcacctatgtgaaccccatggtttgcctgttcccagatgctgctgttataccttgtaaatggactgtgagtgcatgtggaggacaccactgttagcgggttagttcttgcacctggatgaggcctctccttttacatgcagatcctggatttccacagacttttccaggtacagtatcacatcagccggctttgctactttattagcgctcaagctggaaggtagaaactgctacttagaactcgtcttgtggattgtttggtaaatcaccatttgttcaggtatttgaggacaggcttttaaacaacaacaaaaccccctgaactccataaactcaacctgtcaactactaaggaataaattacacatgcaaaaagtcagtggataaagccaggcatggtggctctagcctgtaatcccagcactgacggatcgcttgaggccaggagttggagaccagcctgaggaatatgatgaaactccgtctctacaaaaaatacaaaaattagccaaagatggtggcatgcgctggtggtccctgcttctcaggaggctgaggtgggaggatcacctgagcccggggaggttaaggctgcagtgaaccaagatcacaccactgtactccagcctgggcaacagcctgcctcaaataaaaagaaaaaaaaaagtcagtagataaaagaattctaaattgccaaaggaaggaaagaaaactgcttaacacattccctttggaacagtggttagggaaatgcggggtggaagcagtggttacaatgtgtgctttgaagtgcgatgaacctgaattcacatgtggccctgtcattcagtgggtatatgtgattaggcaatttccttcacccctctgagcctcactttctccatacatatgtgtgtgtgtgtgtgtgtgtgtgkatgtgtgtgtatatttcagacagtctgactcctgttgcccaggctagctagagtgcagtggggctatcacggctcattgcatcgttgaccacccaggctcaagtgatcctcccacctaatttttttttttctttttttttttttttttttttttgkggagacaaggtttcactgtgttggccaggctggtctcgaattcctgggcttaagtgatccgtcagcctcagccttccaaagtgttaggattacaggtgtgagccactgcgcccggctactttctctgtatgttgaaggaaatcatcctggtgcctttgcagggctgtcaggaggactgattggtgagacaccaagcatagtacttaggacatagcatgtcagtgttgttattggagccacaagctgccactaactgttggttattctctatgatggagacagaggaaaggggtgaagaaaacaaggtattcacatctatttggtgcaataatttggagaagagtatagggttactttagggtcaggggtgttggtgtatgtttgaacttgaacatgggcaaatattctctaaactgttcctcctgtttctagagccttcctcattctctatgttttggtggatttttacatatgtgcagggaagttagactgtaacaacttgaaggcaaggaactgtcttaattttcatcatttaaaagttcatagcgggacacaattcttcaacatttaagcatttgcttgaatgaatgaaaaaggatcaatgttcagcaaatgtttaaaagtcattgatgtttctgtatctgaaytaattggtgatattcctttatcatagacatggygagggcaaaagtcaatctgtgtttttgttactgtagtcatatcacattcttgcatccttacagctttatgtcagtgctgttggaaaatacacctttcttcattgacttaacttgctccaaacaggaactgaaaggtggtaatggtagccaattgactttgaagtttaggttgacagaattcttttgcaaatgtgatcttccctgagtcccacccactgtcttttcctttgctcctaacgtgcccctgctacactagttctgcctgctgttctcatctctgtgggtacatgtttgctttkgctgtcttctgtttgtccttttcctctcagcctaaaacaacctggcagcccctggtctccctcgcctagcccacagctctctgtcaagaagtctctttctagatggagggaagaatcaaatctgaattttattttccatgtggcacatgctttggccacatggtttactttgtagtgcatgctcttgctcttgtttcctgcactgggctagttcaagccttcacctgtcttttcaaggcacctcttctgttctctgccctcccagtctcctcctctgcaagctagaccagccaccctccaggcacttcattcacgacacccctttcttggctgagttttcaacctctctggcccattcatttcagcatatacacaagttgaagtctctctcttctgtttaaaccaccaccatcccccactaccacacaaataccttcccctcctccgccctgtattcccccaccgcacatgccgctccgtctttctccttccctttctgggtttttcctcttytgcctgctcttcagtgatgacatttctctgtcttcgggccctggctctctgttttttttgttgtttgttttgttttgtttttttttccttcactcctgcgtgctgtttttggatgataagacccttcctgtggctttaattgctgtccatatgcggacaacgtgtgactctgtatttttagccctgatctgttttctgagtgccagatgtattcagacaactttgaaatggacagtgccacttagtaccccagagaaacctcatattcaactggtctgaaaatgagtttctcatcttccttaggaaacctgctcctcttcctcacttccctcagtgggcggcaggcgctgctgtgcacagttgtcccagcccaagattacgtggcatgcttatctcttgcctcctccttgctgtcacamccaggagtcacaaagtcttgttgatgctcctacagctctggaatatgagtccccactggtccctgccactgccttaatccagctccttgtaacttctcacctgtrtaatagcaatggtcactgtagtccagtttctttcaaattacggcaaccactctttctgctactgcaccctccaccactgctgctattgtttctactactgctgggactaacccagctctcaggtgacagccaggagatttatgcatcttacctcataccatcaatcctcccaacaactttatgaaggagatggtgttatcttcatttcttcattttttggagaaagcagctgagatctgagaagttgtcccttgtccttgtccaagttcacactgattccaaagtcacttagctatgatgctcccattgctcccagtagctccatttaagaagtgctgattgcggccgggcgcggtggctcacgcctgtaatcccagcactttgggaggctgaggcgggcggatcacgaggtcaggagatcgagaccatcccggctaaaaaggtgaaaccccgtctctactaaaaatacaaaaaattagccgggcgtagtggcgggcgcctgtagtcccagctacttgggaggctgaggcaggagaagggcgtgaacccgggaggcggagcttgcagtgagccgagatcccgccaatgcactccagcctgggcgacagagcgagactccgtctcaaaaaaaaaaaaaaaaaaaaaaaaaaaagaagtgctgattgcaaaccttgtccttcatgggtgctaatttaatcctcgcagtaactctgcaaggtaggtgaagaaactgaagtacagggagtttgagctgcaggcctccgtcagaggccacatggcgggcaggtggcagggtctctggttcctgggttgggcctcccgctctgtccctgctccagctccccacggtgcttcagagccacctccatgggctgcagctagtgtgttttctaaaatccaggtgggatcttgttccgcacagccttcaggataaagcaggagccccttagcacgtgaccagggctcaggggtttccctgccccagtctctggacttgtctctaggcacccccagccctgctgtttcagctatcagctgagtccctaaggcagctcagcaggagcccctctgccataatcacctccaccccctcccctgcccccactccctagctgtctagcttgcacctsttcttagcctggtacttggcagtgccttcccaggagcttctctgatccatctcctgctgtcaggctggctctgtggcctttccagggyccctctttctgtaatcctgtctcccaccctcactgcagcctcctgaaggcagaatcttgtacctttgcagccctggtgactctcacacacctggctgcacttgggtgtctctgctatggactgaatgtttgtgtctccccagattcataggttgaaacgctagtccccagagtgatggtatttggagggaggacttcgtggaggtcattagtgttaggtgaggtcgtgagggtggaggtcctgtgatgtgattaatgcccttaaaaggggaggaaggggccagagctcgctctcactgccatgcaagggcacagcgtgaaagcacagcaagaagatgraagacggccacctgtagaccaggaggaggatgctggcaccctgatctcagacctccagcctctagaactgtgagacagaaatgcttgttgttgagccactcagtctgtgctatttatttgactgtcagtgagtgacagtggctgcatcttctggttacatgatgtgcatttcagaaatgtgttcccaaaattaagcatatgaatataatttggctctgcctgtattgaaaacctgctctttcactgtcaacttgaagttatggttctttttcctggttataaattataactatggagtcctttgaacctctgaactaaaaggaagttgtggcgtaaggcacagatgtatggggtaatgaaagtcttcaaagaaagggatcacgagttactgccattctctgtaattttaagtcttcagcatgtccaagaattttgtttgcacaggaattgcttatttctatgtgagtagaaatgcttgtgcaaggaagtagcaagtgcttttccatctgtggataagacttggagcaacaggctcacacaagtcttcacagaacaagaatgaaagcctggattcctgcctctgcttaaaaggttggggccaatacattctcactaggtttttcttagtcagcactggcattttggaaatctgttccactgagtaaaagcttagaaaaaagaagaccagaacgtgggtgggtctctaaatcatcactttatggttgaggaataaagtgattaagaaacagcttcttcattttgaaagaatccacggggaaatctgtggaaggagctgtggagggctggaatattcattcactcactcattcatttatttgttcaacagataacatagggcaggaaaggggttataaaaagcttcacccttttaaactgtgtaagggaaaaagtagaaaaagtaaaggaacgaacacttcacattatggcagaagaatggaggagaccatatgattgaaagctctttggggcagggactctgtcctgttcacagttgtgttagtatattccacacagttatttcgtacatagtggctgcatatttctttactcaaagtctgtgttcaggaaaggatatgataaattcactgacattakattgcaaatgactaaaaacaacttacttatctttcattttaataggaagtcagatcttaagtaagagaaagtaatctcttaagggctgggcttcaggaatgaataagccagggcaggatgtatgctttgtggctgtgggaaccttgctggcacctatgagattaattcctgtcggctgttcccagtgtgaggtagtgggaatggcccttgcctgtgagctccgtcctagtcgggccacygctgaccagctagatgagcttggcaagtcattttcaccaacagagtttgttttcaggttttctttcttgatttgaaaaaaaatgagggagatctgggactttctagctctaacctttagatgttctatgctaaagccagggctgcactggtgaaagtgagatgtatcaaagaaagggtgatattgaaagcaggagaaatagaagtgtcttccccttcaaggcaaacctgagacaaggattagactagttcaccaaagggccatcgaatttgcagagctaatttcctgtagctgaagtgggagcgtatccatcctgcactgggcatgatgtcttgtgtgagtggcttgggtagggactagaacgtaaggattagattaataacttttttttttaaatcatcttttcctcctctgaaacctctccttaactattggctttcaagttaagtttggaatctgacagcacagacactyacagccaccatagctgctttttctttgcatttaattgggttaacttttaagaaatggcatgtttgacttamgatttttaggcatataacctataatattggctttggggggtgcttttctgttcttattatttgtcctttatcttggcacctcataattaactaatggtggtatttattttaacttgagggaggttcattttgagatatgaaatgagcatctgagagggaaaatcacagcagctttcagaagtgaaatttaacaaggtgaaatgtacaaattagcttgaataagagcatgactgaatctatactaagcaaattactttctgttggggagtttattcctggaatgtctctttatagttagttttaggactaataggatgggataacaagaaaaacttaagattttttatggacagttctggcaggaagtgaaaagcagaacttattctttgtaatatttatttatttggtataatgatagaatcataaagcaccatcagataatcccatttgacccacataaatactcagtgatataagtagctactccattttaaaatgagaaaacggggaggctccaagagtcttagtaacatgctcaagtttaaactgccagtaacaagaggaagacttgcttcctggaaactgtgaacatcagttgcaccatttccccccagataccttccatgtattctagcatgtttggccaatacactgagcaaatcttttttgtttgatttacttgatacattttcaaatatgcttcatcttagttgaacagtttacaggattctgttatttctcaagtgaaccatttacaggagtcagccatttcttaagaaaaatgcaaatcctggctgggcacggtggctcacacctgtaatcccagcactttgggaggctgaggcgggtggatcacttgaggtcaggagtttgagaccagcctgaacaacatggtaagaccccgtctctatttaaaatacaaaaattagccaggtgtgatggtgggcacctgtaatcccagctactcaggaggctgaggcaagagaatcgcttgaacctgggaggcagagaccgtagtgagccaagatcgcaccattgcactccagcctgggtgacagagtgagactctgtctcaaaaaaaaaaaaaaaaaaaaaaaaaaaagaaagaaagaaaaagaaaaattcaaatccattatctctgaagtagacaccccagtgagtgagctacttctttctttctttgccaggtttgcatgagccgttggtcatggagtccttgcactcttggtctatctatttagatggaattgactccatgctcaatctcttttgaggttaaaagttagaaactcactttaaataaggcaagggatacagagtatatattttatcttacatatttgaaagcagcagatattatcattgacatggtagaagtaatgctttttctaaatacaatgtaaaaaactattaattacttggtttgcttatgctaaatgatgttttcactcaagtccttagctactgccgccaatcatctgttaatatttttctcttatatttgtatgtcaatagcgcacacattggtaaagccatttcattcatttctgctaatgttaatggaattaaatctgtttcaagccaggtaggtgaggtgttgagttttcagattgkcagagatagcttttctgtttggttcttatgagctaatactctacataacaattcaaattagtcaactggtttttctcatgtttgtgttggggtgtggcagctctctgacaagtcaaaagaaaatgagtaattgatttggtgctaaaacatgattatgcttgctataatgaaagcaccctagaaatattaaaactaaaaaacaacacrtactatctctgttagacaagtrccttttgttatgttaagatattccatttcttcttcatgcgagatggttcagcatttactaatcttataccagaagcagtttacatggagagatatttagataatgaaaacttgtctgtacttaggtaaatggaaaggttgtcacctgaactagccagagactccaaagcatttagctgccagtcatgccttaaaccttgggaacatcccatgttagacttagattaagaacccttttggggtttcaaagaggtgacgggctgcattcaatggtgaatgatcccaaggttgagttaactcatcactctgaagaagaacaaaatgaggaatttacttagttaactactgacaccttactataaactctgaaggaaggcaaagaatgagatacagataatgtataaaatatttagtaaaatgaaattctcatgtcagctgttaaaaccacaactccgaggatgtgagagagtgtggtctatacaggaggggtggagtgggtgtggacctcagccttctgctctaggaatccatgcttgtgaatgtcttcctaactctagccccactttacaaaatcaaaacaaacagaaaagtttctaagtatggcttcttactggtggtgggaaacagtttgtctcattatctcatttcagagatgcctactggttatactcacaggttcttttcacatcctttatgccctgattgagaggatgtcttagtccattttgtgttgctgtagcagaatacctgagactgggtgatttatcaagaaagagscttatttggctcatgattctggaggctggggagtcccagaagcatggcactgcatccgttggcttctgggcttctagggagaatctcatgccatgtcataacatgatggaaggtcaaaggggaagtggacacaggtgaagggtcaaaacagaccctgccctggagggaactaacctgtcacctccagaatgaatccagtctcacaagagcaagaactcactcactgtagtgagaactgcaccaagacacctaggcccagagggcggagtctctgtgacccaagctcttcccattaagttccacctcttaaagtttccacctcccaacattgctgcactgggaattaaggttccaacgtgcgtttcgatggggacactcaaaccatagcagagacattgccttctaagatagaccctcccaccttcctgggctgggggagctggcttggtctatctagaaggatgmgcaggctgcccactacctacctttattaagagtgatttcagtcatcatacttggctaactttaatttccacttttaaattatctaatcctttcacagaaattttggggattaataaatatgaaaaaccatctccccaaaagctcagaatatttatgaaagtattattagcaacatctactatgcttttgctataactaattctgccttgttaatctagtattcaaattaaaggttgttctttgacccaatggggggcagaggcttatgagatttttttttattatggaataattttggtggagtttctaccttgattgcaaatttggtgacacagcaggttttatgactatagaataatctaatcaacactccagaatctaatcaacactccagaatggaaaatcttgttgggttgcttcaagagaattacctttctgcaatgggagctctatcacatttgagttaagtgataatagataacatgtattctaggtaaaactcttttttcatagggtatcttttatatgtacctagaaaagagatttggatgatacatgataactatcagtagtgctttttagtatcattatgggtaayttattttgtttatctgttttgtgcaatgcacatgtatttctcctataagagaataacttcaaagttgttttttagaaggggtgggcatgagtatcccactgttttattgtcatgggtaagaaaggggcacaagccctctcctgccacagggctttacaatgtttggaatagctcaattggtgttttttccatcttctttttgaggaagatgggctttaaatttttaaaaaattataaataaggaaaaaaaagccagtagatttgttcatattagcttctttatattttcagaggaagcagccataacactttggatagaacacatggcactttggatagaacacgtaacactttggaagactcctttggtgtcttcatttttgggggggcaggaaagacagtctctgaggatgaggatggtaccactacccacaggacggaaggaaaggtaaaaggaagattgaatcactcttcaacttccttctggagcccagccctttccacctgctcaggggctgacttctccggtatcatcagccattcctttgtttcaagagtcatggaccgtatactgaagatctgtgcagtttaggatatgtaaattatatctcagtaaagtattagaacacaaatacacacaaaagcctttctgtctttctcttcctctcttcagccagatttgacagagagattgtctatatcctttgatcgcattttgtcaacttctgtgcccctcttagccactgctgtgtggcttgtccttcttttccacccagaaggctcatgacctccatgttgctaaattccaagtgcccattccagtttttatcttgtgtgctctcggctttctaagccactctatcaattacccaaccatcagccttcccagcatccgtccatccttctgtcagccaatgcgctgtccttctgtccctccttccaatatccacccaccagtcccttcgtctgtctctgccaggcattctttttttttttttttaaacaaataagctttatgttttagatggttttagatttacagaaaaattgcgaagacagaacactattgccatatactctgcaacaggttttacctgttagcaacatatgttagaattatacatttgtcacaatgaatgaaccaatattgatacattattattctctaaagtccatactttgttcggattctttagtttttgcctagagtcctttttctgttccaggatcccatctgggacaccacattgcatttacctggtatgtctccttagactcccttggctaggccagtttctcagccttcctttgtttttgatgaccttgacagtattgtggagtactttttaggtattttgtagaatgtccctcacatggcatttgtcggatgtttttctcatgattagactgcgtttatgggtttgagggaggaagacccaaaaggtgaagaaacacttttatcacattctgtgaaggtacatcctgtcaacgtggcttattactgttgatattcaccttgagcacctggctgagatactgtctgtcaggcttctccactgtacagctactccctccctttccacactatattctttggaagaaaatcactatgtgtagctcattcttttttttttttttttttttttttgagacggagtcttgctctgtcgcccaggctggagtgcagtggcgcgatctcggctcactgcaagctccacctcctgggttcacgccrttctcctgcttcagcctcccgagtagctgggactgcaggtgcccaccaccacacccagctaattttttttttttttgtatttttagtagagatggggtttcaccgtgttagcgaggatggtctcgatctcctgacctcatgatccacccgcctcggcctcccaaagtgctgggattacagacgtgagccaccgcgcccagtagctcattcttaagtaatgggaagttatgttctgcctcattgtgtagctacataatttatatggaattcttttgcgtgggagatttgtctcttcttcctcattggtttatttagtctgctttatttatgtcagtatggttcacgtatatttattgtttgtcttggattataattcaattattactttatttcatggcccatattattccagctttggctattgcgagctgtttcgattggttcctgtgttctttgacatacccccatgatcgtgtgtgtgtatgtatttaatactactttactttctagcactacaaaatactctaggcttatcttgtatgtttcctgccccagattcagagtcagccatttctccaaggaacgctgattccttttattagagaatggtattagaaaccaagatatggccaggtgcggtggctcatgcctgtaatcccagcactttgggatgccaaggagggcagatcgcctgaggtcaggagttcgagatcagcctggccaacatggtgaaaccccatctctactaaaaatacaaaaattagccagacgtggtggcatgckcctgtaatcccagctactcgggaggctgagacaggagaatcgcttgaacccaggaggcrgaggttgcagtgagccgagatcatgccattgcactccagcctgggtgacagagcaagactgtttaaaaaaaaaaagacgaagaaaaaagaaaagaaaagaaaccaagataagggatgccaagtgtacttgttgctactgaaatgtaattgtttctaagatctctcacatgacagcaagaaaatmtatgtgtgtattcttattggcgtatacatatctacaaatatttccatttgtaaccatcagcatctatatcaagctaaacatcagctcatttgatgtcttcgattctaatccattactacatgggttgcactagccccctttctttgcctgtctttaaactcctactccaacagagacaaacctgtggttcccaccatccgtatccattcccttaattgttcagttgtagtatatatgtacagcaatatcagaattgttaactcaayccctatgggaaacaactttatcaactagaagatggcgcttatatgcactccttttacatttgattttaacagactctacttatttctagttacttaggtcagtacccttttcccctatccccttcagtgaggttgttgcatacatttgtaatatagatagattgttttgtyacattctgcattccatcctgggatcccccaatctcctaaatgactttttaaatttgcttacattgtacattaagattcattctttgtgtagtcagtcctatggactttaacaaatgcagagtgtcacgtatccacccttgcagtatcatacagaacagttgcaccccctataaatatctcctgtgctttatccatttacccccctccgtttattttcttttcttttttcttttttttttttgagacggagtcttggtttgtcacccaggctgggtgcagtggtgtgatctgagctcactgcaacctctgcctcctgggttcaagtgattcttctgcctcagcctcccgagcagctgggactacaggcgtgcgcctcaacatccagctaatttttgtatttttagtagagacggggtttcgccatgttggccagcctgatctcgaactcctgacctcaggtgatctgcccacctgggcctcccaaagtgctgggattataggcgtgagccaccgtgccaggccaacctctgccatttcttcctgaaccactgatctctttcctrttgctatcgttttgccttttccagtatgtcatataattgaaatcatacagtatacagcattttcagactaacttctttcactacacaatatacatttaagattcatccgtggtttttttgtgacttgatagctccattctttttatggctgaataagatgccattgtayaaatgtaccacagtttatccacttggctcttgaaggacatcttggttgcttcagtttttgatgattatgagaaagcctggtataaacacgtgtgggtggacttttgtttggatataaatttgaaattagtgaggtcaaaatgccacatgcacttttaggtgctagggacacaggtgcttaggatacaacagcgaaagagtccctgtgctcytaaaaacaaatgcaaatgaataaatcagaatggcttcagctcacgagtagtgctaggaaaaaaataaagctaataggataatgagtgagagactgtggccaggttagtggggctaggaagggcttctttgaggaagttcattgcatttgtatctgagcctgcatgatgagagatggcaccagcggtgtgcaaagccctggggggacatactgggctcagttaatgcaaacaccctctggcaggatgaatcttggcatggccaagggactaggaacagaaagtactgtgaggtaaagacatgaatgagagtattttcttaaaaactttttattgtaggccaggcgcggtggctcatacctgtaatcccagcactttgggaggccgaggcaggcggatcacgaggtcaggagatcgagaccatcctggctaacatggtgaaaccccgtttctactaaaagtacaaaaaattagctgggcatggtggtgggcgcctgtagtcccagctactcgggaggctgaggcaggagaatggcgtgaacctgggaggcggagattgcagtgagcggagatcgcaccactgcactccagcctgggcgacagagcaagactccgtctcaaaaacaacaacaacaacaaaaaactttttattgtagtataacatacaaagtacacaaaacccaagtgtaagtgcacagttgatgaattttgtcaaattgaacccacccaccttccagatcaggaaatggaatagtgccagcactgcaggggtccctcgtgtgtgcttatcccattatcagcccccttccctccctccaaggtcatctgattaattttaccttcttaaaagcttttatgtctgtttttttgttgttgttgttgttcaacattagatgtgtgagatacacccacattgttgcatgtcatttgaggtttgatcatttcagttgccacatagtactccatgtgtgaatacaccacagttgtttttttatcgattctacttttgatggacatttgggaggccttcagttttgagctattctgaattgagctcccgagaatattattgcgtatgtcttttggtgaacctatgtctgcatttctgttggcttatatacagagtggcaaaattgctggcttatagagtacgtgtatattcagcattgctaggtactgtcagatgatttcttaagtaattgcaccaatctacatgcccactgcactatatgaaagttctgattgtttcccatccttacctacgcttgttattttctgactttttcatttagccgtctgttatgtaatatagtggtgttgcattatggttcgaatttacatttacctgatggctagtcaagtccagccccttttcatatgtttactggcctttggatatcctctttgtgaagtgcttgttcaattcttttgcccatttcaaagagaaaaaacaacaactttgggtttgggttgtcttttatatatcctggacattgatctcttacagtctagatatgagtcctttgtcagaaatatgtgtcccacttggtgaactgcctttttcactctctgaatggtgacttttgaggcacagaagttcttaatcttaatattttccaatttgtcagctttttcctttatatttggtacattttcaacctatttaagaaaactttgtctgctacaaggtcatgaaaatgtttttctgtgttacctttttgatgcttcattattttaccttttatatatagatctgtaatccatctgaaattcatttttatgtgtggtataatgtagagattacgattcatgatccttttgtagttcatagcatgatgattgggtgttcacatgcatgtgtgaaatgtgccagccttgaaccttgttacaacattggcacatgacccatctgacctgaatttggaacacccagttgacccagcaccattcatttaaagatcatcttccctcactacactgtagttacaaataaggggataccgtagattgaatgtttatatccccctaaaatttatatgttggaatcctaagccccagtattatactattgggagaggggcctttcggaggtgattatgtcctgagggtggagcactcatgaatgggattagtgcycttataaaagacacaagagagctctctttctctgcactccatcatgggaggacacattgagaagttagccatctgcaaaccaggaagctggctctcaccagacataggatctgtgtggtaccttgatgaacttcccagcttccagaatggtgagaaatatatttctgttgtttaaaccaccagtctgtggtagtctgttaaagcagcccaaactgactaagacaggagaccttgtatgtttgkctctatatagattctagtgagtatgttctaatattaggtagagcctttctgtcttgctcactatactccatcttcatttcctggcagtggcccctgtgctgtaaatattcaataaatatcagctggttggtggacaggtctgaacttgcctttaggcaagagttttaaaatatctgggctcccagtccaagaaaagatactcagattttgtgttagagaagacttgacttgcctagttaattacatttcttctctaggcccaaatatgtttctggaccagttctgctggctaaagtccttggggaaggctkgttgacctcaggttgtccagttggcagtaatgaatctatttaaccatccagccagtcatgcaataaatatcttttatgggcctactatgtggcaggcataaagtagaactaaaataataggattatttccagagtttctatttttaattttagaacatttgttgtttctttctttacaagttaaacactcagtgcaaggagggtaattttgagaattttcctctattttgagggtagctttattgttctgttatagttatttaaaatttttgtgtgtgacagcctagataaacaggcaacaggcctaagaattagagcttttatgttgctatcagactattttaaaacaaacaaaaccctacaaagaaaaagagatgaaaataaatgtgaagtgcagtatttcacacagtgaattcagcgagaagttaagtacttttctcattttcaaaatttagtgccagaccaaagaccaagtttagaaaaatagaggaatgcattttcaggaggttggtgtggactctggatgtgccagtcagtgccagtacaccagatcgcattgtgagtgggccacgtgccatataccatgtgtcacatgccacataccgctcttcttcttcttttttttttttttgagacggagtctgagtctccctctgttgtccaggctggggtgcagtggcgctatctcggctcactgcaagctccgcctcccggattcatgccattctcctgcctcagcctcctgagtagctgggattacaggcgcccgctaccacgcccggctaattttttgtatttttagtagagatggggtttcaccatgttagccaggatggtctcgatctcctgacctcatgatctacccgcctcggcctcccaaagtgctgggattacaggcctgagccaccgcgcccagccaaatgctgctcttcttggtaactgccctctggggaacaaaagagccctagaggcttctcccatggtaccatcttgcttggtgacaccaggggctggggttatgtcccagggtctctttgttcctcctttcctctggggatatgaacaaagaggggcaggggacaagcagatccccaaactggggccagctccaggcggtagctgttggaaaatggggctgcctccgccagcacttattgtccaccactgcccatgtctggtggctgcagtttgagctgctctgaagccttttgaggccactgggagaggcagcctcctagcaggcctgcctcaggaggaggaagcagattgctaagggaacagggtggctggtgcttgtgaatgttacttccgtgatgggactgtgattctcgttcttatttagttaatatcatgtccaatttcattttcagcttgtctcaggtgaatattttatatatttagtgaaacctcaccaaccttgaagtcaggaattttgtaactccagtcatttggaaccgagtgaaggaacctaaaggaaagcagaaagaggccaggcgcggtggctcacgtctgtaatcctagcactttgggaggccaaggcgggtgaatcccttgaggttagaagttcaaaaacagcctggccaacatggtgaaacctcatctctactaaaaatacaaacattaggccgggcgcggtggctcacgcctgtaatcccagcactttgggaggccgaggcgggcggatcacttgaggtcaggagtttgagaccagcctggccaacatggcaaaccccatctctactaaaaatacaaaaaaattagctgggcatggtggcacacacctgtaatcccagctactcaggaggctgaggcaggagaattgcttgaacccaggaggcagaggttgaggtgagccgagatcgcaccactgcactccagcctgggtgacagagcaagactccgtctcgggggggaaaaaaacaaaaagcagaaagagtagctttgagaccctaaagagatacgatattttggggtatgctggggtatgttcttgatttattacagaggtccttgggcttccatgtagagcttctgtgctcttactttagccacatttctaacaagtttggttttctgcttttttagttcactagatttagaagcaacaaactaggctgctaggtatacgttctgggagaacatctagaagtgacagctgacagcctgacagtaagggaggagacagagcatctataaaaagctcggaagaccagagctgtcttatatactgtataaggcagagagctctgagcctgttgcagcctggagcgtgtcccgagaggcagtgtggcaggacgcctggccacaggagtgacctgagccattcagaccccaaaggcaggcacacgaggaatcccttagagagatttgaagaaaaagagttgaatactagttatctgaaataatttacatatatagaacccttgttttccttgggatactaaacacataaaagaactccccctttctctccatgtctccgttctccccttctctcctcccctctttctccccttctctcctcccctctttctctcctcccttgctctcctccccctttctccccttctctcctcccgactctcctctcccccactcccctcccaccttgctctctccctttccgttttcacttccccttttacttccctcccccactccttctccctaacacaatacagcgtcccttttttttttttttttttttgtctttgaggttcacatatatgcagtgagttgctggtgaaagtttaacaactggctctcatgggagaaaaaaatcccttgattcggccgggcgcggtggctcacgcctgtaatcccagcactttgggaggccgaggcgggcagatcacgagctcaggagatcgagaccatcctggctaacatggtgaaaccccgtctctactaaaaatacagattacctgggcgtagtggcgggcgcctgtagtcccagctacttgggaggctgaggcaggagaatggcgtgaacccgggaggcggagcttgcagtgagccgagatagcgccactacactccagcctgggcgaaagagcgagactcccgtctcaacaaaacaaaacaaaacaaaacaaaacaaaaaaacccttgattcacagcagcccagtttccttagtgtaagtcctcgccatggttgatttcaggtgaccattgtgaagtccctggggaggagcagggacaagtacttcctccatacagatgcaggagatggaagtaaccttaagagcgtaagaataggcagataacaccaaataatcagaaagtcatgttttgagtatttacaactttattatataattactcttcttatacaattatataatttaatttaaaaatttagtaacatttaactcaatgtatcaaaaatattatcattttaacatatcgatagaaaattattattattatttgagacagattctcactctgtagcccaagctggagtgcagtggtgcgatcttggctcactgcaacatctgcctcccaggctcaagtcattgtcctgcctcagcctcccaagtagctgggactatcggcacgcgccaccacacccagctaattttttgtactttagtagaaatggggtttcaccatgttgcccagggtggtctcgaactcctgagctcaggcgatccacccatcgtggcctcccaaagtgctgggattacaggcgtgagccaccgtgcccagcctcaatataaaattatcaataagatattttacactccttaaaaatatctaaccttccattatagttagaggtgatcctatgacaaattttgaccagtgaaatgaattcactgcatggagtttttgaataataatttaatggtaactgattctgttgtcatgggaaacttgtctttttccttacttcctgaaatgtaagtagaagaggaaaaaaaattaaaaatagaaacaataaaataagaacttacatatgacgtctttgaactgttgaacaaatgccaatatccaactatgttggacttctctgtatatggcagaaaaaaaatcatatttagtctccaaactgctgttaaaaggttgtcgttgttgttagatgctgctaaacccaatggttgagtaaaagagaaggtgtcaaaagcagagacctgcataaggtgaaggcacaggacaagtgaattgtgaatgaagaaaattctaggctgatgaaatcgaacatgaaaaggccgaagcgggaagaagctgaaagtagaatgaaccaaggtttactaattaccaataccatgcaacaaactcccccacatcttagtggcttaagaaatgactatcatttattttgcttgcaaatctgatttgtgcatcatttgttgggggtgactcatctctgcctcatggggaattaattgatgtggcaaacttagggcctgagtatgtattttcaacatgacttactctgcaaactgttggggccatgggccattgtgtcagctcttcagcatacaggcttttccatgtgctatttcggtttccttgctgtatggggactgggctctggagtaaacatctcaatacgatcaggaagaagttgtattgcttttaatgactttgccttggaggtcacatagtattgcttctgttctaatcacagttctaacaaggcttcaaggaaaaggaacatagattttaccttctgatgggaggaaagtcaagtgagatcaccttgtgaggaagggaagtggaatgggaaatattgttgaagccagttttggaaaatacaatctgccacacaagaaagaataagaaaatatgggtgatgagaactgaattcaacacatactcattacacttttgtcatgtgctagttactttttttttttttttctttttttgagatggagtctcactctgtctcccaggctggagtgcagtggcgcgatcttggctcactgcaagctctgcctcccaggttcacgccattcttctgcctcaggctcctgagtagctggactacaggcgactgccaccatgcctggctaatttttttgtatttttagtagagatggggtttcaatgtgttagccaggatggtcttgatctcctgacctcgtgatccgcccgcctcggcctcccaaagtgctggaattacaggcgtgagccactgcgcccggctgctagttaccttttaagcacccgtgatatcgaagtagaccaaagagacaaaaatcacttcccttccttgtgggttttacattctagggaaatgagagagaagagtgatacgtgatgaggttagaagaaacagagccttgtaggttacagtacgactctttttttttttttttttaatggtaaggaatttgaattttgttcctaagtatgatagcttttatgcagggaagtgatatggtcttattattttttatgactataaaattaacttttatttaacatttttttacaaaatacattwaaaaaattttaaatctgttttttagagcagttttagattcacagtaaaattgagaggaaggtacctttcctatgtactctctgcccagtcccccaacacagcctccccaccaactcccccggcgtgaccctccattggagcggtacattggtcacaatcgatgaacctacgttgacacaccattatcacccaaagtgcatagtttacatgagggtccactcaaggtgctgtacattccatgggtttggacaaatgtttaatgacatgtacccaccatggtagtttacagaggagttccactgacctgaacattctctcgttattgtgtttgacagctggcttataaaattcctgaaaatttaacagtggtctctagtgagctggtacaagccagctccattcagcacaccattgtacatacctaatatcttatagttgagggattctctgtaattttgtttgagcataacaacaatctaactcttttataaggagaatcccagaagctcacatttaaaagagacccgagagatcttctgtcctgacctttctgcctgacacactgattccatctatagcatggtaaaaggatctttcagggccactgctgctcagatttctcacgtctccacacagaatctgtgattgacgcacacatttgaaagttaagkgattttcttcaggctgcaaactgggactggaatttcgtctctttctcttgttcttctctaattttattctcatgcaaacagcctgatttctgatttcataatttagcacaagacatattttatttaagtagggatgaatttaaagatcacagaaccatgtcattaagtgaaatcaacaaatgtttatcagcattcagaatttctccatttctttttttcttttttcttttttttgagacggagtcttgctctcacccaggctggagtgcagtggtgcggtcttggctcaccgcaacctctgcctcccgggttcaaatgattctcctgcctcagcctcctgagtagctgggattacaggttcccgccaccatgccctgctctttttttttgtatttttagtagagacggggtttgccacattggccaggctgttctcaaactcctgacctcaagtgatccgcccgccttggcctcccaaagtgctgggattacaggtgtgagccastgcacccggcccagagtctcyccctttctttgctgaagaatttatgytatgtattcatcacctatctataaagtggttatagctgggaaccctttgcagatgggtaattcatcattagacgggttatagataatctctctattcattatatggcattgacattcagaactaatggttaaagtcactctagatgggaaatattagattccttccctaggccagggagactagacagctttttagaagatctctgtaacccccagcattggtgcttttatgacaaggtgaagctcttttgtaaagctgtgtttttgtgtgtgtgtgttaatgcaccagaccattcctggcctactgtgcaaggccctgtggtgcaggtggggaggmgggtagagatagagagcgaggtacagctgagtgcagatccccagctctgagcatcactgggtgtgtgacttactcaattcatcatttagctattgagagctgatgttaggcatattctttcttttcttatgaagccttggtttattgtgggcctcagaatagaagcttcttggcctgaaaatgaagttctttggaagtgccatctgacacttctcctggtgggcagagttgctgaaacyggaagcagggggtttgaggggtgctgtaactgaygtggggagaccgactggggacaaagaatgaggatagtaacaggagatgactcctcctccccaggaggccagatgcatccagaggcctcacrtggctggatgtaggttacaaggtcgctctcacagtcaaggtgtgagcaaggccttggtcttcccatcagccatgctgccttataagccrctcagtcaactccccatccacctccaaactgctgcttgcctggcctccctcttcattgatgatgtgatgagccacccaaatagacctggagttttttttgtgttttgaaataattttaatttacagatttgcaaagaaagcacagagttttccccatgtacccttcacccagcttcctccaatgttgacattttcctgtgcatttctcgacactaagaaatcagcaatggtacaaggtagctaatgacaatctttattgagatctccccattttttccacgaatgccctgtctcttctagcatgtcttctaggaaaccacattgcatgagtggagttggttttcagctcctctcattttctcccacacttggcaccacctaatctggtctcttatccttacccttttttttttccatccctatggtgagtgcccgggcccagccttttccactcatgtggagcctttggcaccctctcctggactcccttccccagattctcccaccttgctgtatacatgctgctcggagaggccactgtaaaaatgactcttctcagggggctcagatctctccctgaatgaagtctgagctcactacagccctcctttgtaactttccaacttggtcttgcactactttccaatttcagccttcttctgcagacaggtgggtctcttggcagacagatgagtctctttaactctgtttaatacctgaggatgcctggttctcactgtgtkttcctwacrtgctttatcttgttcagtcttcagaataatgccgatgccagccagcgctagraatggaggcccgcagaggcttatggaactggcccatggtcactcagccaggacatgggagcccaagactgcagacctgaggctcctaagcaycccaatctctcatctcaacttcaggatagcctcgtgagttctgctcacgccattcccaggatcccccatcctcaaagcttcctctgtcttagtcctgcccatccttcaaagcccaacttgaaccccgtctccatgaggtcttttgttttaggctgaaatcaatttgcttatttggcacctctccctcccccccacccccgagatttgttaaggtattattgaaaaataataattatatatacttgcagtgtacagacatgatgctttgataggtgcataygttgtgaaatgattaaatcaagctaattagcatattcatcacctcacatacttaccattttctaaattgtgagaacacttactaacttacccatacttcttggtatttataaatcaattacaaagaaatgctatgagtctccctctgtcgcccaggctggagtgcagtggtgcgatctcggctcactgcaagctctgcctcctgggttcacaccattctcctgcctcagcctcctgagtagctgggactaccggtgcctgccaccactcccaggtaatctgtatttttagtagagatggggtttcaccatgttgttagccaggatggtctcgatctcctgaccttgtgatccgcccaccttggcctcccaaagtgctgggattacaggcgtgagccaccacgcctggccgtgtgtgcatttttatcttctcaattcgactgtaagctcctagagggtaggaacattggcttataatatattctgtcctctggaaggcctggcagatattcagtgttcaacggtgtgttttaaataaatataatttcctggaatatcatttaataataagtagtgaaagctgggcgcagtggctcacgcctgtaatcccagcactttgggaggtggaggtggacggatcacaaggtcaggagttcgagaccagcctggccaatacggtgaaacgccatctctactaaaaatacacaaaaaattagctggtcatggtgtcgcacgcctgtaatcccagctactcaggaagctgagacaggagaattgcttgaacccgggaggcggaggttgcggtgagctgagatcatgccactgcactgcagcctgggcgaccgagggagattctgtctcaaaaaaaaaaaaaaaagtagtgaagaggatgtttcttttttgctctcatatttgaaacatatgatcaattggcttgaacattgtttatgataccactatgacatttaatccgtgttgaccaaataataaaaccagaaacaacaataacagtagtagctcacatagtgcttattatgtgctgggctgttctaaggcttgcccatgttaactcctttcaccctcttaataaacctgtgaggtggatgctatttctggtcccattgtagcgatggaaccaggcaggaagaagtccagtaacttgctgagagccgtggagaaggtggtggagttggaaggggcccccactctgagctgggtctcttggatctgcttcagtgggatctcttagcagaggtcacacatggacccagtgcttccctctttttctgtgtaaaatcacagtggtcatttactaaggatgcagagctctgatatgttgaatatgtttttgggaaagtgaatctgttaatattgtgagtccttataaatatttaactctctgctctttatgactagttagtaatttcctttgtaaaatattacttcaacaataaaagtgaactcttgagcatggggctggtgagggcatttccaaatgcaaggaagttaytttgacatctccctggtggtgcccaggtacagacggtgggtaattaccagaactgttgctttgtatgmtttccctartcaaaggcttaatcatttgacagtatctaacccagtgttattggrtaacataacccatggctcttgactgtgctaggtatgaggctggtgttttctcagcagaaccagttaaaataaaacctagatgtcatatcccartctggcctgtttgggaaaatgcagtttgaaccacaagcgcaatctacccgtggtgttttataacactgtttgcttggccagtcttcttcagcaggccctgaatatcttgtacttctctccctggtaacaggatctctaaaccggccacacctgtcataagtgactctactaaaggrgaattcagaattccactggggatacttagaacagtgagstgatgtgatcttgtgttattttccctttcttgggggttatcccttgattaattacctgtctgttggagagagagtgttcttataattggggtgaacaggagggcyctagtgggcaccccggggtgagggagtgtggggcattgcagtagaacctaggcagcgcttggagccagccctactggctatctgggcaggccagccytggaaggattcccatcttctcaacgggagtgcccgtggcttccatgagttaccaagctgggaattgcttctaacaatcgagttggaggcggggtgcccgtggtacaatctgtgtctggcttccttggcaactacctcttgtcttgtttcctgcttccagtcaatgcctttaggattaggctgaactttccccttcattgtatgtctcagcgtcaaagagaggacagagaaggaacatcttgttgctgtcttacttgaaataccagataagttcagggttcaataaaggtgagaccttccttagcttatttgaaggaactgctgttagtctaattcatgatctgtgtctttctactgctattttggtggatttgtggattggcgtccctggtccagaagagttttattatcatcctcaaatagtccacattcaaacaaatcccttttggatcacagaagtgagatttttttcctttaagctgttataatgagtgaggcccaggtaagggcagtgtcctgccgtggctgcaggtgtctgggtttgcagagggcctgaaggagtggcttcaaacaggacaatcctgttcatcgtgtgggagaccctgtgggcaaggagatgggttttatacggatgaggccactcaaggaagagggaggagagatcacgaggaagggctagttatttagggccggtcccaccctccagtgatccggcctccccctgtgtgtctctccctaccttctggctgcctgtgtcctaactccacgtcctgtttgctgccttccccataccagaaatcctaatatccacggctcagcctggccctggttcctgagagatgtcttgctgtgtagctctgtggtggatgttgtagacagtgaacggctctctgggcacaattcagccagtctctgttgtcagtggaagcagcacagatcttccctgcaccgtgtggccatttgaaaacaggggtgcacttgacaactccaaaaaaactaaggtagactgtctttacctgttgtttctgtgaaaggatctggggagaagagagggaaaaaatgaagtcatagtttcagagccatatatgggcctcacttaatggagtgagtgttggggccagatttatattgggaaggaaactatcttggtagataagaagtgaaaattcttgctggtgtgaccaaaaggctgggacctgtctgttgacagcagagaaggcaagcgaagggtcatgtgtagcacgttctcaggcctggccttggggcctgtggagcttccatgcagatccggtggtcacagatagccttactgttcctttcccccctcagtccctctctgtctctctctccccggtagggttcaacatacacatatctgtgggtgcaaatacatgagcagctctgagtcagtcttctttccctcattgttgtccccaaagtcccacagtcttttgtccttctcggagaccagttggattcagcaccctgtgaggcctggggttcaactcaggacagctgtcggggaggcagggagtgggacctgggccgctttctctgagccagtccggactgcagcagaaccccagtgactgtcccaacaagaggccgggacagactcatctcctgaggccccgtcgtcaggcaagaaagatgggcttccctgtggcatgtgtgttttccctcatcactgtgtggttagccccagcggggatataaatattgtccagatgctcactggttaatgttttacctcgcacaagaatgtgctgttcccaggcagctgtgtgtcatagttacagtctcctagagggcttgtgcgtgtgtctcctggagccgcggctggccctcaccccccatgcagcctccgcgaggccttttgtgcagagccttgcccttgtgtgtgccctcctactccatctgtatcttgtcgtcagttgctggcgccacctcagcaggrtttactgtgacctttcttgggcccatctgggaacagtggtagtaggtctggacctaggggtccagtgggtctttcccacaacctagcctgtgtaagaggctggaggaaaccctgaatgcaggcagagaagtctgtcacagaggcccctggggacagtggacgctggctctgtgggccgaccaaggagcgagaccagctggagcatgtcaggggatggtgggtgtgattggagaggagggcrgtcacagcaggtgaggttgtgtccctctcctaatatgcagggccagcctttgaagttcatttcttcagttcaggtaaagtcaatacgattgatttctagacctatagacctatgtgaagtatctcaaccaaagagatgtttatctccaacctaagcatagctctattttatttctccttttgtttttkggaatcattaaagataaaactactcccagccattacaactgtcatgatgacataaaatactgcatcagaaatagtaaccagggtctttatactgttgtttatttcattacttggaatgaaartgacaatctaaggtgaagagatggacttggtttgtctgaaatasggaaacatctaggtgtagattttcagatctcacaggggacaaatttcttcatctgcagaggaggaaataaacaggatctgtgtagctcttggatgaccagctcaatacatggatgctggaggtgaagggagctctctagggaaagtttgatggctgcatttttttgctttctatactctccctgtcactacgaatatggaagtgtttttcgaagcctgttctacttcctaaaacaccttataatgcttttccttttaggaggaagggaggcctggaaccaacctgggaaggcactggggagacccagggaggaaggagactgtggtcgccaagcatggtggctcatacctgtagtcccagcactttgggaggccaagctaggggcgctgcttgagcccaggagttcagtaccagctgggacaacatagcaagaccctatctctatacaaaataaaaatttrccaggtgtggtggtgctagctactcaggaggctgaggcaggaggtttgctggaatacaagggttcaaggctgcgatgagctataattgcaccactgcactccagcctgggcagcagagtgagacaccaacagaaagaaagagagaaagagagagagagagaaagaaaggagggagggagggagggagggtcggccatgaagactttatctatatagcgagggtaacagacagcccaggtgtrgagagtccagataagtgtctcgatttttccacgttggcctatgtttttaaatggaaacgaactctgcagacctgcccttcattagaatctgaatccccaaacatctttctcatgtttaatctctgccattggttcatgggctgttaaaaaaaaaaaggggataatatccatgaaggctctcttacacaggtgacataaataacttttttttccaaatacagctgtgacaaaactgagcaattatatccatgcatagaatgagtgagaaagacaggagtttgagtcccaactctgccacattactgactgtgtgatcttaggcaagttacttagactctgttttttggtttttctcatttgtaaggtgtgttttggggaaacagataacaaaagggatgttgtaagaattaactgagatgggccaggcacggtggctccggcctataattccagctgtttgggaggcygagggggatagatcacctgaggtcaggagtttgagaccagcctggccaacatgacaagaccctgtctctaccaaaaccacaaaaattagccgggagtggtggcatgtgcctgtaatcccagctactcaggaagctgaggcgtgagaatcacttgaacctgggatctgaaggttgcagtgagccgrgattgtgccactgcaccccagcctgggtgacagagtgagactccatttcaaaaaacaaacaaacaagaaagaattaactgagatgattcatgcagtcaagcattagcatagtgtctggtagatagggtgcactcagtggatgttagctattattatgtttgagacagtatagtatggattggtacaagtgttggcctcagctctagctgtgtgactgtgggcaaataaccccgagtctcagctacttcatctgtaagatggggatattagttgcatctgcatgaaagagtggctgtgagagctatacgtggcagggcttggggaaagtagtttaatgaaatctaagcactgtaagatttaatgcttccatgtttcatccagcattatataaggaactctgcacatgtgggtacatctcatgagctcctcagtttgcctcctgttgttttctctgatgtcagtgttgtcatagctgttcttggaagagttgttttaggcatgtgtcttgaggtccttcctgtggtcactttagtgggtgacacaggagaggcagtctgtgaagctccctaagagcatggctggggtgggggcggagtgaagggtgaaagcctcagattgtgtgactttgaagggagcctggagctgagttgtttggagagatgatttttcttgctgaatgatgaccctggactacatcagcaggtctgacaggggctctagacaaaataagagacaatctggtacaaatctgcatagttactggaaaaattagtgtccacattcttcttacagtgcatccaaaataaggacccaatgtcaaagtgtaggcttaactggatgagagaaaggtagagaaactacagctcctccctcaggtcagatttaaattgagtggttactgatgtcttttttaaaatgtgaaatttagtggagctgcctttggaagtgtggtatttatccccgctttagtctgtctatccatagtggctgggagcttcaggttaggctggcattctatgaggtgttcttggtaaggattagctggcctggagtctcactatgtcaccaggctggagtgcagtggcgcgatctcatctcactgcaacctccacctctcgggtttaagactctcttgcctcagcctcccgagtagctggaattacaggcacacaccaccacacccagctaatctttctgtagaggttattattattcaagggtgtttttcaggaagctggtggacagtggtgggcatttctgctctgggattcaggttgtccttagaggagaaattctaatgatctggtagaacattaaaaaawgttctcgaatatttaattattagctatcaatgttcttttctgctgccctgtctcttcgcttactttatttcttgttccccaagtaatccacttctcaaattggctccttgcacataatgtttttttaaaaaaattttttgctgatatcttaattagggaaaatgtcagctctgcgcttagccttcttgtttctaaacatagtaagatgcctttgtccttccccttaattgtacttgctgcagagctaagctgttaggtttgctttgagtgtgtgtgagccatctttttgacaaacatagcatactttttgtgtatatgtgttaagatctttcattaaatgtgacttgatttatttatgattttgatctacgacaggttttctttttcattgcttctcaaatttgccttgaaatagaattacttactgcagtaaatgatttgcagtatgtttatccccttcttcttcgtccgtagcagctgctrgttgaagtgggaaataggattcagtggtggaataagaattagttttttttggatatgccaaatttcaaattgactatatagctaactaacttgtgtgtaaaggatatttaaaagccataaaacttaatcttgtcatttgactaaattcagccattttcatgaaattggtatgcatttataattttcatgttatggtcagcagaacagctttagtctgtgtagtggtcatgggcatgcactctgtatccagacctgccggctttgaatctggcctccctatttccaagctgtgtaccgtgagrcaaattattcaacctctctgttttaattgcctcaggctgctataacaaaataccatagcctgggtagcttgaacaatatagatgtgtttctcacagttctggaggctgggaagtccaaggttaggatgccagtagattgggtatttggtgagggcctactttctggtttgcagatggctgtcatcttgctgtatcctcacatggaaagatagagatcatccattcatgaggcctccactctcatgacctaataacctcccaaaggtctcacgtcctaatgtcatcactatgggggttagggcttcactatgtgaattttgggggacacaaacactcagtccatagtagcactctctatttgcttaactataaaatggggataataaagacatggacctaccttataacgttattgtgaagattaaatgagataatacatgtgaggtgcacagtatagtggctgttaccaagtaggtacaatagccagccatgctttgcttagtgatggggatatgttctgagaaatgcatccttaggtgactttgttgatgtgtgaacatcatagagtgaactacacacgcctagatggtacagcctacgacacacctaggttctatggcacagcctattactcctaggctacaaacctgtgcatgtgaccatcctgaatactgtaggcagttgtaacacaatagaagcaattgtatatctaaacacatctacacacagaaaaagtgcagtaaaaatatggtattttaatcttatgggaccactgctgtatatgtggtccactgttggtggaaatattattatgctggaaatccataaatatccacttggcacaaatagtacaaatattctgttgtttttttaattctatctttcatgattgctatggcaaattagacttttcatatttgaaggggatttttttttttttagtgagttatctcggactrttagcaagcaattctggctgatgttagtcataaagtttacttgaattttctttagtacaatcatccctgaaattataaagaggaaatgagttggtcaaaacgggtatgtaaattcaactttattgctccacctgtacaaaaaggaagtagaataaaaaataaacatattttgtgttaggacttcagggaaattcagtgttcagaaaaatgcttccaaatgtcgtagtacagagaaagttattatgaacctggttaacatctgactgcgggttctaccaagtcaccaaactgggacatttctttttttttttgagacgcagtctcactctgtcacccaggctggagtgcaaaggtgcgatctcggctcactgcaacctccactgtccgagtttaagcgattctcctgcctcagcctcccaagtagctgggattacaggcgcctgccactgcacctggctagttttttgtatttttagtagagatggggtttcaccaccttggccaggctggtcttgaactcctgacctcgtgatccacccagcctcccaaaatgctgggattacaggcgtgagccaccgtgcccggcccaaactgggacatttcttaagatgagcaagtgaaacaaaagtttcagtggtttatrtagaatctcatgttgatgtatatttataagcatgtttattttaaacatctgagagaaacagcagagacttgctatggtgtaacgcttactttccracagttcacatatttcccaagttttaaggagttcctattgatggtaggtgagtgattcttttggtttttgaagaaggattagttgtgacaaccccgtgagctaatcaggcaagttgaatgttattttattctctgtcatagattcagaagttaatatgtgggttccttagcaactaatttgcaggtgtagtcacacatccaagtgcgcgtggagaacgagtatcccaggtaggatgtgatgagagcataggagggactcagcctgtgaccaatcatgtctttgtgcttttaaggcacaaatggagcatggaggggccgtctccatcataccacctcctcttgctcctaggcgagcctaacttcctttggaaggggatatccagccacctcctggtagatagtatctggcacgacagtcatatgctgcacaggtgtgtggactaggagcaataggccataccctacagcctaggcatggagtaggttgtaccatctagattgtgtaagttcactctgtgatgtttgcacaatgacagaatcacctatggatgcatttctcagaacatatcccttttgtcccctcccccaccccatcctcttcatggccacatgktgtgttttgtcgttactatacctatatcttggagacagcactttttaagcatattttggacttctctctgccaaaaatgcggacaagtggcctctcttttgccctcagtgggtccttactcccagtctgtctagtttctccccttgattgaaagcctccttgagagcagccaccgcatgattttgtttactgttgtgtcctggagtgtaagacacagtgccttacacagggctggtgcccagaaagatttgtgaatgagttggtgaatgaatgaaattatctatttgaacaaaccaaagctggacacacatgggtagccgtatagcctggctgagatatgcttgatcatgaagttatggctttattcatctgttggcagtgggattgactaattctcccttcactccctcatgcccatggttgggcagccaggaccttctcacctaaacataccatctgttgttggctcctggctatcacatttagttacaggtctttcccccttttaatttccggctgttattaactatcctctatttctgatgtagtagcattctcacttcctgcttttcagtttgactgggttgcaacgggtccattatttactcaacttctttctttatcratttcctcatctataacatgtcaacaatggtattgcctctcttacagggtagttgtgaggatgaaggggttaaatgcaggtgaaacccttagagaagtgcctagcagtagtcagcctgacaccgaccatgtctcatgaaagtcacacagacctgcaaggctcctgcaatctgccctttactctttgcccttcccagctacctcatcgatttcctgactgctcgtcttgccrtggggaccatccttgcattaaccacaggaatttccagcaacagtccactaccatattcctagcactgagcatagagtctgacagatgatgtgtgtgattggaagatgctgtgtttctgcctacccttggctgctgggtgcagggctcagggctccacagagtgaaggctacctctgcataatagctctgcggcctccctgtctgtattaggaagctgatgatcatttattattccagcaagcagtgacaaatcagctctgtgtgtyggtgaggataggcgaggctatgttacactcaggagtgacccaaactttcagtggcttaaaccgagcaagtcatattctcactcgtgctgtgtagcttatattggctgatgtaggggttctaccctcaccatcactcagggacctaggctgctgaggctctgtgtagacacatgtggccatgactagcaaggcaggcaagggtcaggcgtggcacctatcggctcctaaagcctctaccaggaagtgcacacatcacttcacatcagagttcactgggcaaagcaagtcccttagtcacacccaacttcagaggggcagcaaagcccagccctaccctgtcgctggaaggaggccaccagaatattcgtgcctggtctttgatgctccmgtgaccaaggatgggtttgcgataaatggagtggggccccactgttctcagggcttctaaaaaggaatgccccttgccacatctccaccctcagttccgataattaattgttttatttaatcagggagaaaagacattaattccaggaagcttagcaaacaggcggttcctctaggtatggtcttcaaaagccctcaggagcaattttcccatccactttgaaggatataattccactgttggtctgaagagcaaatgccctgcgtaatttagagctgggcctcagaggggagtgtgttaccggacartcccctcagcaaactcagttattccactgggcttttgctgagccctgctgtgtgtttggactttatgtgaccttcaatactgactgatccataggcttgtcattgcataggtgagctccacatcctgtcaacttgattttgacaatctgaagctggaaaagctttggggagcagcgcctctgcacactgtgtcaggacctgggcttccggggctccagagtggttgataaacatcatggcggctcagagagggagaagccaaccaacagtgtttgctagaggccaaggtggggtcagggcctgaggcgggggatgacctgaagctggggacggcctggaccagtaggtggctgactcaaagactgagcactgagagcctggggaagaaagggggagaaagttcaggaaatggataccagctgggggtggctgctaagaatgaggcaaagctggagaagttgctggggtccaaccaggaggaccttgtgggccaagccagggagtcagaattttcagctgagtgaggagccatggaagcagtggtgtggggtggtcaggtttgacttttcttttaagttatgcttgacttagtcttttttttttttgagacggagtttcactcttgtcgcccaggctggagtgcaatggtgyaatctyggctcactgcaaccttcgcctcctgggttcaagagattctcctgcstcagcctcctgggtagctgggattataggcacctgccaccatgcccagcaaatttttgtatttttagtagagacaagatttcattcaccatgttggccaggctggtcttgaactcctgacctcaggtgatctgcccaccttggcctttctctttctctgtgtgtgtgtgtgtgtgtgtgtgtgtgtgtgtgtgtgtgtgtgtttgcatgcttttaacttcaacttttaagttcggggtataagtgaagttttgttatatatgtaaatttttgttatgggagtttgttgtacagattattttgtcacccaggtattaagatgagcacccattagttactttttcctgatcctctccctcctcccaccctctacccttaaggcccyagtgtgtgttgttctcctctgtgtgtccatgtgttctcatcttttagcttctacttttgggaatgtgtggtatttggttttctgttcctgcattagtttgctaaggttaatggcctccaactccatccatgtttctgcagaggacatgatctctttctttttatggctgcgtagtattctatggtgtatatgtaccaacttttctttatctagtctatcattgatgggcatttaagttgattccatgtctttgctaatgtgaatagtgctgcagtgaacatacatgtgcactgtctttatgatagaacgatttatattttttgactacaggatcttgacaagatttacattccttgaccacagttaaatggtacttgacttagtcattgttttttattttttacatgctttacttcttggcatgatttgtatttctacaactgattggttttcacaatatttgttttaatcccaaagatatatgttacaccgaataaccacatcacatttaatctgatccttttcaatattttttcactcacacagaagactcaacaatgtaaaaaaactgaagtagaatattatattctaacatagttttagtcactgttggagaaaggtctgtttattatcagggtttctttattttattgggtggttgttctaatttgttgttttgtcaaaatttaaccttgtatttatgtgcttaaaacattaaggatctctaatttagaacagattagtcttctggattaattagtcttcttctagatttgctggtttgatggtgaaataatgtattttcatgaatcttcttttggtaatagcttaattaaatgatcagacaaatgtttatacaacacattctaaaatcatacattttgttcagaagagattgaaggtgaattggaattttaaaaagacccttctgtgctcagggcatgccttcctgatgggcgggtcctgcggaagattgatcggtgtgggaacagaagaacaggaattaccttttttttttttttttttttttgagacggagtctcgccctgttgcccaggctggagtgcagtgaagtaatctcggctcactgcaagctctgcctcctgggttcatgccattctcctgcctcagcctcctgagtagctgggactacaggcgcccaccaccacgcccggctaattttttgtgtttttagtagagacagggtttcaccatgttagccaggatggtcttgatctcctgacctcatgatccacccgcctaggcctcccaaagtgctgagattataggtgtgagccactgcgcctggctaggaattaccttcttatgggacattttttcttacaggattttttatttttttatttttaattttttaattattatttatttattaattttttagacagattcttgctctgtcacccaggctggagtgcaatggcatgatctcggctcactgcaacctctgcctcccaggttcaagcagttctcctgcctcagcctcctgagtagctgggatcacaggtgtgcgccaccatgcccggctaatttttgtatttttagtagagacgggattttgccattttggtcaggctggtctcaaactcctgacctcaggtgatctgcctgcttcagcatctcaaagtgctgggattacaggtgtgagccaccgcacctggcccttacaggatgttgtaattaacctttgttcactcactaaattcctccttcttgtaagttcttttttctggacagcactgagatcaatccgtgagggtctgtgtactcccttctcctcgaaagcaccaggtgaagggtgatgcatttaaactatttgatagcactctccacccctcacaccccatttcttaatctatttctgttgacacagcgccaccccagacagggatcataatgcaatagagcagatgtcagtgttccttcatgacttgctctacattctagtcccatttctcagggccactgttattggatttgagcgagagtctagcctcttgattggataaggaagacacctggctatccttgattgcatttggaaaacattctgcttttttttttttgtggaagattgagaaatactctagtctcatcttcaatatagtatcaagtcatcttttatgttggaggctttctgttgatggctaaactcgtcattttgatattgattgcttttgcttttctttcggtagagaacatttctgactttatattctaggattgctcccatttgaaaccttcgaaacctttcttcagactgatacagaatgctttattatcaagcacacctctggataaaactgtggattccttggcaccaacagccacagtttggaatcttgaccctgagtagttctaactgaatccagcagcttctactcacctttctgttcttttaaatgggtcacataaatctgtcccccaaccccccaacacagaacccctccaggcatctacaggagggtgaaagctgatggtcacccttcagcaaggctttcttaggtgcgtagcctgcccttgattccaacttgtaagttaaaggtgagaaaaggatgattttggtcaaattctcccttgatgcctgacccagggcaaaccatgtcacctttcttatccttctgcatgctatattttgaggttctgtctcatggcttaaaatgctgtctatatactggtgaatcacaaatgtatatctctagcctggacgcgtttatgaaactttattcttatatctccaacttcctcttcaatgtctccacctgaacacttagtaagaagctcagccttagtatgcccaaagcccagcccctgatcttcaaccccacttttctccacggcacttcctccccactttatgcatgttaggaatggcaactttatcctaacagttgttcaaggcagaaaccttaaagtcatcctagatctctgtattttgcctttttttttttttgagatggagtctctctgtcaccaggctgaagtgcagttgcatgatctcagctcactgtaacctccgcctcccaggttcaagcgattctcctgcctcagcctcccaagtagctgggactacaggcgcatgccagcacacccagctaatttttgtatttttagtagagacggtgtttcacaatgttggccaygacggtcttgatttcttgagctcgtgatccactctcctcggcctcttaaagtgctgggattactgcggtgagccaccacacccagcgtattttgcattctgtagtcaatttgtcagcaaatcccattggctctaccttcaaaatagacccagagtctgtccttctctaccttggtccataccactaagttctcttgcttgtattacttttgcagcccctacctgccctcccttcttcctctcttgctccctatcctcaacccggatgccagagtgatcccgttaatataagtcaaatggtgtacagtggctatgtctttacactggtctgtaccacctgtgtgatctgactcccccaccctacccacacggttacctctctgatcccctacttctttgcycttcactctctctgctcccgacattggcctccttggtcctcayatgttttctcctctgggctctgcagcttactgttccctctgtctggaacgttcttctacatggttccctccctcaccttcaggaccttatcatacgtcaggctcccagtgaaccttccaggatcaactgttgttgaaatggcagcagcctccatacttcctggctccttttcctgcgttgcttttccctgtagcacttatctcctgctaacattattttgcacatctaaaagctaggagtgcaaagattctgtcaattttgtttcctgctctattcccagcatctggaacaatgcctggcatatagcagacattcartaagtatctgtggagtgattgtatccaccagatgttttttactgactgtgtgcaaagaacagttctcgaaattgggagagacacaagtacatcagatgtgtgtatgtctctcagagcatccgcagcagtgtgacagagggcaaggaccataacacctgctcttagaatcttcatttaagcaccatagatccttgattgaatctggaaaacactctgctctccttgtggaagattggggaaatattctggtctcatctgcaatatagtgtcaagtcatcttttatgctggaggcaatatagtacctgtatatttaactgcttggtagtggatgtttgctattctttagcatctcagagagtataggggaaatctgcgtgtttgagtacttatgcacattgaatgtggttattgacatgaaattcaaaggtgagactttaaaagagggagaccttaccctgctgactattcatgaaggaaatggtttcaggcaatggagtggtctctgaactgggatttgaggtgtagatagggaaagaagagggttccaggtacagattactgtgtgcacagaggctggagcttgctgactcagtgtctgggaatgagcaccattccagattctgtttgtttctcaatgtctccctaaaggatactactgaatcctcttctcggagtcctcacacagcatgaaattccatgcatgagatttgattggctgcaggtttaggctggtccgttttgacttttcccattcattctgtgggcttgatttggatgccgcctgggctgcctggttattttgttgtctctaaattctggcccatattatttgtgttgtacttgagtctgctagagcagtggtccccaacctttttggcatcaggggctagtttcacgggagacaatttttttcacagactgggggttgggtgcagatggtttcgggatgaaactgttccatctcagatcatcaggcattagattctcatgaggagcatgcaacccagatccctttcgtgcgtggttcacaatagggtttgcactcctatgagaatctagtgctcccactgatcaacaagagacagggctcaggcggtaatgctttcttgcccatgttcacctcctactgtgtggcctggtcccaaacaggccatggaccagtaccactgtgctttaaaggaaattcagactggcaaattacctatctgctccaggtatctgttgttgcatgccacaaaacaccccccaaatctcagtagcttaacacaatatgtgttattatatttcatggttctgggggttgataggactcagctggatggttccctcttgggctctcttacacagccggagtcagatggtggctgggtctggaatcatccgaagactggactgggctggttttccacgatggttccttcacctacaggtctggcttcttgccctctctgtttccacacagtgtctcayctttcagggcctctcatcttttgggactggtactagtccatggcctgggtcttgggacccctgtgctagaggatgacatggcacagtcacacatttggctgaccttttagtgggagggagatagaccctggaatattctgagtgatcagttctcttttcccagttatctttttcttactctgttgtttaagtacagagtataaatcattttttgtataggctgttcctggcagatatgggccaagctttgattcatagagagaaggaagcttagacgttaccaagaccagtgcttcccaaatctcctgattatccaaatcaccgagggagctttaaaaagtcactcaaggcttgtttaatcagcatctccaggacacaggaagaagaaaaagaggaggaaaaagaggaggaagagacaaggatgtctcacatgtgagaaaatctcagagactgctacactagatggaaagttgcctatgtcagtggtccccaaatgccacactactcagaaagacaggaaaacaagaaaaaaagtacattttctttattagaattggagtgtgtagatgtctgtatcagagtctgcattttcaaaagaatttccaggagtgagtaagagaaaggaagatgaagaagaagagagctacgacgggaaagagatcggaaatgagaagatggacttggcttgcatcctgcagataatgagtaaatgctgaagtcctcgatggagggccagggctgggagaaggggaggagggaggggtgggaggtagctgtatacatctggaggagggaggggatgacatctgcctctgctgggtcactcagatctggaatgtccttgcaaggaagcccattctgattttgaacagctgctcttgataaaagctcattccccatttccttctaccattcataggatgtagctctggagccccctgtcctaagcctccttatcctggcttccatccacttcttcagcaggcatttattgaatgcctaatgtgggtgacatggtttggctgtgtccccacccaaatctcatcctgaattgtagctcccataattcctgcgtgttgtgggagggaccctgtgggagatcattgaatcatggggggcggtttccctgatactgttcttatggtagtgaatgtctcacgagatctgctggttttgtaaagggaaactccttttgtttggttttcatttctctcttgctgctgccatgaaagcagtgccttccgccttctgccatgattgtgaggcctccccagccatgtggaactgtgagttcattaaacctctttttctttatgaatacccagtctcgggtatgtctttaccagcagcgtgagaacagactaatacagtgggcatggttttcttattttgtttttttctctaaatccctcttccatttctgttaccttccacttatcccaagaaatggttacttaacaaattcaaaacacttataaggatttggacacagcttgagccaagatttatctttctttggcaacccctgtttgttttgtctcttgagagtatgtacaaaatgatactgtaaacaggattttaagtggcatgtgtaatttagtgaagagaaccaaataatgttctactacaatttgtatgccaattataaatcatgcttttccattaattaaaggagtagctctttgattatctaccagtaggatgcaaaaatgattaaatagtgttttatttaaaatattttacattttattaaaccaccttggcttctgactactcctaactcacctcgcctttagcacaaacagttctgtccttggtgaatctgataaaatgatttgcttgttcwgctataaaacgtaaaagaggctcttataatttgttgcatagtttaagaccctgttttgtttgaccactgcttgggggttgatgtttgttattctttagcatctcagtgagtaccggggaagtctacttgtttgagtacttacacatgttgaatacaattattgacactgatttaaaggtgagattgactcagttcataaatatgacagttgatccaggaggcattctgtctggaataaattgataaaggcaaaagttataaaaagaatatgtgtctgcttttgctttgtactttacttacatacctagagcagttactagttatagccttttgaatataacctgtatgaccatcttcaaatctgtctcaatttcaagaggaggttactcatgcaattatgtgggttactcttattcttaacttgaacatttcagaaaatgmgttttatggtagttttaagcctaagcattttacatggcagagagctccggtttattcactcaataacaaattgcagtatatgtgtgtgtgtggataccatgttatacatgggggctaaaaaaataaatgaaatgcagttcctgccctcaaggagctcttagtttgctagtggagacaactgatacacatctggattgacatkttttgtttttgagatagagtgtcgctattgcccaggctagaaagcagtggtgctatctcggctcactgcaacctctgcctcctgggctcaagctatcctcccacctcagcctcctgagtagctggaactacaggcacccaccaccatgcctggctaatttttgtatgtttatacagatggggtttcaccatgttgcccaggctggtcttgagctgaaagtgatctgcccaccttggcctcccaaaatgctgggattacaggcatgaaccaccatgctcagccccttgttttgtttttttattgttgtaaaatacacataatataaaatttaacattttagccatttttaagtgtacaggtcagctacattaagtacatttactatttttttttgcaaccatccccaccattcatctcccgaactttctcatcttcccaaactragacactgtgcccattcttgatgggttttaatatgcctaggaccacagagctatgggaggccagaggacaggaaactcccagttctaaggcagtgtcaggtcatgggcagtgattggcctgaatgccccttgcccatcttctgctgtgtccaaggactgaagacctgccactctgcagcttggtcgctgtctgggctgaagaacctgtctcagtgagtgggggactgggattctcctctcttgtgtcagagagactaaaaccgtagttctgctagacctctcacccctttctataaataggagcatcaatggggccttccaaaggaagtcattgcaatacactgttgttaagccttctgagcttctagctgtactgcctggaacagcctagaaactggcaaagatttatggtcattgagggcaactgggcaacaataaatcttcagccctgcttgcctttatagcatctgtgtaagcttgctggttcagagccactgggactcaaagtaaatcattcagtcagtcactcagcagataattatggaccgcccactaggtgtgagacattctgtttctcctttcttttatgtcaatatttagcagaagtagtagcaaggcatccaattcttgaatctagtttctcttctaaggactttttttttttttgaatctctaaggttgttttgagtatgttctcctcaatccaaattkttccctgctcaggagaaaataaagctctggggagaggcttaaccatttaatcatgtaccatttaacacctctttctgggaatggaaacatagatcagcataaagaacttgtcccattagtatttgccaccgtttttcctttgaaaagtaaagatgtgtttcaatcacttcatttgttaaaattaaagcatggcctctccttctccctgtccatctgctgtgacttgtgatctgatttgagtgtctgttctagtagcagaagcagcagaggtagatgagacaacaatttactgcctcagtggaaacttacttcatggccgagtcagaataacacagttggagtttttaaaattaattggaattttattctacactacttgtctggagtctaagctacaaagctgttgttgtaaaggtgaaaatctagcctaatcagtgccaatggcatttgcagaagatgccaagaacttcctgggtctcaggaaggctggaatgtacttgtcctcccttctccctccctccagtaaacacaaccttccaccctcccctcaggctccagctgctgcttgctgcacctctatagatcccgagtttgggaactggctggagtctctgttgaaggactggagaaggttacaaggattgtctctgcccctgcctacctcaggcctcccasaggtgggggatgagggagtctgtggaagaggaaagaactaagggaggagcccagtgtgagaggctctgctcccgcctgcggcacttccctgcacctgccacaggtccaattcatgggaacagctggactttctagccactgtcgttggtctaggaagttaaactgtgggcctcttacccaccgcagtcactccctggaggtggcctcagagctctggctccagagggcacctgtcttgcatggagaggtaagaaatgtttgagttgaactgaatattcgctgccggcctggggtcggtgagattagtgagaagggaacaggtggcgtaaaagctaatgggatgctttaagattggcacattgctgatttccaggctgccgtgggaaggctggtggtgggtatccaggttgctgtagcggggtggagagaaagcacctcctgttttccaatgtggaggcaatctggccatgacatctgtgtccctgcccgccacggtggaggagggcctggatgcccggctttgtgtgcccctggccgccacggtggaggagggcctggatgcccggctttgtgtgcccctggccgccacggtggaggagggcctggatgcccggctttgtgtgcccctgcccttcacggtggaggagggcctggatgcccggctttgtgtgcccctgcccgccacagtggaggagggcctggatgcccagctttgtgtgcccctgcctgccacggtggaggagggcctggatgcccggctttgtgtgcccctgcccgccacggtggaggagggcctggatgcccggctttgtgtgcccctggccgccacggtggaggagggcctggatgcccggctttgtgtgcccctgggcgccacggtggaggagggcctggatgcccggctttgtgtgcccctggccgccacggtggaggagggcctggatgcccggctttgtgtgcccctgcccgtcacggtggaggagggcctggatgcccggctttgtgtgcccctgsccgccacggtggaggagggcctggatgcccggctttgtgtgcccctggccgccacggtggaggagggcctggatgcccggctttgtgtgcccctggccgccacggtggaggagggcctggatgcccggctttgtgtgcgcctggccgccacggtggaggagggcctggatgcccggctttgtgtgcccctggccgccacggtggaggagggcctggatgcccggctttgtgtgcgcctggccgccacggtggaggagggcctggatgcccggctttgtgtgcccctgcccgtcacggtggaggagggcctggatgcccggctttgtgtgcccctgcccgccacggtggaggagggcctggatgcccggctttgtgtgcccctggccgccacggtggaggagggcctggatgcccggctttgtgtgcccctggccgccacggtggaggagggcctggatgcccggctttgtgtgtccctgctgtggctgcgtggttgtcaggtgaccatcctctccagggaggggagagctgccccttgctgagggagggtgtgcatggcttgttcccctgccagaatgtcccattccttgacattttgaccagtcttgccacattctatgggttaagacctggatgattacaaaagttgtggaagatggttttcttgacggtcttgtttgcaatggaggtgccagcaggtgctgagaaacactgagggacctcagcaatgccatctgttctcagaggggctcaggagaagcaaagatgagcagtggccgaggaatggtgccgctgacatagtccgggcagccccgctggcacttatgctgctgagcttggcttccacagccagggaaaagggtgtctttctgtagcagccatctgcctcgctcatcatcagttgtgatgattttgtcttacctgccaagtggtagttcttacgtcttgcagatctttgaatcctcagcacctagcacagtgccctgcctgcagtaggggtaacatagccaggaagcacagcatgcacgattgttttctccaaaagatgtgcagaaatcagtgaccagacagaagtggtaggcttcttctttttttttttttattgtcaccatctataatggaatggcatcctttacttaaactcaacacctttggaagcactggctctcagaggctaatgcctgtggctcccaactatggtgacttgtgatacctcactcagatatgacgggtcagtggctttggagggggttctcaggaatctgcatttttacaagttcatgggggtgattctggggcaggtattttatgaatgtgaatcataacttgaaaaagaacaggctttcagctgaggcacggctatcattcgaatgtgtcccctccaaaattcaggtgttgaaatttaatggctaaaatgataatattaagaggtggccctttaagaggtgattaggctctgagagctcctccctcatgaatgagatcaaggcccctgtgaaagaggcttcatgcagcattccatttcaccttcctctgatctgtgtgaggacactgtgttctggagggtgcagcaaggaggcatcatcttggaagcagacacctagtcctcaccacacaataaacccaccagcctcttcatcttggactccagaaccaagaaaaaaatttctgttcatggtcaggcatggtgtctcacacctgtaatcccagctctttggaggctaaagtgggagaattgcttgagcccaggagttcaagaccaatctgggcaatatagtgagatgccatctctgcaaaatttttaacattagccaggcttagtggcacgcatctgcagttctagctcctcagtaggttgaggcaggaggatcgctggagcccaggagttcaaggttacagtgagctatgattgtgccactgtattatagcctgggtgacagagcgagagcctgtctctaaaaaaaaaaaaaaatctgttctttatacattacccagccttttgtattttgttagagcagtgcagatggactaagtcagatacgctctggaaatggattttccaagtggggaataaacaacgaggaaggtaactctgtgtcatttccactttcttacacctggggtgcttcacactttaatttttgtcacacctcgtgtaatccccttggtactctttaacattaatcttgaagaacaccttacatttttggtagcattattgaaaccagttgatatattaatatttgagggcttttataggatatatatatatacacacacacatacacacacatgtacacaacacacacacacacaacacacacatacacacatacctgtaggatgtacaatgaaaaaccagttaactttctgaagtacaggattttaaatagactctatttgagccctggagattggcagtagtctcggctacccctcatggtgccggggtccgaattactcgcctctctgggacagctcccttttctccctcccttgtgatcttgcatccaacccttccttaaccaagtctgcagacttaggttygtcctcaccctaaggtgaaccagccagctcctgttctcagtctrgggagtgctccttttccactgctgagcagagactggagcaggagacacagtgatgcgtctcatggccctgcccctggctctcttccctttggacacacccctaggtgcagctgtggcctcctctgtaacaggtctgcagaagagcaagattagaagcagccatatcccctacatttgtaacaggagaggcccagacctccagctgggggattaacatgttctccagaaatggctagttactcccaaacttgcttctttcctccaagtcttcactgagagcctgaatccattcatatctgcctcacaaggagtgtggtcccctgagtgtgtgaaagctgtcgtcatcctctaagtttccatggagtttcctgggctccagctggctgtggataccagggcttgaatgtgytgggtgcctggagccgcatgtctgaagggctctgctctcctcccttgctgctccaaaagtcacggaagtcaaaagggagaaatcattccccagccatgctgcatcctgaaaggcacatagcacaagttgtaggggccatacattttgaggtcagattgtccaggtttggaactaaggaagcgatcggccctattgggcaggatactcagacattccatctgtaaatagagatgatgataatactcacctcagggaattgtttgttattttatttacaaaatgattatcggggtcatgtgtcaggcgctatcccaggcactgctcttggtcctccagtatggggaggcagactgagaaatgtgaattggaagagtgtggaaagtgcagcgaaagagaggtgcagggcattctaagtttccagggctgggaggttgacctcatcacaagtctggcgaagacattttgctttaggaagtgatggctgacacgagataacaagaagagtgtcctacacatgcacccagcacgtgcaaaggccctgtggaggcctggctggggagtgtcctgagggatcggaggagaccagcggagttagagctcagggagttggggtgaggcattgaatggagaggaggccgggagcccagcaggggaagccttccaggcagaggtaagactgttggtcctaagactggtaggaagccacccgtgagttctaagctggtgaatgacagatctgtgttcttaaagttgctactctggctacagagtggaaactgggatggcggaggcatgagggtgagtttatggaagccagttaagaggctcctgctatagcttatgcaaaagatgatttagctttcactaggggggcagtggaggtggtacaaagtgcaggttcaggagacggtaagccatagaattgacagttatggtgatggattggatggtggcgacagggagaggaggggtcaggagtgaagtattccatgaaccgtcacattgcctgcataaacatgcattacaggtaaacgattatggtaataatttacaaagaagcatgccctttgctctgctcatttcacaaggcagctctggttaaatgactttttattttggactggcctcattccctaagaccaaaggcagctgagcctgtgtgccccgggggcctgccctctgaccctggtgtagccttgcatcaagcgtgagctcctctctcgcctctctgctgtgtggtgtgaggaaggtagtgcaaggaatgttctagcaagtttctcatcctcatgcagaacatccctggtgggtgcccaccccacaacaaggcttgccagccttgagtctctgttaatctctgtgtccctcccctgtacccccactctgtcacgcaggctgggtcccacggaagaggcactgcctggctccggctggcttttcccagatcaagcccacacctccttgcctcaggctgtcctggtgtctggctttgcttctccctctctcattggcacccttgctgttcttaggtttgtccctttctcattggcacccttgccgttcttaggtttggggcaggcccgtgtcttgtcagcagcaaccctggctcctctcaaccaggagctggagtccccattgggcagaagaagcttcggccgactttgccgctcctttgccgccgggacagccctgcaggctcttctctgggagggtccccatggtgccctcccacacagcctggcctggtctcagggctgaagctgaggacctgggtgtgcctcagttggctgaasgtcattgtatgactcacacctggaccttttgcccagccctcggctgtaagaagaaccagcagagccagtcacaggaaggcctggccctcaccttcctgggttcagccaccaccaacacattagtcttggtcttttgttttgttttgttttaatttaatcacttaattttttaaaagcattttagatttacagaaaaattgagccaaaaacacagagaattctcatctacccctttctttctcctccctccagtccggttgtcctttttcttaacatcttgcattagtgttgtatcttggttacaattgctgagacaatcttgctacattattattagctaaagctcatcatttccattcagactcactctttgtgttgtacatcctgtgggttctggggttgtgtgtcattttcctctaattgggttttggcaaatgtgtgatgatatagatgcacccttataagatcacacaggttttctggcctgaaaattgccctgtgctctgccttagtcatctctctttcctcattggcccctggcaatccctgatggttttactatctccatattttagtcttttccagaacgtcctgtagttggaatcatgcgtatggcaactttccattttggcttcattcacttatggatctgcatttaaggtccttcgtgtcttttcatgcttgatggcccatatcagcaatggtcttttatactccaagtgcagtgtgtctgctcaccggctggaggccttgcgatgggattcacaatttcctctcagtgtcttccaagcggcttttccgtatcatcttctcaggcttctgtgcacctgcccgtactggacatatttggccattgctgatctaggagccttcccgaggcaggaggtgaaacggtctggatttcgtgttctgtgttaggaaatctaacactgcagcaaccccgaatgcctcagtcatgagcagttgatagtgcaggggaaccgtcttctctccaagaattggctagaacgggcttctgcccactgcttttattccatcatcgggtaatttgagtgtttccagtctaagagaattctgcttggccctaagcctttccactgcaaatctggatgtggaccatcttctatcagagacagctcaggctcaatccctaaattaatggcaagcaagacgtagacaggtgtgacttcttagagacaggctggactgctgctgctctgtccttgggtggcgccagcccttcctttattctttcccagtcttcttatccattgcctgtagcccaggaccagtgccaagcctgtagcttccgcatggtgttcctctcccttccggggatcttcatgtaggtgctgcacggrgaaagaagggccctgagaagagaggctgctgtcggcacaggagccgtgagggtggcggccgyctggccactgtgtccagtgctttcaaggtgttctcagtgtcctcgtttatgccacggcttagaagattgtccttgccatctttagcaactgtctcagccgtcacttattttcactcgtcttacgaggaccaacctgccgactttctcgtcackggggcattgttaacaaccagctgtgcgtgtttagtgtkcataagcagagcaaagtgtgattgtctccaggaagctctgcatctgggtttttttgctgacattttcttttctttttttctctttgaaygctgtggttttgaacaaatyggtaatgtgataagtcttcacttaacgattttcaggcatcaggagtacacgattccctggaagagacatttacatggaatatttatttatttgaagaggaatcggatgtgcccagtcaacttagcacccactgaggtcctgtcaccatttgttgagtttgcacaacgtgcgtgggcatgattgtgcccgatttctatccagccccgagaattagctagcagtccccatttyacaggtgtgggaactaagggttaggggatgcgttaccctgccccagctctcacgggttgtcagaggcagagatgaaactgaaacctgggtctgcttctctccaaactccatgctctgggcacaacaccacttggcccctacccaagggaccgactctgtgctgagaagcagggcagcctggggcatacacgggaagtcggaggcttcagtcgctttcttcccatgctgtgctctgttcaccagactccctagggtcctcccattgcaggaggaagtggcctcttgagccctttgagatcaaggctgggcatagaacacaacctctgctccaactcagagtcttttttttttttttttgttaaactgtgtctggagcactttgataatctctccagagatagtcatttttgctaaaatgaattgctaaatgtaggggagagatttgggggcacgaactaagcctgccctgggtgccagtgatactggcaacttccctggtgggtgggaaagagaaacctgcctggtgggtgggttcmggacctagaaaagacctcctcagcctagttccttgttgctttgccrccgcccccaggcagttcagcctgggcttagtcagtgtctagcagcctcactgaacttctgggaccaacagcccctgggtacttctcttaccacctggtctgcatcgtcagtggctcacacacccatcacactggcctgctgctgctgttgcataggtgtgagcttggtacttgtgatcttgcaaagtgctaaatggctcacccaactacagtacctgatggagctcttgagataccagtttgctctctgaggtttggatcagcagtgacccagataagagttcgtttgtaagaacaaaatatatatatcatgcttgggaggctgaggtgggcggatcacttgatgtcaggagtttgagacaagtctggccaacatggtgataccccgtctctactgaaaatacaaaaattagctgggtgtggtggcaggcacctgtaatctcagctacttgggaggctgagcaggagaatcccttgaacttgggaggtggagattgcagtgagccgagatagcrccactacactccatcctgggcgacagaatgagcctccgtctcaaaaaaaaaaaaaaataatggaaataaaaaagaaaaagaaatatatatatcatgctactccctagttaaagccagtgtcatctcttcccagcttatttctgtggcctcttaactggtcttttcgcgtatgccctcctttctaacaggtaaaccataacccatcatgcctctgaaagaatgagaacccatcaatggcttttctcttgctcacggtacaagtcagaggctttacaggggcctctgagtctccacatgctctgtcccttcccccaccatggccccaactctgatacagtgaccccgggctcctggcagcttcttagacacagcctggcattacgtgttttcccttgatgctgtgtctttaatcagatacctttctcgctgagccttaccctgtcactgcctgacttaaaattccagcccccatactccctgtctcccctgcctaatttttctgcaaaatatttatcaayctttgccactgtacgtattgtacttatttgtttattgtctgtcttcccccattagagtttaatccccacgagagcaaatatttttgtcaattgtttattccttaaccctggcatctaggacagtgcctggcaggtagtaggtgctcagtaaatcggtgctgcaggggtttgcctggtgttctgagatcctgatgtagatgtgcctagttctagaataatctgacgtaacccgtgatgtgcatcttcatgtgtgagcactggtatttgttttacagtgttgatttgtgagacaatgccactcctgttcacttgtgttggaatgtgtcttcatgagcaggaggaaagggaggcgttctacacggggcatgaggatggtccctgccgggagctctcctctctgccgcagctgtcatttgcatctgcgtcagtgccccagaagtgaaccttcgtaggatataggtaggtcaggacctgctctcctgggtgacaagaaaggcgattcctgtaaatattatgtaaaacattccttcacttcaccatggagtcaatggagtcaggttcagtcaggctattttgatgtttttttttgtttgtttctgtttttgttttttttttgcgacagagtctcgctctgttgtccgggctagagtgcaatggcatgatctcggctcattgaaacctctgcctcccgagttcctgcgattctcctgcctcagcctcctgagtagctgggattacaggcacatgccactatcctcgtctaatttttgtatttttagtagagacagggtttcaacacgttggtcaggctgttcttgagctccagacctcatgatctgcctgcctcgatctcccaaagtgctgggattacaggtgtgagccactgtgcccggcctattttgatgtttttaaaaagggctttgggaggactttgctctctggctctaagcaagctttagccattggtttaactttaaaaacaaatgtgtattagggaaatactggtaatataggatcccactggaaaggcatatgcttgtttacccatgctacttctgtctaaggcccaaggtgaggccatcctaccccagccactctaaatggcctggccacctgtgcagatgggtgcccggtggggctgggccctcgattcgcatcaggcaagctcatctccatgccttgcgtgctccccagcttgtcaagcctccatctgtttcgttcttcactccrgcatcccatgtaccttcctcaatctggatttggggacatgccctctggccttcatgagccacaactgtagaggatataagaaaatcaaagtttatttctctatttttctggagcactccttcccaaaacaggataaatacatgaagatgtaagacctaatatgtcttaaaatgtctatggttttttctctactcttgatagatagtctgagaatgtcttagttcattttctgttgctgtgacagaagactacagactgggtaatgtatacagaaaataaatttatttcttttagttctggaggaagataatcaatgtcagcaggcttcccaatggaagccaagagcagggattccagaatcccaagaggaaccaatttccaacctcaaggcctgggaagttcaaggtcgaggggtcayatctggttggcttctggtgacagcgttcatcccgtgtaatagcatggcagaaaactggaagggcaggcaakcgcttgaaaaaagagatggggcaaagggggctgatccactttataacaaccagcgcctcatgagaaccaaytcagtctctagagaacagtgttaatgcacgcatgagggtgtgcccccatgacctaatcacctctgaargttcccattacctctcactcagtactgttgccctggggaccaaattcaccctgagtttcggaggggtcaaaccacatccaaaccatagcagggaggatgtaggccttgagggtggaaatggtttcctctcgggtttctggaatatttgctgttggcttccatgctctgttgctatagggaaacccactgacattaattctctatcttccatgtgtggcctggttttcttctgaaagcttccaggatcctccctttatccccagtgttctgacattatatagtgatgtgtcatagggtaggttgggccccttgttaagtgggaacatttttttttgcagattccagggctgatttaaatatttaatgttatattatttaaatacataccacttaaaactgggtataaattccttatgctatggttataaaaatcacatccaaattgcaaattaaacataaagtaccagctaatgaaactcaaatgcacaacatccctttgctgtgatggctggcttcactccttttgtcactggaattaggtacagattgccgtctctcagtgtcctttgagtgatagcgtttggcttcacttggcgtgaatgagtcatttatatattaaatctaccctgtggcttttttctcattagccacaacaattaacataattctgcttgatgccaatgtgtaaacacagagcagcccggcacagcgtggttatagcacggctgtccagactattcttagactgtgcttgcttacaggaattattttggattgtcattacaatgaaaacatgagatgtaaatgttttcatagacagctcacatagtcccaaggattcagttctttttatacgcttcctatgccagtttgctcccataggcctatagaaagatgagctataagaaattgtggctattgttcagatgagtgtttgaacaggccataataagctgacatttgccactccccacccctgccaccccacgtttctccatcagctgccacaatttgcacaggagtttaatcccgtgttacgttgccatccctattttgaaatggagacggatgagagctgttagccacagtcatttccaggaagctgccaagctatgtctcctagagcttggagaccatgatccatcttcaggtgaggttttagcttgaacattcctgcctgctcccttcactgctgtgggcaggggtgaacgtttatattttttaaaagctaatgtgacatcagacagggctgacagtgtaaactttctggctagttagaagtgtgtgtatatatctgtgtgtttatttgtgtatgtgtgtatgtgtgcatgtgagtgtatgagtggtgtggaatgggtgtattcatgtgtgtgtatgtttgtgtatgtgtttgtgtgtgtggatgtgagtgtatgaatggtgtggagtgtgtgtattcatctgtgtgtatgtttgtgtatatatttgtgtgtgtgtatgcatgtgagtggtgtggagtgtgtgtattcatgtttgtgtattcatccatgtgtgtattcacatggagtgtatgtttgtgtatgtatttgtgtgtgtgtgtgtgcatgtgagcgtatgagtagtgtggagtgtgtgtattcgtgtgtgtatgtttgtatatatatttgtgtgtgcatgcatgtgagtgagtagtgtggagtgtttatattcatgtgtgtgtatgtttgtgtatatatttgtgtgtgtgtgtgtgtggatgtgagtgtatgaatggtgtggagtgtattcatctgtgtgtatgtgtatatgtttgtgtatgtgtgtgtgcatgtgtgtgtatgagtggtgtggattgtgtgtattcatgtgtgtgtatgtctgtgtatatatttgtgtatgtttgtgtatatatttgtgtgtgtgtgtgtgttgtcactgcgggccagctgtgtttcaggaccctgctttgcttgcatttctgcatcctggtacctgagcctgttctgagcttcatccgtggcatgcccagcgccaggttctgcagcgcttcccagtgcagtggcaatgcggagtcccactgctgcttgcaagttggggcaagggggctggtgatggccaagcctacactgtgtgttggtttgtgaggtgtcttcagagccccggtgtgctcccgtcattactgtccttctccaaaacctctcagcctcagaacctggatcttatctttaccttttctttcccccgatccctcatccagttcatctccaaactccatctgtttattcctccctattatcactattttaaaatcttatttttgccaggatcatcttcaagccctgttgcttcgcacctgatacatgacattcccacagcctcctgcctcctccctgttatcccgggctccgcagtggggccatctcttccttctgtcattcccctgtcttgttctggagccatggagccttcagtgtgacagtctctgcaggacaaggggaaccggcagcctatgggccaatgggttttgtttatcctacacaatattttaagaagttgacggacagctttaaaaattggaatttttttacattaaaaaactctattttcagttattcctgaaaacgtagaaaatccagcagcactgagcacatattcctagaaggtgacaggaggtgggaatggcgtgttccctgctgctttccctcaggccatgttttctccagtttgctgcactcctcactctactgtatagcccctcagcctgctccatttctgtcacctgtctggcccccatcgacgtgcatatttgcagcccagagctgactggcttcctggccaaggacctttctacacccacatttagaattcatcttgtctctttgcctcctgctaccattttgcctcttgggagkgctctcccttccctctaaacctgttcaaatcctgtcattccgcaaggtcagttcacctcctccctcctrtgtgcaacttccctgcctgcccctggcggagttttctctctccctgaatcactaaagcgcttcaggtttgtctgtggctttggggccattgcatgtcattgtgtttgtcagagctgtgtttagacagcccgtcccccagtgccagggcctcactgtggctgacacacagtgccttgcactctgcggactctgggttctcaacaaatgtacgacaagaaagatgtgtagaggtgatccagggcctcgtgctatgggtaccaacaggarggcctctcactaatgtggggcagggagtagctgataactttccccagcagctgtgaagacagttgtttcactttttgtcaccagagccactgtttagggacacacctttaatgtgggaaaatgcccaaacacaactaagctctgggacgtcatggtgggccatgggcatgttccctcctttgtaagtgatttgatctatcactaaggtcattcagtgatactgctctaagatcagcatacagaagataaagttaaataggacttcaatcaaatttagaatatttccatacttctcattaagaatattaagtaccaatttacaggattctctacttggtactaggtgctgtctttgcttcccaggactctccctcaagagcctctgggtctctatgttcttctcacctgggttttgtttcagcttcactgacattcagaacacccgggacgcatgctgagctgggagcgggatgcctttctcttcctatgcctctgataaatcagggtgggatttctgagaagcagcataggttggtaaaaagcgcagatgcctaatggctgttaacgatgactcaatcacttgaggttttttccccaacccttgagatctgggctttgtttgcatcagctttctggctggtaaaaccaagctcagggtttctcatcacatgcccttgggtagtaggagtgaccttgagatgcctggcatttttttctttactcctgtcaagcccctttgagaggggaaggggctttgcttcccaacttctgggccagagggcgagtgtactctggggtagcactgtccaatagagctttctgctacaatgcaagtgctctccatctgtgctttccagcacagtagccacttgcctcgtgtagctattgagcacttgagatgtggtcattgcgactgaggaactgagttgtatttcattttaatgtattcaaatgtgcttaccacatatgcttaccatatgggacagcccagatctcaggggttggggaaaatgggtcagtgcaatacctaacagagagccgtgcacagtcctaaggggaagatgcctaactgaagatgcctactgtgtagggcgaggctctacactgctatgcaagtcaaagcctgtttggcctaacttggctggcgtcaaaactatttgaattatatttgcagaaaaacccattgctgtgctgttctgcggagggcattagttactaattgttctytcatttcctttaaaaatagcagacaccaagctcccttagctgtgatttaaggagccacagtggtatagctggcgagtgcagtcacgaaccgcataacagcatttcagtcaacaatggactgcatatatgacagtggtcccataagattataataccctgtttttaacgtaccgtttctatgtttagatgcgcaaatatttcccactgtgttaccgttgcctacattattccgtatggtaatatgctgtccgggtttacagcctaggagcaatataggctgtgctatacagcctgggtgtgtggtaggctacgccatctaggtttgtgtaagttcactctgtgatgtttgcccaacgatgctcctagccatcgaaaggtcatccttcagctttattatcatcaaagcgtttcaacttcctgtttctacatcatctgcttctattaatagctacatgattgttaagtacaaatatgaaaattatgtcgaggagtacaaaatctttcttccattaggcagaaccgcacagatgagatctaaaacgttcacattgataaatactgcttttgaagtggatttttccccttaagagccaagcaaaggatcaaaacggaaattctccacagaaacaagaataaatcactagagaggttgtttctggaattttcctgcccattgagggcctgttcttggagctaatgtcagcgaggatagtgtatcatattccttgacttcctcagtatactggggtcctcacttttgtgttgtaacacacacacacacacacacacacacacacacacaagaggttgagtactattactgaataaatgcactttagtaggaaggaaacattcagaaagtcagcctcttctgggaagccaagacaaacagctcttggagccaagacacagagaggccacacccagggaatgcccgggtgtccccagtgtccccatgtacacctttctctctagctcctgcagatgcttctcagccatccctgtggctggaaggagttgggctgccatgactcctgatgaaatgcaaaattgcaggactctcttaaatgctcttttattttgacattttaaaatgctattctgagaggtatagagaagacttaggtaacagaagagatgagaaatagccaagatctcctttgaagttcagattccaaatcagtggggtctttcaccaaatccatctggcccttcttccctctttttgggctagaggtctttggtggcaggaatattaaactagacccacaytggctgcaacaatgaaagaggttgattcactcactgataggcaggcttcagaggtggtttgacacagggatgtggtgactttatctagaaccctgttttcttattctcttcagctctgcctaacgtggagtcagcctcatccaaaacagcctttcttcagggttgtatggtagccaccggtaatttccggtgccacacttcctcggttcagagggagtgaaggggacgttcttgtaaaaacagcgccttttcccagagcccccttagttcttagttggaccacgtgtcttctcttaaatcagtaactggggctaaagccatactgatgccccaaatcccatggtggaatcaggttttccatagacccagagctgtgaaggaagatgtggacccccaaataaagattggggtaatcacccagcaaagggtggctgtcagataggaaactgycatctcccggctctatcatctgccagtctccccttatatacttacagatgcagcttaatgctagaaagtagaaaattctcattttttgaaagattacttttatggctttgtgactcttaattctcctttgctccccctcctccttctcttcttttcccctactctccttttccttccttccttcatttcccttcttcatctgtccccatccctccttcccttttcctgtcttttcccttcttctcctctttaccccttcatcctktttccccttttctctctttccttccctcctctccccctagcctctccttccccctgcttatctgtcagcccttctcaattgatgatctagttgtttgttcaacttaacctaactggtggggtacagtcaggtttcttactaaattaaatgccttcatatcctcccactgccccccaggaagaagaaatgccagaggtagaaattgacattgatgatcttcttgatgcagacagtgatgaagagagagcttcaaaattacaggtaagcagtttccaaaattgagaaccttctaatcatggacacttgagagtctacttgggtcttcagtgcttggcatcaactgattccgccctgtggtggtgttggcaccaggacctgggccatttgcagagaggaaagcaatgggctgctaagtgttcactctcttaaactgcctctctgaggataaagcagcccttgactatagtccattttcaaagcgccttatgggtataactttctccagccccattttcttgggagaaacagctgattctgcttccaaagatccacttgccagggaagggaagtgatgccccacagttgtatgagaaagagagggactgagctagcactggaatatccaagactagagctctggtctcacagttgtggactgtatcattcatgaaattaatttctaaatattgcttatgacataattctatttagtagacgatctgttcatagacagtgctcacctcatagcattccagtacaacgatggatattgagatgtctagtatttccttagtggacagcaataaagtacagtacttatttcccttcccacaggaggtcaaatctatcatttttaaatctgcttttgggagtttctaaaaccaattaacttktgacttgccattgttcttaatgtccactgataattactgttaatgactgttggtgaccacaaatggcaaatggccactacggcaatcaaagggcacatttgaatgwattaatgtgtttaatgcattagttattactagcatcccttgagtggtgaacagtctcaattatgacaattatttcttcttgctagatttagctgggagacaatagcatcctagttataaaattttaaaaagataacgcaggtatcagttctatagaaaatgtaatgacataacagagttttcttaaaattgagaacttgagaggagtttttaagctatcatcaccccgcaccccccagttcccaggtgaggacccaagctggtttatggctgcattgcacttaaaccccttgcttcctgagtgcagtgtgggtgccaccatcttgcacaggctggctcaacttgaatatccaccaagttggcagccaaaggaaaggtgtgtgcatgcgcgtgtgcatacagaggaggtaaaaagtcattgaccagaggagtgggtttgaaaccatttggatcctgccgggttatatccagttaattgaaggaaaaccggaaagggggatttrgttcctgtggaaggccatcctggatttgagctactaaattagtccacatctctctgaagtctgcaacctaatggatgcttgagcatccctgtccttttttaaaagaagcttttttcctcagcaagacattcaaaacctggtcaaggggctgggcrtggtagctcacgcctgtaatcccagtgctttgggaggccaaggcgggtggatcacctgaggtcgggagttcgagaccagcctggctaacagggcaaaaacctgtctctactaaaaatacaaaaactagccgggtgtggtggtgcacacctgtagtcccagctattcggaaggctgaggcaggagaatcacttgaactgggaggcagaagttgcaatgagctgagatcgcaccactgcactctagtctgggtgacagagcgagattctgtctcaaaacaaacaaacaaacaaacaaaactggtcaagggttatattttgttttcaatgctatggtagcaaaaaaaaaaaataaatattttcctgttcaaaaaacttctatgtagcacatgtgtatgcaggctgaagaatttatgaaggttaaacgttttctatcttcagactaccaactggtgctgaaatgaagtgcgtttctagatagtatgaaatcttgatttaccattataaaataatactatgaatataaaatgatttttaattttgccttaaaaataatgctgaattttaaaataataaaactgattttctgtgtgtttaattctaggaagctcttgtagactgctacaaaccaacagaggtaagcaaatcacttttcctaaatgccatgtttgaactggtttttattaaatcaatttgtctatttttaaagcaaaccacaataagtaggtttgagtgtgtgtataccaattagcaattattatccatgagtgcatatgtttgaatagctctaacttcattatttctaagcctaaacatgtctagttcagagatacttaaaattaatggagcagagtgtgttgcttgtgttagataaaagccaaacttcaaaggaaattgtgaaagggtttggaatcattttagtaaaagttttaggtttataactggtttatatattctattggtttattggtatgtwttttttttttttttttttgagacggagtctcgctctgttgcgcaggttggagtgcagtggtgtgatctcggctcactgcaacctccgcctcctgagttcaaccaattctcccgcctcagcctcctgagtagctgggattacagacgtgcgtcaccacgcccggctaatttttgtatttttagtagagacggggtttcaccatgttggccaggctggtctcaaactcctgacctcaggtattcacccrcctcggcctcccaaagtgctgggattacaggtgtgagccaccgcacccggcctatcggtatgtattttttaaaagcgtaaaggcagktctgtctttccaaagagttacctttattgggaaaaaatgttatgctttgtttagatatttatcaagtgtaatgtataaacattatcataaaaatgagcattaatgtgattagactaaagcatttcatgtagactctcatgactgacagcacatagtagaaattaaggttttaatcagttatgaaaatattagcaagagaagtactttcttcctctgataaattggagaaattataagatccgtcagatgttttgaagtctgtttgtaacatcaaagcaatggtgataagacttctgatttttgaagaggtctaattaaaaggggggaggaaagcatgcttttacaagtgtctgatttcaatgacttggtttgggactagttacctatttgagctttatgcttccaacctccagctttgattacatcttgcagtcatagagatttttaattttaattttagccaccaaaatatatacttttagaccaggcttggtggcccacacctgtaatcccaggccaatcacttgagtgcagcagttcaagaccaacctggtcaacatggcgagatctcgtcttttaagaaaaaaaaattggcctgtcgcggtggctcatgcctgtgatcacagcactttggggggccragacgggtggatcacgaggtcaggagatcgaggccatcctggctaacacggtgaaaccccgtctctactaaaaatacaaaaaattagccgggtgtggtggccggtgcctgtagtcctagctactcgggaggctgaggcaggagaatggcgtgaacctgggaggcggagcttgcagtgagccgagattgcgccactgcactccagcctgggcgacagagcgagactccgtctcagaaaaaaaaagaaaaaagaaaacaatattatatgtatatatttaaattaatgtaatactaatacatctgaaccccccccccccaaaaaaaattctgaggcttattttaaaaaggtaacagtgactttctccacctttcaggcccttttcctattttatattatatttatgtattgtatttctatattttcataagcaacacttttgcgcttttggctgtttcccttccctgctatttgctcttttctttctttttttcttttagagacagggtctcattctgtcacccaggctggagtgcagtggtgcaatcataactccctgcagcctcgaactcctgtattcaagcaactctcccacctcagcctcctgagtaactagtactgcagtcgtgcattaccacacccagctaaattatttttatttttttatagagactgggtctcactatgttgcccagacttgtcttgaactcctggcctcaagctrtcctcctgcttcagcctctcaaagtgctggaattacaggcatgagccactatgcctggcctacttattcttttattcttaaatatgcatttactgtttttttttcatttattgactttaggagaaagatgatcactctctctctctccacacaattccttttcatctataccctcatcagttatttaacagtattttgttaaattagtagtcaaggtttataatactatgatttaaacaaatgtttttcactgttaagctaacagtaaatatgatcatggttcctttttgtatagccctttgtttctcttggagttgacaatccttgcctttattattattattattattattttgagacagggtctcgctctgtcacctaggctggagtgcagtggtacaatcttggctcaccgcaacctctgccccccaggttcaagtgattcttgtgcttcagcctcctgagtagctgggattactaagcccagctaatttttgtatttttagtagagatggggttttgccatgttggccaggctggtctcaaactcctggccccaagtgatccacctgccttggcctcccaaagtgctgggattacaggcgtgagycactgtgcccggccataacgcttgtctttggttttgtctaataccaattggtattttttgttgaactctccagtgtgtttgtcaaacatgtaacatatttcctgactgttcaatcacatcattaccatccctctgcccccagacttttctcctggagcccctatacaacaatctggagaagtttttctttgtgtttatgttttaaattattctactctctgcattgtctctgttttctctgaatcttacctttttctgcctattttcatgtctttgctgatttttggtagcatagtcacattttaatatggggagacagtaaactgatttgcatttgtgtgtataagaacggcttgtttttttgttgtttttgaacagagtcttgctctgtcaccccaggctggggtgcagtggcgccatgtaggctcgctgaaaaacctgccttccgggttcaagcgatgctcrtgcctcagcctcctgagtagttgggattataggcatggggcaccatgcctggctaatttttgtatttttagtagaggcggattttgccatgttggccaggctggtctgaaacttctggtttcaagtgatccacccaccttggccttccaaagtgctgggattataagcaagagccaccgcgcccggccaagactgtttggctattgctgggtctcactatggagtgaccaagttgcaagccagatttttcttctgaatctgttatgtgtggaaggggatggctcctcaaaaatgtcaatgtttggttctttttctctggagattcaggatttttagagtttgaccctcaaattccctatgtgagggttgacggtctgactttaggctttctggaagcagagaggagaaggcaggagactttaccatttagctgtttggggactaaagcttctttatttataggtagttggggaattaatataggaaagcgattttaaattgtgtgatgggttagacaagaaaaatagaattgtagtcaagaaaaatgatgaatgaygtagatgaatgaacatgtaatatgggagtggaaggggttgctgcagagaggaggccccattggtcgctgcagacacgcattcactaatttcatcaatccctttttcttcagttctccacctaagtgaagaaattcatgctttggttatttgggtgagagagtttggacttgcagatttctcttttgcctggcttcgcagccaacagtgaaatgcagtaaaagcactgcattttctcatggaaatgagcccgttctctccctaggttttataatgtctagggaaccaatatttacactagttaggagccatgctgttcaatgaaaatggtgggtcttgcctccagagcaaaaatatttctcatctggtttctatacggagggtcaggagatgaaagaatgtattatttgaacactcttcagagttccaaaagcagaaaaaggagctggagtctctaactgaacatccctgtgttctttttttagctcccatttctaggaatggagaaatgatgtaaaatgctgaggaatttcattcaagttcacttatctgttaacgggtcatttcaaaaaggctggacacttttgcctttgagcatatgatcacaggaaacagattttactggcatctggattgtgataatgacaattaatagcttatatttttccagagctctgtagttcacattgcactaacatacattactttatttaatcctcacaattgtcactttaagtagacagggtttgggtagcttgcccgtaatgtcagagcagtgagcaagagagtcaggactcaacccgagtttctgacacctgatcttgtgctctttctttccaatctgccagtcttcctaagctacttgactcagcaagaggcttagaactttataggactttgccctgtctgaactaaatgcctatcaattaatggtgttcttttctaagcagggatctctagaggtgctgttattgatcaaaattattttacttaaaattgttatgccacttggaagttagaaatgtgaggaagatgtctttgctgattcagatacttttattttataatccctcattgcagaagtagggtgagtggtggaaagaatactggaatttgagtcaaaagtcttatgccaatgctagcactaactgtgtgacttcaagcaatgttctcaacctctctgagtctccctttcctcctctataaaatggaggtaataataaccatgtctctgcatattggtaaggattatttgctgtgataatttttaaaatttattttattttaattttttttgagaaagagtctcactgtgttgcccaggctgcagcgtggtggcacaatcttagctcactgcagcctcaatctcctgggctcaagcgatcctcctgcctcagccccccgggtagctgagacaacaggtgcacaccaccacactcagctaatttttgttatttttgtagagacaaagtttctccatgttgcccaggctagtctcaaactcccgagctccagcagtccacctgcctgggcctcccaaagtgctgggattacaggtatgagccgccaagcctgacccacaatgataattttagtggtggtaacgatagcaatgataatggctaaaagatcactaggcacttagcagatgccgggtgctgatctagtcacatctcatgtattaacagatttaatcttttttttcagaaaaatcttgacatttgttaaattcttcatagcttttaaaagataattttaagtagactttattatttagagcagttttaggttcacagtgaaattgactagaaggtacagatttccaatatgctcactcccatccacctcacacatgtacacagcctccccaattrtcaccatctcctcacagagaggtacatttgttagaactggtgaacctacattaacacatcattatcgcccgaagtccacggttaacattaggattyactcttggtactgtacattatggatttgactgatttcataatgacatgtatccaccactacagcatcatacagagtagtgtcactgccctaacaatcctccgtgctctgcctgttcatctctccttccccactcacccctggcaaycactgatctctttattgtctccatagttttacctttctcagaatgtcatatctttggaattaaccgtatatagcctttctattttcagaatagccatagcatgaacatttgaagccttttcaaactggctttttttttttttttttttttttttktggtggggtcttgctttgtctctcaggctggaatgcagtggcacgatctctgctcactgcaacctctgccttccaggttcaagtgattctcctacctcagtctcagtagctgggattacaggcgcgtgccaccacacccggctaatttttgtgtttttactagagactgggtttcaccatgttggcaaggctggtcttgagctcctgacctcaggtgatgtgcccacctcagactcccaaagtgctgggattacaggcattagccaccatgcccagcccaaaatggcttttaaaaaatgtgatgtcaacatttagcagctacagactggcttcttttccttagtaatatgcayttaagtttgctccaggtcttttcaytgcttgatagctcatttcttttcagtgctgaataatattctattatctggatgtaccagagtttatccattcattcacctactgaaatactcttggttgcttccaagttttggcaattaatgaataaagctgctataaacattcctgagcaggtttttgtgtgaacataagttctcaagtcttttgggtaaataccaaggagtaggattactgtattgtaagaaaagtgtgtttaggttttgtaagaatctgcttacctgtcttccaaagcagctgtaccattttgcattctcaccagcaaagagagttcttgttgctccacatcctcaccagcatttagtgttgtcattgttctggatttggaccattctaattggtgtgtagtggtatctcattattgttttaatttgcatttctctggtgacgtatgatttggagaaacttttcatatgcttatttgtcatctatataactatagatgttaactatgtctgttaagttttctggtccatcttttaactgggtgtgtttgtttttttttgttgttgaattttaagggttctttgaatattttggataataggcctttatcagacatgttctttgcaatattttctcccagtctgtggcttctcttttaattctcttgacagggtgtttcacaaagcaggaatttttgttttagtgaaatccaccttatcaatgttttctttcacggatcatgccttttgtgttgtatctacaaatcactggaaaacacaagatcatttagatttttctcctacattaccttttgggagatttatagttttgcactttacattaggtccatgtgcgatccatttgagttaatttttgtgaagagtgtaaggtctgggtccaggttcattttttgcacgtggatttccagttgtctcaggatcatttgttgaaaagcctacctttgctcctttgaatgcctttgcttttttgtcaaagatcagttgatatttatgtcagtctgtttctgggtctcttttctattccaattatctacgtgtccattctttcaccaataccacactgtcctgattattgtggcttcaagtatgtcttgaggttggtagtgtgagtcctccacctttatttttgtcctgcaacattgtgttggctgttctgggtcttttgtctttctatataaaccttagaatcagtttattgattttatccacagaacagcttcctgggatttttattgggatttcattgcgtctgtagatcaagttgggaagaactgacatactggccatattgtatcttcctatctatgaacatagaatacctctccaattatttctgtcgagatatcctcaagcttaaagattctttcctcagctgtgtgcagtttactaatgaacccatcaaaggcattatttctgttatagtatttttcatctctagcatttctcttagaatttccatctctctacttacattccccatctgttcttgcatgctgtctactttatctatcggagcccttagcgtattaaacagagttgttttaaatgcctggatggataattccaacattcctgctgtatctgagtggttctaatgcttgctctgtctcttcaaatttttttgccttttactgtgtgttataatttttttttgatatctgaatatgatgaattaggtaaaaggaactgctgtaaatgggccttaagtagtgtggtagtaaggtgtgaggagaggggaagcatccatagtcctgtgattagttctcagtcatatagggagcctgtgtccttgaactgtgaacttcacaagtgcttctcggtcgcccccatgcccctttaggtggaatggatagctagagccagctggagtttggtatttcccttcccccaggtcactcaggctctactaaaaccctgtcaggttaggctctggttagtttctcctcaggacagatcttgttaaataaacttttagactttggggaaaaaaaaagaagaagaaaaagaagaagaacagaatgctccggtgtatttcaaaatggttcctttttatctcgtcctgctggaagttcaggggaatttttctccagtgttcactgtgaggacctgggagaattcttagaggtaagactcgtacaaaggtatgctcctacctctgcccgtgactggatccccatggaatttttatctctaaaacttgtccactctgagactagcaatttgtcaattccagttcaagtttttctactcatcctttggttcccacaaaggttgttccttgtgagtttctcttccaggcagttgtgattttctgtattcacctgtgagtccctctacttcgggggcatttgtttgctcagtgacctcacttcccttgtggatctaaaaagagttgtggatttttgagtttgttcagctttttacttttgttaggatgggatggcaatttccaaacttcttacatacctgactggaaacaggaagtctcatttaatcttcacaacaaagctaatagattgacaccattgttgtcagttaaggaatttgaggcatagaagtgttctgtaatttgcctaaattcacacagttaatgaacggagaagtcaggttatgtattaaagcacatgacataaagcttcacacatattaggcccttagtatgctagttgaatcttattctgtataaagtaatgcttgcctatcacatgttaaatatgcaagaagtccaagtttgccaataatgatattcttggattattrcatttaaagagttgactttaaagaatcttctaatttcccagaagtgatattgtttttggtgtgtcaccttctgtcatmtactttgggtctacggcttcatcctatatgggccactggccaatagggaaaggacttgtgtgcccccattttgattcatattcattyycccccccaaatccatagctgacctgactgattcatattcagtctgcggactcttgtcatgtaaatcttcctgactgctgggaaacacagcagtataattgtgagcacctcactaatgtatgagtgagtgattagtaagaatggtgatttcatttttttccttaagtaaatgccatttctaatgyagtgaatattaaaatagatctgacttacaggtagcaaaaggatgtttccatataatgcaagaggcaaaagtaattttattttggatattacttgtatttgcatgatcagtagtgttagcctagtggacatggtaaaaatcagagatgggggtctggaagcctgctagccagacttaggaggagctkcttctcctttttctcactatctttgcacagtttccaattttgggattacaaaatagaacctccattgtactgggaggatgaacagaaaatgcatttaatgtgggcttgagggcatctgccttaccgtctgttaggggagttgtctagtcaatgagcttttttaaaaaaatctctttttatagctgaagatacctatgccattgctctttgataaacatcaggtttttctttccatgcatttattttttttttgaactagaggttttgatagaacctatcattgtatcaaattatacaatgatatcaaagcctatacattgataggcatccattcatccaggataactaagtccgagagtaggtggcaaaaggcatttctgggttccagtaatctaccaggtaatggaaatgtcatggacacacactggtaccagaaagccatgtgtgatctggtttgtgagtagaaatcgagcagtgttttctaaaaggcaggcctgctctgctgttcttctcatattggcagtaagaaggcagagtttccttctaccatgatttcatggtaactgactttcagactagctttggtgatggccattgtcaatcatttatttagcatttaaactgatcttttaaaatcattgttcagtttatggatacatggaagtacattccttctgcattgagctgtttacagtgtagagagaatataagtggtatttacaatacaggaaaaccatgtgatgactgaaagagacacagcttggtgttttacaatcttttctttattcatttgctcaacaaatgtgtatcgaatatctgtgtgcctgtaactaatctaggaactgagacctggcagggaacttctacatccatttttaaagcaacctcttggaaggccacagtaaactatggtggaaatttaaatgttcaaagaacatttaggaatgaaaggacagaaatgtcaggctgtgagcttattcratggttctctaagttagaaaccaaattgcttgacagaatgtgctttttagggcatctgcacttgctagaggaagcagtcacattattcatttcaatgggtctgagtgtgtgtccataggcagggaactcctttcttatgtcagacccttttcatctggctgtcatggggtttcctcgaaaaagacggcaatcttgggctgggatgaggaacagagcttgaatgctagattggtgagttgaaaagacacctttaaaaagttgtcacgtttagaacaatgtttctgaatagagaaggaattgagaaggacagaccagaatcagatgaaaactacattttagtggctgtagccactggctacaaaagccttataatgttttagtgtcattgggcaggcaagtattaaaggattggggtttattagccagaaacatgtgtrgctttacttaatagcccaaaggattttggtcccattattacaattgctcacatactttcattaggattctatgcaccagacctcatctgccccaggtaaaagagccgtacgtgctggagctggaataggacccacatttgagtccaaatcctatgctctgtcaactcttcactgccttttcctgaatttttatgaattgagcacaagctctactttagaatatttataaagctgattaagatttataaattgaggaaaatcaacccagaaatgttaggtaagcttgctgaagacatgcagtcatgaagcaaaactctgcatttatttcctggacttcattcagcactctttgtaaagttagggaactgtccaaaagactgctgtcacttctggcaccaatcacaagttcacacgtcctcaaaaccaacttcagctttgataatttgcaagaagaattcaaatattttatactcatggttctggtttattacagggaaaggctatagtcaagggaagagacacaggggacagagtccaggaaagtggcaaatgtgaagcttccacttgtctcctccctgtggaatggacagcattctcttagcagtgatgtgtgacaatatgcaggaagtattggcaatctgagaagctaacctgagccygggagtccagagtttttactggggcttaatcacatagacatagttgactacccatgtggctgaccttgtctccagctgataccacatgactcaaagcgtctactctaaatcacatcgttagactatctatcttggcaccgtaccccaagtatacgaagatgcttttttttcaggcagatattctaagggcttagagctcacctctcaggaggtgagggcaggttaaatttttcactatacactcttagaagcaggatgaccatgagatggtgatgataacaataataataatagtgatcagaagaaattagatggcagtrtaggaaaagccacgtgggccttgcttttgggtgccttctttctcttgataattaataattgttatttttataagagacacgatagaggaggcacaagctttaaagggcagtggacccgrttagcattttcaaatgattgactgtgattttatggccttttcttattcattaaactgagaatggccaaccctgtattagaaacagctctacactctcttcctatgcttagacttatctagacaaaagaaagaatataaaataaagacaatgtgacacatgactttaatttctatgtctataacagagatagttataatcaaaagtccccaaaagcccggaaatgggtttcttttatttaggcaaaattcagttatttgtagcaaataatacactccctcattgacaatgaatgagaatcttggtgaagttatttatactttagttcctcagtgattttaaagtcggagattataattttgccaaatttactctattgattatttactgtgactggatgatatatgtgaattttattttacattgcccaaattgaaaatgtaaagattctgagacaccagttagtaagtgaggggagaattaaatgctgtaagattgaatctaggggagggttaatgaactgttctgctgcatacaaatagaggttgggatttgggtaaaaaaataaattagcccaagaacaatggactgaatctataaaatagattaatgggacttcgctcacagtggaacaaattactatttaaaggcagatagtctagaaaataagtggacaaacatcgtgtcagtggttttaagttaaaggagggggaaaaaacaggatgtagttaagaccttcaggaatttatgttgacagaagtcattttaacaacagcagccacaaacccttacccataacagatccataagcctcctttcagataatgaaaaataggatcagttctggtgcgccmtgccagcaaatgaacctctcgaaagataaaaacaacccctgccccccaaaaagaagggggaaattaaatgtgtcagtggtgagtgatggtgggcgagagggcttgctgtggagctgattcatgcctgtaacttccaggagcaaatccccgtgtcacactgagttggggaacaccccaaagctgagctcatcagtactgattcaactgcctgcctgtttgccctcatccaggagttttcagtgtgatttttaaatgcctagctggttctttgggygaggacattttgccatttggaacaatttgcaggtgttatcctcaccttttccaagaggcacacaccacctgcccattttcctcactcatctaaactttgggcatctggaaattcttcccttcccaccacccgcttcacactttgcctgcttcccacccatctgctaatgtcaggctttttggaagaagtgtcgggtagctgcttcacaggaaactcaccatggagttgactcaatttgctgtaagttggcagccagcccccaggcccagggcagatggctcctgtgaatgtgcaccttgaaggaagtaactgatcaggggcacaaagaggaggcaacacgtggggagttgcatggcccatgtggatcccagcctttggaatcctcatctgctgtttctctcccgtccccccaccctctgcgtagggaatggatgggtctttttttgttgttgttgttgtttgtttgtctgtttttggaaaagctgggtgagcatccgcagttcttctgggcaccctttattagagcttgcgtaatgtatacaatcactgccattggtgagactgtttcctgagcagggattttaagcatttcttcttttgtcaggaaatatttccaatccaagggccactgcataatatccatttatctcgtttagctttttaaatggctcaaaatgcttaaaagaaggacataagtataggtaatgcacagaacagggatttgcagtgatactgtagtttccccttttcctacttgccaacgggcccatctttttaaagcagcacattatcatcaatgagaggaacagatgaattactttgaatgactagggaaggctaccagatagttggctgtggtgataattacaaaatgtgtgtccatctgctgctgctggtactggctagagcaggtggggcgctgagggtggaatatgaaagtcatgagccccaagacggactagtgcagggckcagagctcagagtagagggtggccactgtgataccacgcccctgtgacagagccatgtggtagaaactccagggggagagaaaggaccttgtgttttcatggccgctgccgcatcccctccgaaacgtgtttggacttctttctttcttagaagtctctcagcagcatgttgtataaagtcagttttccaagctccctggaaatgttgcttgtctttctattgcctcttcgatgtctcctctgtattagtatgtgtgagtataaaggaacatccaaggcccacccttcccctaatgctctgtgtcttccgtcacaccccaagtctggctagcttccagtgctcgaaggggcatgtctggagccttcatagttcctgggccggttgacactttgtctagttttttcctcactcagttgacatttaaagatttcagtgtctcctctctctttttcttcacttttatgccagagttacaggaattaatcagttcatttgtacaatcctttactctgcaaaactttgagcagctcctcttatttcttatgcactcactatgctaggaagacaaagatgagtaagacttttggaatcatgtgggggtgacaagtatgcacatggattattttgtatgcattgtaactgtgtgaagaatattttgcaaattttctttctcagcttgtgtattttgcccaacattaggtgtcggacacttatccttgttaatacagaaagctgtcgttcattcatttttattactgtatagtatttctttctgttcatacactgtaatgtatttatccattcttctgttgatactcaggctgtattcagtttttcattattatgaacagtggtgcaataaaataactattattggcctgttgccttccttgtgtacaagactttctccaagaatatataagaaatggagttgcttttaaatgtttgcaccagcatgcatgcccaccaacaggatataagaattccctattgaactcatgatttctacacctggtattgctaagtgttaaaaattttgccaactgatgctatttcattgtttcaacaaaatttttcctgactgctagtaaggttgagacattttttttttcctacttgcttattgggtgttcatgtttccttctctgggaatttccattttgaaatctttgcccacttttcttttgagttgttggtgtttttcttgttgatttttaagagttatttatatattctagatgacaatcctttgaccttgatataggttgcaaagttattttcccaaactgtggagcttattttcacttgtgttatcttttgtgtacagaagttttaaattttaattgaagccaaatttattaatgacatctttggcttgtgctttttaaaaaaaggcttgtttaagaaatctttcrtgactgtaaggtcttaaatacagtcttccttgtatttggctttgaaagctttcactttcactttttacacctaggtattcaaaccctcttgaatttgtctttgtatatggtgtaaggtagggatctaattatgttttggcctattgtcccagtcccatttattgggcagtcagttcagtgtaccctcactgctctgtaatccacttctgttgtatgtcaagtttccttataagtagggactacttctggctatttgtctacccctgcattttgtctcaattactagggctttagaataagttcttaataaaggtccaataagtctacaattccttattcaaagtgtcttaactattctygaatatttgtatttgactagaattgcattaaatttataggttaatttggcsagagaagagatctcgatgatgatttgttcaggrcacacaaaaatggacactgtaacttcctgaagggcagggacaggttgtaggaacagatgggtaacagtgagttagttcacttttggtcatttgagactgatctgcccatgggacatctcatggagatctttggtagccccagaaaatgtgggtctggatctcagggtgaaaccagagctaaagatgagatctgagtcactagtgtggctggtaaaagagagtgccccaaggggcctgggaacagagctttggaggccagcatttaatcagcaggtggtgggtgggagtgcaaaaaggggagtgaggaggggcggttagagacccaggtggagaaagtacagcaaatcttcacttcacatcattggtaggttcctggaaactgagattttaaatgaaactacatataaacaaaaccaatttgaccataggctaattgatatacacgagagttaagttcctacggcatatttctggtctcaaaaacatttccaaacttctaaataaagacccccaaacacttctaatattaaacattgaaataaatgtgagctatatagacatttaagaaagactaataaaatcaaatttgataattagtcaccccgtttgtggtgaatctgtgagtgatagtgatcatagtggcagtgggttaaatccaggaacaaatgtgtgcaaagtgaaaattgtaaggagcgcccccctcccatcacatggttccaaaataatcagtaaccagtgtgggagactggccaggcactttcggactgcattgttgattgccatgcctttgagtgatcatcatattctttatgatttttgttttataataatttgtattcatttattttccacccctctttttccagttcagtgtggctagtggctggagctcatcctgacagctcagagcacgcaccaggcaggaaccagccctgcaaaggaaggcaccccattgcagggcatgctcacacctgcacccacattcactcacactggaacgttgtagctatggcagttcacgtaacacacacagctttgggatgtgggaggaagccagaggactggtaaaacactcaggcagacatggggagagtgtgcgaattcccacgcagacagtggctctgtgggggagtctattttttttccccaaccttatgtcaaaacaatgtggaacaaaccaatgttcttggaggccctgctgcagagggaagtaggcaagctccttgaaaaactccccccaaaattgtactgctatacactcactagaatgactaatatgaaaaatactgacaacaccaagtgttgggaaagatgtggaagaactgaaattctcgtaccccactggtgggagtgtaaaatggtacaatcactttagaaaactgtggggaggggggcggtttagaaaaagttgagcatacacattccacaactcagccattgcattactgaatatgggctcaaaagaaacaaacaacaaaaaaaagaccataaaattacttgtgcaatttattcgtaacaactttatttgcaatgacgagaaccccaaacatttatcagcagatgaatggataaacaaatagcagtctagctatacagtagagtactactcagcaatataaaggatcaagccagctgggcatggtggctcatgctgtaatcccagcactttgagaggccaaggcaggcagatcactttaggtcgggagtttgagaccaacctgaccaacatggtgaaaccctgtctctactaaaaatacaaaaattagctgggcatggtggtgcacacctgtagtcccagctactcaggaggctgaggcaagagaatcgcttgaacctgggaggcagaggttgcagtgagctgaaattgcgccactgaactccaacctgggcgacaaagtgagactctgtctcaaaaaaaaaaaaaaaaaaaaaaaaaaaaggaatcaaactgcggacgcacacaatagtatctaatattggtgaatctcagaaatattgagtgaaagaagccaagtaaaaaagaatacataagaggaatgatttcatttacataaaatgcaaactaatttatagtgacagattaactgggtttgggaccagatgagctctaaatgggaataagacatctttggtggtgatggaaatgttttttctttgttgtgttttaataggcaggatctcattttgttgtccatgctggagtgcaggagcacgatcatagctcactgcagcctcgaaatccttgggctcaaatgatcctcctgcctcagtctcctgagtagctaggactataggtgcgcaccaccacacccagccaatgttttaaattttttgtagagatgggatctcgctttattacctgggctggtctcgaattcctggcctcaagtgatccttctgcctcagcctcccaaaatgctgggattgcaggtgtgaggcactgcacccagctgacggaaatgtgctgcatcttgatagtcatggtggtttcctgggtgtaaccaattgtcaccactgatcagtgatacacttgaaatagatgcagtttattgttcttaacttattcctcaatgaagttgataacttaaagagaaaaggaaaaataggggtccttagcagtgtcaagggacctggctgggggcactggacgtgccaatgaggagagtcttgatgattctgagggctgcctgggtagaatttcagtgggcagaaaagtcagcattccacgcactctattcttcctttcctccttcccctcctctttcttctttttttccctgctttgcctccttcttaaattcttcttttctaatttataagacagctagaataggagggagatactgagggctctggagatttttattgtccccttgggaagaggctacgggcagaactggaggaaaaggttcgtcgtactcaggggagaatttccagtctagctgtggacactgacctttgcatgtctttcgtccctcctcccatactggaaaatgaaaggattgttgtgtttatcataacacatttttggtcattttagtttagtttgtaattagactataattacctaacccggttgcttaataataaagacttctcaccccaggcagcatggtgcaaagggaattgtgccctccaccccagggyggtgatcatcccaggtccctttggcctttatattaacctacggtttgaatcttggtctgaccattgagctgctgtgtgacctcagacaaaccgctaaacccttgtgagcctggtttataatacttgtaatgatcaaatgagacagtatgtgaaaataaacagagtggctgtcacatgaaaggtgcccagtaagtatgtgctgtatctgagtccctgacagatactcagtacccgcgagagcacggtactgtgccaagcaaactagaaatgcacacacataggaaagaatagtctcgggtgagtgratgcattaaaaaggtccatgcggtgcattctcagatcccaaaatagtgcccaggactgagatgagaggtaggggcccaggagtttactgaagacaggaccttttcattgttttcygtgagagggtaaaacttcacctgcagtgtgacagcggccacatccaaagactcagaggagccagcatgaggaggaggagctgaaagcggagggargtggttggtgccactgtgtgtgtgtgtgtgtgtgtgtgtktgtgtgtgtgtgtgygygtgtgtgtgtttagccaggagggagctgttgggaaatgccasctaaggaatgttttcaagtgcaattctagcacttcatgatgtgaagaataaatacgatctcctttgtagtcccttgagacgggaggtcgcacagtctgggtggctctggagtggctgattttggtcctgggctgttgctcaggctgtggggaggagcggtcccaggcaggaatctgaggaaggagctacagggactgtggcccttggccaggcaggacggagagcctgctgtggattttctcagcggttagagtctctgttgtctaagctgggaaaactgaccatcactgagggagaaacactggtggaacactgacagcttcctcagaagaaacacatgtgtgctgcgcccagcctgacatccatgccccagcctgagcacccatggtctcacttggtgtcacacaacatacttctcctctgtcttcaatgtcaaacctttcccatggcgaaaatgggcgggggtggggcaggggggatataagctacatttttcttagtgtggtcagagtagcatattctttttttttgttgtttgaaacggagtgttgctctgttacccaggctggagtgcaatggtgtgatctcagctcactgcaacctccacctcctgggttcaagtgattctcctgcttcagcctcyggagtagctgggattacaggcatgtgccaccatgccctgctaattttgtgtttttagtagagacagggtttcaccatattggtcacgatggtctcgaactcccaacctcaggtgatctgcttgcctcggcctcccacagtgctrggattacaggcgtgagccaccatgcctggcccagagtagcatattcttgatttgaatttgtagactggaaagttcagtgtagtctgatgatgatgatgataaygatgatgacagtatcaagcacttgtacagcacttactactctttaagcacttttccaaacatgtaacatacagtaattcatctcatcatttaatccttacagcatccttgaggtgaggtcttattgtcattgctcctatttataggtgaggaaaactgaggcatggagaaaatgattcatttctaagtggtgcagaaggatttgaacccaagtcatctgactctagagtccctctcgtaggcatgtggctacactgcttcttaccatgtgtggtrtgtattgggtgactcctttctggcaggaacaagcccattaggttttttttaggcatctgtttcaaagggttcttctatatttgtaagccaaacctttttcttctgtttctctccttcttgcatcattatacgatccatagtcctcaggacacacggccccagcctcatcacaagcagtacatgcgacaatttgtccacctgctgttctgtccctgcccagggctgagcacaacagcccacagagaatgcttctgctgagaggtagattctaaggtgtggacccaggatctcttaggtagtattttgagacatatttggacaaaagctactgaggcagtgtagaaaatagatactgcttgtcttgaaagctaggtcaaggcaaatgtttgtttgtcttttaaaaattatggcagttagctgaaattgtatttcaactgctaggaaactagaatggccagatcttagaaactggtggagaggcagtcagttaataaaaatttccccggaaggagtgatgggggaaggagagaggagagggtgggaggaaggaaagggagggagctggcccttccagagcagtcatttccggattctgtggcctttcartgaacacagaggtctttcgaggcctctcagagctctggctgccttctccagtctttggctgtgggaggcagcatgggaggagcctgaactggcctgacaggggctgtcctttgcccgcagggcacccgttcacccccagctgcagctcatgccatatgttggcagggcctgtgtttctgtgtcttctttcccagctggcctgggagctcctggaaggcagggcctctgccaccttctgctctgcatctcagcacttgagtagagtctggcatagactcyacttagattagagcatgggctcagtacatacttatcaaattcagttggcatcaagaagcctggattcaaacatttgcttggtgatcgtaggcagtgacttgtaatgaactagaatatcagtatttttgaactgtaaaacctctactacattggattaaatacgggaccatgtaaagaggccacatagaggaggccttcaatcagggtttccttcttttttttttggcggtcgagcgtaagcagtgtcagatccccatacagaaaccacatccaccagggagttcctcattgatcctcacccatcctattagccagggactgaaacttcaaaaaagaatggattccctttttagaatattgcaaaagatcatgtcygttgtggttaaagaattgccttaaataacatatcattttcacttgaatatcctgcaacaggggaacactcgtgttcatcctttctttcagcatgtccaatatacgtacaagttacatgggaggaggctgtataaaggtagtggtgaaacatcagcttggaggcagcctggtttttaataagatgtacacagaacttttatgaagacagacatattctgggacagaaagcaattttcaaatttaaaaagattcaagccatacaaagtgtgttctttgattacagtggaattacattagaaataagtaacagaaagattatctggaaaatctccaaatccttagaaactaaatgacacatttctaacccacagtccaaagaagaaattaaaagggaaattagaagctattttaaactgaatgaaaataaaagcccatcatatcaaaatgtgtgagatgccactaaagcaatgcttagtgctgctgggggtgggggaacatatagcagtaaatgtctgcatcaggaaaggtctcaaagcaatggcctgagcttccaccttaggaaccaggaaaagaagagcaaattaaacccaaagcaaggtggagaaaggaaataataaagataaaagcagaaatcagtgaaatagaaaacagaaaaacatgctgggcacagtgtaattacacgcctgtaatcccagcactttgggaggccaaggcgggtggatcacttggggtcaggagtttaagaccagcctggccaacatggtgaaaccccrtctctacaaaaaatataaaaaattagctgggcgtggtggtgcatgcctgtaatcccagctactcgggaggctgagggaggagaatcacttgaacctgggaggtgaaggttgcagtgagccgagattgtgccactgcactccagcctgggtgacagagtgagactccatctcaaaaaaagaagataaaaaaaagaaaaccaataaagacaatcagtgaaacaaaagccgattatttgaaaaggtcaatacaattgataaacttgtagccataatgataaatggaaataaggagagaagacacattactaacattaggaatgagagaggtgacatcactacagattctatagatattatgcacaagcttgtgccagtaaakccaacaacttagttgaaataggcctgatattgttaccagtggagaatgtccaggttcttcgcgttttgaacaaagaattggacaaaacacacaaagcaatgaaagaatgaagcaatgaaagcacagatttgctgaaacgaaggtacgccccacagastgggagtgggctggagcaagtggctcaagagtgctggttacagaaacctctaggggtttcccattggttacttggttagaccctatgtwaatgaagtagtggcctgcaaccagtctgattggttgcagaaggtgaccaatcagaggctgaagtgaattttcaaagttacacccctgtgcagatgaaggctaggcctgtgaccagtctgattgtttgcgggagaggacctatcagaagtactttccatttttcatctgcaatgcagaaagtgrggagggttggaaagagaacagcctctgatccttttgttacctgagtgtggaaagttagggttttccttttgattcacttctagtcagtctgtgcaaaccagccttagtttccctgcctccagaccctattctcctgccttaacattgtaatataataagaaatacatatttgctctctgctccaggtccttggcacagaactcctaaaactcttacaatttcctgagcaatcagttgctatgtacatcttttgttataatatttcatctttgaccgcagttcttgacccagatctcctaatctgttggaatttcctgggtgataggagtgtcttttgttctaatgaggcatgtcttggtgggcacctaagtgggtgctggtcaccagaaagaccaagccacagttagaaacttggaactttcagccctacccccatcctccaaaaagaggaagggggctggacatagggttaataattgatcatgcctatatgataaagcccacataaaaatccctgaagaactgtggggttcagagagcttctgggttgctgagcatatgtatgtgctgggagaggggcccagagagggcacgagagctccatgctccttccctcaagccctgacctgtgtgtctcttcatctgctgttcatytgtatcctttatcacatcctttattaatgtaataagtaaatataagtgtttccctgagttctgggagttgctctagcaaattattgtaccctcagagagggtcatgagaacctcaattcatagctggtcagccagaagtataggttgacaacctggaacctagaattggcatctgaagctggagtcaggcttgtgggcctgagactttaacccgtagcatctaactctaacgccagctccaggtaaatagtgtcagaatcagccaggcacagtggctcacgcttgtaatctcagcattttgggaggccraggtgggcggatcacttgaggccaggagttcgagaccagcctagccaacatggcgaaaccccatctctactaaaaatacaaaaattagctgggcatggtggcacatgcttgtaatcccagctacttaggaagctgaggcacaagaatcgcttgaacccgggaggcggaggttgcaatgagccragatcatgccattgcactccagcctgggtgacagagtgagactcttgtctcaaaagaaaaaaaaagtgtcagaattgaattgaatcgtaggacactctgttgatgtcttctggagaattacttgatatgtggggaaaccccccacccacattttggtgacatgaggtattctgtgttgagtgtgggagtaggaaagagagttttgtttttgctgtctcatacaggaaaatttcttaataggtataacctttcaaaacctcccctcaaacacacaacaaaacaaaacaaaacaaaacaacaacaacaacaacaaaaaccctctaggcccagatggcttcagtggggaattttaccagacatttaagaaagaaattctaccaactctacataaactcttccagaaacttgaaaaggaaggaatacttcccaactcatgctatgaagctggcaataccctgatactaaagataaagatattacaagaaaagaaatgtacagacaagtattgaattcaacaatatgtaaaaaagccattatgatcaagtgtggtttatcccaggaatgcaagattagtttaacattcgaaaatcaatgtaattcaccactttaaaaaactaggagggggaaaaacccctctaatcatgtcagtaatggaaaagcattaggcaaaacccagcctctattgctgatacaaacagcacactagaaatagaagtgagcctccttaagttgataaaaaatatctgcaaaaaacctacaggtaacatacttgctggtgaaggactgaatgcttccccctaagatcagtaacatggtcagggtattcactttcaccacttttattcaacacagtattgcagcttttagccagtacagttaggccaaaaagaaatacaaggcttctaaataggaagaagtaaaattgtttttattgatagacaatgtgactgtgtagaaaattcaatagaatctacaaaaaaatctcctagaactaatatgagttcagcaagcttgcaggatacaagataaatatatgaaaatctattgtatttctctataccagcaacaattggaaataaaaatatactgtttacaataacatcaacaatattaaataggaatatatctgacaaaagatgaacaatatttgtacactggaaattataaaccattgctgagataagttagttcttaactgagagtagagataaatcatgtccatgggtgagaggattcattagtgttgagatgtcagttctycccaaattgatctacagatttaaggcaatctcagtcaaaaccccaacagggaaatttacaagctgattctaaaattcctttttttttttttttttttgagatggagtctcactctgtcacccaggccggagtgcaatggcacaatcttggctcactgcaacctccgcctcccgggttcaagcaattctcctgcctcagcctcctgagaagctgggattacaggcacctgccaccatgcctggctaatttttgtatttttttagtagagacagggtttcaccatgttgtccaggcgggtcttraactcctgacctcaggcgattgaaccacctcrgcctcccaaartgttgggattacaggcatgagccacggcacccagccctaaagctcttaaggaaatttaaaggacctagaatagccaaaacaattttgagaaagatcaacaaagttggcagactaacattacctgatttcaggatttactataaataaatctgtactttttaagacaatatggtatgggtataaacatagacaaataaatagatcagtgattcagccattccactcagagatatttacacaaaagaaatggaagcatattccatacaaagatttgtacatgaatgttttaaacaactttatttataatagccccaaactggaaacaacccacatttctaycaacaggtggatggataaattgtggtacatctttatgatggatgctactcagcaacagaaaaggaatgaactattaatccatgcagcagtgtagctgaatctccaaataatagtgcagagtgaaagaagccacactaaaaagtacagtgttatgattccatttatgtaaaactctggagaaggaaaactaatctggagtgacagaaaacaggtcaattttttcctgggaatgggaggagggagattgcacagaagcatgaagaagaaacttytggaggtgttggatgtttccatgatgttagatcatgcagatagtatgcttgtggttgttgtctgccttaaatacgttcagcttatggcatttcaattatgccttaataaagctgctaaaaaaaaaaaaactcactgggaaccttgtagcctctttcccaaccattctactcaaacttctstcatctaagacacactggccctttcttgcccgatccattatatttgtctctgtccttgatttacttaacttctcattgcacttgacttaggtgagcacctctttctgctagaaacacttttccttcttggcttctgaacagcacattctcttgggtttttcccctagctcttgtggctccaagtcctctagcaaacctcatttgttagggtcacctttgaccctatcttcctctctatttatactctactcagctccaacgttatcccacctagtcctgcaatttaaagcagcagcatctgtacatcccaacagaattttctgggataatagaaagagtccctatcggcattgtccacatggcagccactagccatctgtggctatggagtacttgaaatgtggctagcgtgactaacaaatgaatttcaaattttatttattttatttaatttcaatttaaatagccacatatggttagtggctaccgtattgaatagtccaggtctagatcactgtatgtttacaaactgtgggtgggaacacatttgctggtcttgacttttattttttcagaataaaataaattctatttttcacaaaatatttgtttcaggctggtatctccagggctcacacatagttgtttttttggtttggttttgtatgtaagttgaaaggcactgatctagatgccagtaatgtccatgttaatgttttcaaccatgagctgaggcccaaagtcatatttgtcatcctgacatctcatcacaaatctgtaagcctggtgtttttccctccagttttcccacacctcagcaaatggcactatcttttcctccagttgatgcggaacagtgaccttaattttctgctttcctgttccccctccccgccacaccctactcccacactcagtccagcagcaaggtctactggctctgcctcctaaatgggtcccgggtctacccacttgtttccatctgggtttctatcaacatactctaagcccatggcatctcttgcctggagtactgctgtagctttaaactggtctgtgattcactgttatcttcataagacccacagtggccaaaggaatcttccaaagccataaatcagatgctgctgctgccctactccagagcctccaagagctttccaccgtgatgctctgttgtcaccttactgtgcctatgaggccctggtgactgggcccagccctccgccacagtcaccctgtccattctgtgccagggacttccacttccttgcttatttatcttcagggctctgcacatgtgctgtgacctaggcccgccagatcttcccaagatggcccctctctgttaattcgtcttaactcagaggtgatttcctcaaaggagcagcacttctctgactaaatcagtgtctgtaacccaagttggagtgatagtattttaggagtaaatgagatacattgttactgaaatagagtgcttttgagtaataggagccaagagccatcaaagtattcttgactagagatccttgaattttctttgcaaatcatctgtaatcaacaaaatccttctgtgcaagtgatactgccaagtttctgtatggagaataaatattggtcttgctattttttaacttactcgactgagcaccccattatgcaaatttaatgagcagtttaaaatatgcatattatgcacaacatagtgtattaagatatagatgtataaattatgttaatataaaatttaaaatgagagtatttcattaatgtgaatatatcatatgcacaaggcaaatagcatttatttaaactttttaatctctgaaatttatgtacatcatggttagctttgtgagaaagtttgaatttgatttaggttaccaaatttgatttcaattatccaaatttaaatttgattgtcatgaagagaaagggtctgtagggtcgattattccttatgtaattttagtctttacttttgaaaatgtgttattaaaatagtgcagaaaaattaccagttattaacaaaataaattatagggtttgtgatttttgacctttgctttaaaaaaaaaacaagcttacattcaaatactgaaactttttgtagtagtcatatgcataacagattccaaaaacaacaraattgaaactgtatgtgcagaatactatgtattggttaaaccacataacacaggaggcaataggaaatgcatttacatttgcaaaatgaaaattgaatataaataggaaaatgtggcatgattttatcctagaaaattatttaaatcagaatagacagtgttcagaaaattaaaataaggcctccattttacttcacttgtatttcattctgtacaagttcagaaatggtggtgattaaaatatttaagtcactttacattcttctgggatagctctccaaagggaataatccaagctacagacaaaaatttatgtacaaagacattagttatggcattttttataattttgaaaagtcaggagccatccaaatatccagtggtgggaggaattaagcagattgtataacatccttacaaaaagattatataaccactaacattaatttttaggaagattgtttaatgtgggaaaaagcatctgacataatgctaggtgaagaaaaaggatatatttatatggtatgatcttaattaggtgaaaacaatatattttcttcaatatccatagaagaaaatatattaatagcagttaattctgaggactgcattgttgctggttgtattttccaggttttctagaaaaaacacatattacttttataatagggaaaagattattcataaaataaattttggtgctaatataatattaaatatttagggttactgtgctttatagccagagagtagtgcagggctcatttagtctgggagctcatgagtgaggattataattgataagggagattgagagctgtttttcagatggctccatggacagcaaagttcctcggtgtttttgctctcagatagtccctgatgtgctcagttctgtcacttactgactgtcgcttgctgatcagaaagtctgattggctgttagctttgtatttgacaaatataaaacaggaagaccaggtagttgttacctaataaatatgacttatctggtggccaaacattttaaaacaggaggcaacaatgagagattcctgattgtgtaaagtgggaaccattctggatcatttttcagtctttaggttctgatcgatttacaggtcatgaaatccttttagtgagtcttccctagcattactttgtaaatgaaattagagtagaatagaaataccagagtgcatggcatgtagtaagtatcctgtaagttttaatttcagatgtgtgtttgtaggtaccggattgtaacataaagtgtgtttttgttttggtgtggtttttttatctatagtttgctgtcaaaaaacttcaaagactcttagtgtgatctacaccagtggtgtgcagtattctccagtgataagtagcatcagtgtcacctgggagcttgtcagaaatgtaccttattgggccccacccagatctactgaatcacaaacactagtggtgggtcccagcactgtgtggtccttaatgagtccctgtcttagtagtcaattttctgttgctgtaagagaatatcacaggctgggtattttattataatagaggtttatttagctcacagttctggaggctgggaagtccaagagcatggcactggcatctggagagggcctttttgctgcgtcatgtcatggtggaggttgtcacatggtgagaggacaagtgtgtgccagctcaggactttcttcttcttataaagtcaccagtcccatcttgggggccctactctgatgaccttatctaatccgaactacctcccaaaggccctacctccaaatgccatcaacatattaatttgaggattaagtttccaatacatgaaatttggaggacacattcaaaccgtagcagtccccctggtgattctgatgcacactcaaatttgaggcacactagtccagccttgccattcttggtgaggttcaaggactaacactggcatcacctgtgagctagttggaaatgcagaatctcagaccccaacctggacaggctcactcagaatctgtgagatcaccagttaatttatttgcatggtaatgttaaatagctctgatctcaacacaaatgcctcaggggccaagtaggtcatgtcagtagtgaaagtagcctggtttcccccgtaaagaaagtagaacaataagaaggcattgtggtgtgaagttttagtattcttgatttgtttttaaaaatcctgtattataccagtgggggttaacacattcaaccaaattcatcaactaaggttaactgcagttgacatcaattactttaagcagatttttaaacasagaattttaatagtgaccctcatattaacttcttctgatctcttttaggaatttatcaaagagctgctttctcggataagaggcatgaggaaactgagccctccgcagaagaagagtgtatgattctggaacagggtgaaactctcccagagaygaagaaagagtcctgggatttgtacttcatgaagacttttgtgaaagaataggtgtccttatgaacaacktttttktttttttttttttcttttttggtgtgaaggtgggggggtctattagacatttattcaagagcgttctttttttggttttaaaggtttttgttaatgtaatattttaatagcaaagatatcatgactctagccacagcctaaccaaggattatcaaaggaggtggacactcaaggaagggccacgccaggctgcgtttcctgcaaggactcagatgttcagtaccttatgatacagggaagatagttttcttacaagtagtttggtaatattttttttcttaagttgtayatttgactcagctgtcaaatttctcacacttgtatatatctacacacaactaagttaaaatgttgatgtgagttttatttcacatggatggaataaacttgtggttgtcctttaactggaggtcccagcacatgtgttttcaagaggccactaggcattcttcactgagtgctgctgacttcaacgttcactttatgcaccaaagtgaaagaattcagtgtatccgttattttaatgcactacaccacagaaatgttaagttggtcaagggcttaatttatggaatttctattatttcattggttgggatgctttgccaggtcatgtgcttattgtctcattttgtagtcttttaaagttgtatgaacccttaatttgaagaactaacttgatttctagagaaatatccacactatctcagtggtattttgcattggaaaaaggaagcactgtgtagcagtgaattgtctgctttccaccgagtactgtgtttattctctctccaggaaagcagrtcaaaagaaagttagcagatcgagtgtcttcttccttagaaataggttctggtagcttctgtgcctgggtagyatcagaccagtgggagtaaaccgagtgttaagtgtcaaggtgagaaagcctcacattctctcaagacagttgctctaggagctgagttgctggtttggaagtgtggagattgcatttctggcttctctcaatggcttgtgttgaggactctgggtgctcctggccctaattgtgcaccctgatccccgtgcttggagctaggcctggtggcgtgctctagccctctcagttaccagctctttggagaaggatcaaaattcagatggaatgtgggatgggtaataggtgagagtagaaacccttccctccaggaggcccccgctgmctcccacagaaacccacctaccataagatgtcttcaggtggccttgtccaaggatgggggtcaggcattttatatcaagggtgctctgaacatattttattttttaaaaaaactatgtttgtgaattttgcgtatactggcaagcttttgaaaatgtatttaattttgtattgtttaccaatgatttatttacaagatatttactcaaataaatggagctgcttacaagcctgttgacatgtgtggcttgcacaacacgttaacatgatggttttgctgtgtcagtttctctgcagaggtgaggaccaagcacctcacctcgtttcatttcattttcaaggatttctaggcatgtaatcctggccctctcctcaggcatcttcagatcaggtggtgaaagcaaaggagctgggccacattcttgggctgagaaagaagacgagctctgtgtgctcagcctggcactgtcctaggccatgctcctttcatttaattaaaactcctctttgccatcttacaagaaccctcaaaaacatttcaaattagtaaactattccacttgttagaatgccttgcaccatggaagtcggaaaaatacagaatgggcaggatttctgttaggcttaattgaccagcccatgtgatggtctcagatgaagtaagaattgacttttcctccaaaggcctctgctcccaccacacacttcctccccaccttccctcctgccctgatccccgtgagtgcttcagcaagaagtttgggcctcttccttgactccccagtatgctcccagtcacccagcttgtcctctgtgaatacttctcaaacctatcccatgtccaactttcctggattgctgccaccaccttgggaacagattctccatgtccaggcttgtctccctctgatccatcctccacccagttgctagaatagtctgacgactccaccccctgcttgaaacccgaaccctctgcatgccttatgagaaatgttgtctctgcctctcccacctcatcttttggccttgtgctcatgcccagttctgccaaattccttggagtttctggcgtgttctatgtattttcttctctggtgctttgtaaaatctgttgccttggcccagaacgccccctctgccaacaggctgtatccagagagctgggttagaccccctcctaggtgtgttccccctcagctccagcctatactctgtcatagacgcatccacagtatcattattgcctatccatttgttggtgtcttctgttagaatctgggatcctcgaggctgggaatctagacttcaccaagcatctggtcctaggcttggcccatcaaagagattgtgtgtttgccagttgaatgaaaatgacaaaagattcaagaaaactccactgttttcttcccagctagagttgtggttcttagatctgagtgtacatttgaatcactgggaagctttaaaaacaatggaagcctaggcctcagtcaattctgaccagttaaatcagcgtctccaggacaagagctggggtgtttgttttcaagctctccagcttgcgcatcgctgggccattgggtcactcttgtgccattggatggccagatgcattagcctgacctcagctctccatgtttatgctattacagcaggtggcagctgtggtattagcacactcactatttctcatacagagtcttctcactagggcaatggctccaaattatccaacttctagtgccgcgctcacttgaacattgggaaatctcaatgtaaacttcatggagtggcttccatttataacgatcataataaaagcactgtgctaagtgcatgctttatctcatttaatcctgaccttaaccttatgaggcaggtggcattctcattttacagataagaaaataaactcaggcttagcagcttacctaagtccacacagctacaacactgagattcaaacccaaacctatttggctccaaagtcccataaccattagactttcttgccactcttagggaattactcttagtcccactcacaagagtgaaccccagaagccacatttaaagtgagccaggtccctgagctggcagggtaggggaggaggccttgtggatggaggagatcccagccacctgtggggctcttcctcactcctgggaactgagggactccctgctccccatctgcagtgcagccaggccctgtgatgctggccctccttatccagagtcctcttgccttttccccataacataaagctcctggacttgggcttagcagctgagcaaggagtatccagccatcagtttcctgagaaagagcagctcaggacaaggtgattttcaattcctgaaacacaggaattaaacaggtttttacttatttatcactgacatagtttggatatttgtcctctccaaatcccattttgaaatttgatctccagtgttggaggtgagaggtgtttgggtcatgggggcagacccctcatgaatggcttggtgccattctcctgggattgagtgagtacttactcttagttccctctagatctggttgttaaaaagagcctggcacctcctcccctctctgtcttacgtcctctcttgccatgtaacaagccggctctccttctgccgtgattggaaacttctgaggtcctcaccaaaagaagatgctggtgccatgcttcctatacagtctgcagaagcacgagccaaataaacctcttttctgtataaattgcctgccctcaagtacttctttatagtaacacaaacagcctaagacaatcacctaaagtctccataaaagattgtgtgctgtgcaaaatcagcttttggaaacctaagctgtttttgacatgactgctgtttagcaagagagtggcaggtccacagctactggacacatccccatccctactcagccaccctatttttgcctctgagtgaaaggttctggggcttccctctgcttcctgggaacctttcctggaatctagccactttgagagtgagcctgtgtagtcatgagtcatatctgtccctctatggcccctatctacttcctttgactcttgtctttgggtgctcagagtcaaggagtcagcacgcttcagtgctgctgcatagcctaagagagaagtgctgtgggtggcagggacccttgtctgttgtctaagaaaacaaaactcctatcgggtagttggaactttctgaaagccattttcaaattggacacaagcataccactattttcccctactggtttctctttgcttgaattaattttaacccaaatagtcctggagaattattcctcagaactagtctcatttccttgagggcttggggtacaacccactgtgtgtttgtaatttgcctgtgaaaatggagtggcttctcagtcttctatgagtgagaaagaacagtgcaggcttcatggagttcccacccaaccccactcagaaacaaatgctggaaatgcttcactaatagccttcttgtgcggccatgaaggccaaccagttctctcttgctgactggaacatcttgcctggggatggattgttcttttaagactggattgttctctgcctcccgtgtctctgtgggtgttcccatcacaacacattagcagacatttcaataagactgatactagaacagctacaaacgaagtccttgagaaacctgcttttctgttgttttattgagtcaattggataaataagggcagattagtgtctggtgtgtgttttcttcatgctcagtctccttggtggggtgtaaatgaaactagcggggtgggcttctttgggctcaccttgttccagtggattctaggaggtaattagttccagcaagcacagggggtaaagaagagtgcattctaaacataggcgctgtatagacttaattgtaattcagtgttcaagttgttaggagacatttctacatggttctcatgtttctgcatgtcttgtgagtgagactgcctttgttccagacccttttttcaagaacgtttatatgtatagcaaacagtcttggaagttagagatagtgtctccatgcagagcaaagctgtctattataaaagatatgggttccctaagtgtcgagcccctttcctgggatgcgacccactgcatgcacrggcgtcatctgtccttctttgcaacaccctaggagaactggggctcgagaagtgccactactctagccactgctattgctgtaactgtccttcctctctgactcaggaatgtagcatcttctaccagcatctatgaaactgacaggctaatttgttagcttacagtaatgtaaaaccttagaccctatacaagtcttgacaatggtcagttgtcttggtctctttcaataggacttgaatcatttttgtcattaatagacattttcttatatttagactctgattgattaatcattttcaaatgcatagggtcggaagtttcctttaaagagatttcatgcctggaagtggttgttctgtggaaggaatttaatttcacaaaagccaccttttcttttcctcgttgttggtaacgtgaagcgaatgttgcctggggtgaaaagactcatgaaagagagatggagagatggactgtcctgggagtttacagcaaaattacccagtagagtgaggcagagaagacaagcaaagattcttgcctcgaatctttctgtttaaaatatgtatctacataatatgagtggtgcatcatcactggcaattttgaaattccccagttaatctctagaagcagttttgtgaacttacttgcagtatcacggcccacccagtggttaccaaaaatagaaattgaagtcagggaatatctgaggctaccagattgattctattcaggtcgctaaatgattcacataaagtgtaacccaacacaccctccgggtcacaagatgcttgagggtgagtgatttactatttggttttctgttattagtagcacaaaattactcctttggtgttgattagatttttaaaagggaacatttctaactcagacctcctttctgatagctcatggataagggacaaataagcttatttgtcttttcttaaatatccttctacagcacttagggtagcaccttgctctttttggctgtaatctcaacatggggaatcagtatgtgtaatctatagtgtttcatcctcacggaataccccagagccatagagaatcacctctttctgtaattggtaatgagagaattaaccaaaacctctcaaactgatttaaaaaaaatgcatagtttttttttctcctaatcttattttctatctgaaacatctgtgcttatttgagagctgggaaactcgctacttaaatctttaatctaggatgtcttaaaattatagttcatgtggacttagtgaggtcctcataatctctgaaactgtgtaggagatggaacttagaaaggagagacagattgaggtgagccacacatagagcaacagagagagatggtgatcccaagacaggatgctggaatgaagagagccagagagtagcagacaggcatgagcatgtgtgggagggtccatgccacattggggtctcaaagtgtccatacctcgaacaggtgaagagccaggacccagagccttggagcccaggcccacaggagactgcagccacccagggagccagggctcgggtgtcccaggaatagccagggtcaagctctgcctcccatcctcaggctcagccttcaccttgatcggatttcctggtctccttcattcccacatcatccactctgctgaattccttccatagatgatcacttctccccaggacaccgccccagcagcaagtaacagcctgcctggcagcgagccttgcacgggcccatccccacccgctcacaggcacacactggcttgttcaggaggtgggttccagctctcttcttcctccctgcactccatgttgggttgcttcgcctgtgggttctcatgcttacaagcccttggtgtaactttgcctccaacccgttcagcatcacgtcaacttcaattgccaatgccctaacccactcccttatgcttccatcatcttgtttaggctatcagacaaacaaattaagacagacatgtgaatactgccatgcaatacagagcaatggatgggaggaaagtccatattttgtcgtcttatctccaggaagaaatgaaggcgggaagagtaa

SEQ ID NO: 12192 - DNA, 46143 bp, Homo sapiens
tggcatgtgcctgtagtcccagctacttgggaggctgaggcaggagaatagcttgaacccagtgggtggaggctgcagtgagtcgacactgtgccactgcgctccagcctgggtggcagcagtgaaaccctgtctcaaaaaaaaaaaaagtctcttacactagaaaaatggtactaacttttgccagaaacatatgtgtaccctttggggaaaaagggtcctagaaaattaatgtaaccaagcttatatttctctatttcaacaactgatgctattggcttaagctaagactatacacagaaatagtatccaggtcattgaattagagtccaattaataaataagaatggtcttctaccatgccaccaccctcatcagcccagcaagaaagactttccttgtcttcaacaaggaagaccttgttgattgcttcttagaaccctcccatccgactacataatataaatgtgatcctggaaatgtgagtccctttgaccccacacctgactcatattagccttaggtcctatgaagataatttggtaaactttgggtcttattgagatagctggttgggcgcggtgactcacacctgtagtcccagcactttgggaggctgaagtaggtggatcacttgaagtcaggagttcgagaccagcctagccaacacaatgaaaccccgtctctactaaaaatacaaaagaaatagcctgacatgttggagcatgcctataatcccagctactcaggaggctgaagcacgataattacttgaacccaagaggcagagattgcagtgaactgagatcacgccactgcactccagcctgggtgacagagacaacatctaaaaaaaaaaaaagagagagagagctaggatcaaggggagtctatttccctgtcagagttctaattacctgttatccctttaaatagctcagggctctccctgttgtcatttggcatataaaaatgttgcccagatttgtagatattcatctgggactagatatgaaatacactcactttaagaaacagaagaagacatcaccacatccaagtgggaagataggatttttattctctatattagttgggacttttttggttttgagtgagataaacaactcaaaatgtcctaaacacaatagcaagtttattggctcatatgactgagaattccagaaggtagacccagctgtaggcagtgctgggtccagagacttgctggaaccctctccatcactgggctctgcttttctttgtgttggtttcactctaaggccctatgtgatactttccacagcccttggatcacacagtcctttctgctagaagtcccagtaaaaagagacatcctcctttgcaatattctagacaaagtcttgggtgggtgtgactctcagactctcattggattgaatttctgtctgtgcccactcctgagcaaaagactgtaacctaaaggccaggcatggtggctcatgcctgtaattccagcaatttaggaggccaaagtgggtggatcacctgaagttaggagtttgagaccagcctggccaacatggtgaaaccctgtctctactaaaaaaaaaaaaagaaaaaaaagaaattatccgggtgtggtggtgtgcacatgtagtcccagctacttgggaggctgaggcaggagaatcacttgaacccaggaggcggagattgcagtgagccgagatagcaccactgcattgcagcctggacgacaaagcgagattccatctcaaaaaaaaaaaaaaagactataacctgagtgacaagataagctgatttgctagagccagagatgggggtcaacctaagttgaaccacatgaatgaggatggggggtgtggataggattgaatggttctccaaaggaaattcagggatgtctctagaataaaaagaatggatattggcagaaaaacaagcaaatggcttctacaccattgctctcgacaagcaagtctaaaatcttagtatttagggggcaatgtaagtctcatctatattgctttttcctaagtggaccagaagtgtttttttgaaaacaaagggaaatgttggttcacttgttttaaggtttcttcctcacttacagccacatgatctgagaatttcccatttaccagtagtggtgaatctcttcagtcatatttgttttacccattcctaccctcacagtgttagctgattggaccaggaatgaatacacctgagccaaagaaactagctcattggcaggccagtggccaatcaaatttatcttcaggactcatgagactaagacaggctttgaaaattcaagaaagcccacaaaatcctctgccaggcgcactgacttacacctgtaatcccagcactttgagaggccaatgcgggtggactgcttgagcccaggagttcgaaaccagcctgggcaatatagaaagacctccatctctacaaaacccacaaaatgtatctgggtgtggcagtgcatgcctatgttcccagctactctggaggctgagggggaagtatcacttgggcccaggaggtggaggttgcagtgagccgagatcgcaccactgcactccagcctgggtgacaaagccagaccctgtctcaagtaaaaataaaaataaaaaaagaccacaaaatcctcctcctgagagatccagacctttcctggttcccattctcctgagaccctctgtgtttctttggattctgtaaaggagccctgcctgcatccatttaataatttattgattctgcttgagctaatttgagtctgtttctgttgcctgaaaccaaatgactttgctaaggctaggttcggtcatagtcatatgcaaggatggcacggaggccagtgaaggtgaagcagaatatgcgagtgtgagtaggaagagacgagggcagagggacaacagggtcagatgatggagggccttgcagatgaccataaggattttggctttcattataaatgaagcaagaagccactgaatgggtttaaatagagaaatggcatgatctaaccttaattcaataagaatctctttgactggcttattgacaagaggctgtggagggcagaattagcaagattagtgaggagcctatggcaatgattcgggtgagagacaatgatcaattagagcatggtggtggccccagaggtggggagaagtagattctaggtatattttataaatctgaacactgatgcttcaagaaggagaggacgttgcctatggtcttatgatgacaggagtggtttagaggcaataccactctgtactgaagaatcagatggtgttggtcataggagtgtacacatttaccaaaactccttgacttgtacattttgggccaggtgcagtggctcatgcctgcaatcataacactttgagaggccaaggcaggcaaatttcttgaggccaggagttcaagaccagcctgggcaacatagtgaaattccatctccacaaaaataaaaaattagccaggcatggtggcacagacctctagtcctagctactattttgtaatctgaggcaggaggattgcttgagcccaggagttggaggctgcagtgagctatgatcacaccactgcattccaccctgggtgacagagcaaaaccttgcctcaaaaacaaacaaacaaaaaaattgtgcgtttcactgtatataaattttaacttgaatctagcctaattccatgcctataatgccagcactttgggaggctgagatgggtagatcccttgaactcgggagttcaagaccagccttgcaaacatggtgaaaccccttctctaccaaaaaaaaaaaaaaaaaaaaattagttgggtatcggtggcatgcacctggggtcccagctacttgggaggctgaggtgggaggatccttggagccacaggaagttgagactgcagtaagccatgatcatgccactacattccagcctgggtgacagagcaagaccctgtctcaaaataaataaataaataaataatttaaaagacaaaaagaagaaaaagctggctttattttgcagtgagaatataactgtgtattgtcattcaaaacaaacatagaatttgaacagtgtgtgtttcaaaatcccattatatatgtatgtgtatatatataaaactaatatgtgtgtgtggacacacacacatacacacacaccaaataataaccaaactgttagccatgcttatttggggaggggggggcacagtttattgttttaattctttgcaatgagcatatattgttagaagaagcagctgagattttttagaggattttctttaaatttctctccaataatgctggacctgtttccatccacctgggcaaaccgcccttggaccagcaaccaaggcatctcctaggaatttggaaattcggactcttaagacccactccacccctatcgagtcagaatctgcattttaacaacatccataggtgattgtaaccacattcaaatctgagaagctctaggtaagaacagatcctttcctctctctgggcttcagtttctccccggcacaaaggggctgtgtctctatggtccctcccaattgcagttttctaatctcgtttcttgtagttatctgagtccctataaaaaggcagctgaagctaggaaaggtggcttacctctgtaattccagctatttgagacgctgaagtgggaggctcgcttgagcccagtagttggcagctacagtgagctatgattgcagcactgcactccagccaaggtgacagagggagaccctgttaaaaaaagaaagagagaaatagaggaaagaaagaaagaaaaagaaagaaagaaagaaagaaaggaagaaagaaaaaggagggagggagggaggaaggaaggaagggagagagagaaagaagaaagagggagggaggaaggaaggaaggcaagcaagcaagaaagagaaaggaaggaaggaaggaaggaaggaaggaaggaaggaaggaaggaaggaaggaaggtgggcgggcgggaaggcaggcaggcaggcaaggaaggaaggaggaaagaaaggaaagaaagagagaaagagaaagaaggacaggccaggcgcggtggctcacacctgtaatcccagcactttgggaggccaagacgcgtggatcacctgaggtcagtagtttgagaccagcctggccaacatggtgaaaccgcgtctctactaaaaacacaaaaattaatccgggcatggtggcgcgcgcctgtaaccccagctacttgggaggctgaggcaggagaattgcttgaacccgggaggcggaggttgtagtgagctgagatagcgtcattgcactccagactgggcgacagagcgagactccgtcaaaaaaaaaaaaaaagaaggaaagaggaaaagaaagaagaaggaaggaggaaataacgaaagaaagagaaagaagcagctgaaaaggtcaaaggatgagtggcctggctgaacagcccctgctgcctacagccggacgctggtgggcactgaagctgcaggtctggagggagtccgaggagcgaggctgcgtgggattactgctggtgctagggcaggcacctgccatctggacgggagtggaaggaagtcgcggggcagtaatagggggcagcaggcgctttgaggcgccttggggtaagtgccgcagagacccagcgggaatgcaggatggcagggcggcctcggggcggcagcaggcactgcgcggtggcccaggaagacgcagcgcggccgggctggggcgcagggcggcttcggggcgccagggggcgttgtgaagtcgtggcccgctccgggcggtctcaggtgcctggcggcctggggaaagcacctgggcaggtgggggcggggcctggggaggcgggtccctagggggcggggcctggccggcccacaagagcccgcggtggcgctgccaggggatgctagcccgagagcgagcagaggagcagcgcacccgcacgagccttggaccctttggaaccgaaaggtgagttcagccgggttgggtcggaccagctcgggggttctgggcactggagcggatgccgrgcgccagggcgtcggacgccgtcagcgcggtgggtggccgagccagcatcagcsrgtggcggcttcccggtgcccgggatgctgggacaccttgcccgggcggtagcggccagctctcccgggtctacccacgccgtggcccggagcacgaagccagtcgagagccactcagagtccgggggtctgggggtcccgggccacacctggcctcttttctccgcccagcgcctgttcagcccccttccctgccggggtgagtcgcgtggacctgtccgctactgttccttctaccctctggaatgctttctccggggtgacttggtgcagaaagaagcaaacacttgaagtgggctggttggattcgctccagcgccttcagccggcgctcccccggggcagacgtggcttccgccacaggacagcgcccgctcgctccgcgcagggagggcagggctgcggggtcgctcggcaggagctcgggtcagggccctgaggttgagttcaagtgatttctgcacaggactcgcccttcgggacgggcactgatcgggaactctccggtccagcgaacccaacgctagacttggggcaaatctctcatccctctccaagctttggggtcctgcactgtgggatgggggacaggcaaagtcggtggtaggtgaggagggggtgcacggagccgctgcgatgagccagggccctggaattctaaagaatccttcaaatcctttctacctgtgtggtcttgggcaaattacctaacctctgtgcctcagtttccttctctgtgaaatgggccaagtaatagcacctcatataactagtgaggattaaatcaggtagtgtgtgaaaaggactgagtgggatgcctgggagtacagaaagggatcaataagtgatagctgccattattgctgctttccctgctgctgttattattattaatgattgaagagcagcctagttagtcgttaaagggactcctaggtgcaaatcccagctcagccactttctagtgtgaccttgggcaagctacttaacctgtcagcgtctgtttcatttgtacaatggaggtggttgtgatacctacctcagacgattatcgtgaaaattaaatgaggtgacagctgcaaagtacttagaagagtaagtgctgggtatcagctagtaattcttccaccaagggtatcacattggctcaggctgcataatctaatggtagctacagtcttgttttgctttgaagttgaaatattatttatatgaatattttatctgttttgcaaagagcaagatcagttcccttccttcacttgggggctcctctgacattgtcgactgatccattggggtcaaggtcggttctggggaaggggctgatggggcagaggtacccctgagagctggggataggagcttccagaatcacagcttctgttgaacaytcacagaggagggctgcagttttatttgacaagcaattgaacctggacctagattttaaaaacaaactctygctaatttttttctttctttccttcttctttatttcattttttatttttttggattgtagtgagggaggaggtaaggataggcaatattttaagtgataaaaaaataaattatattcctcttgcccagaggctactagcatcattttgatggtgttcttcatcccagcaaaatcatatcaatctatggagggtttagagcagtttgkctgctctggacatctcacctccatgcccagcactccatttcctttccatctgaggccttaaacccactmgcatcataagcttggaagcctcctagctttgccccagcttccaattttagcccatatttcatgggttcagggtgggaaaaaaagacataactctgcaggttccgaatactgcctaaaaatcttgatggggcacrtcgaagtcacagacaygggtcctctctggtcctggggaccaccctgtatgccctaggatatgtcctaatttgcctttgtcactgtagaaggcataggacgacacagttttcatatatcccccacccccaatactagtgctcacaagtcttgggaagtggtcatgtgcactgttcagagtttggaaattaaatagctgtgttccttctctttcctcctacctttagttcttggtattgttaattaactccctgcacccagcgtactaccaggcccctcaaaggcgtatgccatagcggtgaaggctgcagggttccatccagctcctccactaaccagctgcatcatcttacacaagatattcaacctctctgagcccatttttctcctctgtaacatggatataataatagcatgcctacttcatggaattattgaaacacaaaaggaaatatatgtaggctaygtgtatatttatagagagagacaaatttacttatgagactaatgagactatatattataaacatgaaatgagtttttatgtagtatattagttcatttctaaaattatttctcattgtaaagtttgtatagttgagatgcatcgtgyacattgatgaatgtgataatttgccttccaatactggtactctcccccaaagctgttattaaatcaagggcattctctaaattaatggtatcttagaatcaaggaaatatggcacaatgcctggcaaacactaagtggccaatagttgcaggttattgttacatcaggtgatctagaaacattaagagcttgactgtaaagagaagaaacaaaagagaaatcgtttcacttataataaagcctcagagaaaaggctggggaaaatgcagccaggaacatgatctaaggtggctgccgggaaattttcttggcagatttcatctgtcagttacaatctgccgagcactgctctgtgccagacactgtgctaggaaccrgggggcataatgagataggaatgctgcccttgaggaaggcgggctactggaggtgataaggcacgggtacccctgcctgataagagagctgatggggctgcttccagagttcctgcccaggaacccggggaaaggtcctgcagcctgtccagccagcgcttcgcaggttgcacctcacccagccccygcacggctaggcctgggggccgtaagagaagtaggcagcttctctggcagctgtggtggccaaaaacaaacgtcccgtggaaaaggggccaaggattcagaatgcaaagtgcctaagccacagaggaacagaggaaggaggtctctaagggcgcatggactggtgtttcccaractgtggtctccagggacacactagccggctagtgcctgccagctcacctgcttctcttctttgcccctscagcacgcccgtcctcrgagtcccgtcctcaaagtcccatcctcgccatggcacccggagagaagatcaaagccaaaatcaagaagaatctgcccgtgacgggccctcaggcgccgaccattaaagagctgatgcggtggtactgcctcaacaccaacacccatggctgtcgccgcatcgtggtgtcccgckgccgtctgcgccgcctcctctggatcgggttcacactgactgccgtggccctcatcctctggcagtgcgccctcctcgtcttctccttctatactgtctcagtttccatcaaagtccacttccggaagctggattttcctgcagtcaccatctgcaacatcaacccctacaagtaagaggcatgagcagggaaacgcgagtagggagccaggccccccacagaggccaaagcccctcccgaaagtgacacactggcagcctggaggtcgattccagcctacaaatgtgctttctagaaatttgaatttgttgctaacgctggtaaacagccccctccccagttctaaatctgtatgtaccaagttttcagaccatcagtgacttgttttttttcttttctttttccttttttgagatggagtttcgctcttgttgcccaggctgggatgcartggtgcgatctcggctcactgcaacctccacctcccaggttctaacaatcctcccgagtagctgggactacaggggtgtaccacagcgccaggctaatttttttgtgtttttagtagagacaggatttcaccatgcttggccaggctggtcttgaactcctgacctcaggtgatccacccgccttggcctcccaaagtgcttggattacaggtgtgagccacagtacctggccttttcttttttttttttttttttttggaggcagggtctcactttgtcacccaagctggagtgcagtggtgcaattatagctccctgcagccccgacctcctgggctcaagcaattctcctactgcagcctcctgagtagctgggactataggcacatgccaccacatccagctaaaattttttattttttaagagatggggtctcgctatgttactcaggctggtctcaaactcctgagctcaagtggtgctgccactttggtctctcaaagtgctgagattacaggagtgaaccaccacacccactccatcaatgacttctgaggatgggctagcccagagagagcagaaagaggaagctgcaggatttgtttcacttagaagaggcctggaacgaactaaccccctctgcacactccccatatcaagcccaaattagccaacccccatctgcatctgcacccctggctctccragctcacatgttcactctgcctgcagcataagtgagctcaaggctgactcagaagtgacacccaggtgacttctgtaagcacctcagctgccccaaaccctcatctgaataaacccagccccattaattgagctcatcgggccctgggtgtgatcagcccttgggactgccctatcatcctcggcaggacctgttctaaatgggtcatcagagtccttctcaggattatggaaaactggtccgtgaggcaggtcagaatcaggcagactttgtcagagcaggggtggggagaagggaagaagaacaggggagaaagattatcaaacgaaactaacttgtccagaatcrtcagtgagttggtgcaaagctcaaaatcaagatcaagtctaagactctctctccgccctccatgtcttcctcttctttctttctccctccctccttctctctctctctctggtcctccttccttctttccatccattatttgttccataataatttactcagcatctataaactgtcatgcactgtactaggttctgggatagagaactgaacaacccaaacacagtatttgccctagtggagcttatactgtagtggaggaataaagtcttaataaatataataacactaatataactaacaatagaggcacagtggctcatgcctgaaatctcagcactttcagaagccaaggcatgaggattgcttgaggccaggaattcgagaccagcctgggcaacagagcaaggccccctctctaaaaatattttattttaaattagccaggtgtgatggcacacattcatagtcccagcaacttaggaggctgaagtgggaggattgcttgagcccaggagttctaggctgcagggaaccatgattgcaccactgcactccagcctgggcaacagagtgagaccctgtctctaaaataataacaataatagagggcatttaattatctatatgtatgtctgtgtgtgtttattatatttaataaactcattgaaccttcccagcaaatcccgttttacaaaggagaatgctaaaacacagagaggctaagacatttgtccaaggtcaggtagccagtaccaggatggggaacctaaactcaggtaatttggctaaacccaggggtttctattctcaattgctatgctctgctgcctatgcctagagcaagtgggagaaaggagagwggagagagttaagaggaggctggaaccatttgatttgtgaaaattaaaagatggtatattgtgcttcacgcaggcaactcctttataactattttgtgttcttgggggtcatcgaggtaacagttataccctccttccccccagcacagatttgaggacaatcagtgggcagaggcagagtgagctgggtggagaaggagcctgcccattaggtagactcctggttggcagttatttacttgtcctcactgtggctggtttatgggaggcacctgacagtcaccactacagaaatgctggttgggacaaacttgtcaacacaccctgagggcaagcagacagtggtggcagaggtgaagccacaggaagtcacacatgggtcacccatgagcctttccccatttgccagagccaggggtcactttggatgggtcaagtcatgaaaggcgtggtctcctctgccaaggagttgggaaaggtgggcaygaggctgacacgtgttgatggaaaacagcctggaggagcaccagagttctgccagggccgcctcccctctccctgacttttcctccccaccttggcaggtacagcaccgttcgccaccttctagctgacttggaacaggagaccagagaggccctgaagtccctgtayggctttccagagtcccggaagcgccgagaggcggagtcctggaactccgtctcagagggaaagcagcctagattctcccaccggatyccgctgctgatctttgatcaggatgagaagggcaaggccagggacttcttcacagggaggaagcggaaagtcrgyggtagcatcattcacaaggcttcaaatgtcatgcacatcragtccaagcaagtggtgggattccaactggtaagatttcaccttctcattctttcactgcttaggggcatgggatgggctgggtccaggactcttctccttgaccactagcccctgtggtccaactggaagaaayacacccagctggggtcagacacagtgactcatgcttgtaatcccagcgctttgggaggccaaggcgggcgaatcacctgaggtcaggagttcgagaccagcctggccaacgtggtaaaacccatctccactaaaatacaaaaattagctgggcatggtggcacatgcctgtaatctcagctacttgggaagctgaggcaagagaattgcttgaacccgggaggtggaggttgcagtgagcccagatggtgccactgcactccagcctgagtgacagaatgagactctgttaaaaaaaaaaaggggagagttggggggcaaacggagggagagcattaggacaaatacctaatgcatgcggggcttaaaacctaggtgactggttgataggtgcggcaaaccaccatggtacatgtatacctttgtaacaaacctgcatgttctgcacatgtatcccagcacttaaagtaaaattattttttaaaaaaagaaagaaagagagaaagaaagaaaagaaaggaaagaaaggaaagacacccagctgggatgattcagctgcaaacaactgaaactgattcaggtaattttaagtagtggggggcagagtgggggtaaatgtattagaaggcaaccagtaactcatggaggcctctcaaagggcagaaattagggcagatgcagggatctgggtagcaagaaatgatgaaaagtcatttcagatattgctgctggagtaaagaagcatcaaatatgttcagtttttgttggtgttgttaatgcttaagagtcaaattccatcttgggactatctggttggtcaagcttgggtcacctaatcaccctttggctaatggatggtggagtatcttcatggacaatctcaccaggctgtatccagagggggaaaggaaattcttccaaagcaaaattgaggtgcaggcacccaaaagaaaaagacggacaataaacagcagaaacatcaatattcgtgcagtacttgccttcatgaggtgcttggcttgacttcattttcccttttggtcccatttgaggggattttttttttttttttttttttttttttttgagacagagtctcattctgtcacccacgctggagtgcagtggtgtgatctcggctcactgcaacttctacctcccgggttcaagtgattctcctgcctcagcctcctgagtagctgggattacaggcatgcaccaccatgcttggctaagtttttgtatctttagtaaagactgggtttcaccatgttggtcaggctggtctcgaaccctcsacctcaggtggtccccctaccttggcctcccaaactgctgagattacaggcgtgagccaccgcacctggcctgaggggctcttgagaaatgccattcactgaaaatgaattctagtaccttcctgggcaaactctatcaccactctccctctccatgccccagccacctctggaggacaggggctatgtccataccttataggcttgattgccaattgtgtgaccttgtagctatagtcccaaatcctgaaaaatggaccttcttctaaatcattgagatttcaaagtcttcttgggtcctttcatgggatatctgcaaggctcttcttgataccaaaatcaactctttatatagatgtttgtttgtttgttttaraaacaagatttcactctgtcactcaggtgggagtggtgcaatcatagctcactgcagcctakaactcctgggctcaaacaattttcccacctcagcctcccaagtagcttggactacaagaatgcatcaccacacctggataatttttctattttttatggagatggggtttagcygtgttgcccgggctggtctcgaattcctggcctcaatcagtcttcccactacaaccttccaaagyattaggattacaggcatgagccactgcaaccagccaaaatcagttgacatctgtccatttagaaaagtttccaagctttgtgtgataagaacatttggaatgtataatggcttctctataaagttctcattgtatatttcaaacatgggtcctcccagctaccacacgtggttgggaaggatggtgtttcagtcaacattttgtgggtgagataatgggcacagaataccttgcctgagatcctgcagagaagtagtctctccccctcctgcagagtctgggctggaatccagatgtcttgacttttgatatgataggaaatgggaaaggttgttaggaacgtagtagcatcaatcggatgaaacctaggtgcctagggaccctgaagagctggttttgcttcttccttggtgggcaagtagtgcagagttgcaggagtaggactctgtgtcctttctcactcagcccctttttggtccttgaggcttgaggatgatcactcccaacccctagaagtgagaggaaacccatccttgccccagatatccaacctgttcccctgagtatctggcctggagtctcagtcactcattcttatggtccttctgaagagtagcgataggaccgatggcttcagcctcgcatctcctcttattcacagtgctcaaatgacacctccgactgtgccacctacaccttcagctcgggaatcaatgccattcaggagtggtataagctacactacatgaacatcatggcacaggtgcctctggagaagaaaatcaacatgagctattctgctgaggagctgctggtgacctgcttctttgatggagtgtcctgtgatgccaggtcaggagagaatgctgctctctcagcctctaaggactggcagctctgagtaccaggccccttgcaggaacctacagccttgatgataggtcttgggagcaaaaggtgctcttctcactgatgctgccttttggaaactgcttacatgggagctgtgttctagagtcagtgagtgaggtatacatgacataaaatcaaaatatccttaaactcattaaactactcattaaaaacaaggtagttggccaggcatggtggttcacgcctctaaatcccagcactttgggaggctggggtgggtggatcacttgaggctaggagttcaagaccagcctggctaacatagcgagaccccgtctctactaaaaatacaaaacttagccaggcatggtggtgcatgcctgtagtcccagctattcaggagactgaggcagaagaatcgyttgaacccgggaggcggaggttgcaataagccaagattgcactactgcactcaagcctgggctgcagagtgagactcttgtctcaaaaaaaaaaaaaaaaaaaaaaaaaaaacccaacccacaaggtattagattggcacaaaagtaattgctgtttttgtcatatggtgtgcctataacctaaccttgtatattaccatcatgcatactgatgactaagaaccatcgttctaaggaaggaaggaagagatggagggagggatgggaggagaaaggcccatgttcaaatatgtgagatttcaaacctttcacctttatgataacactcagatcccttatagtgactgagcagtgggtgagacattctaaagtgttcctgggctgggcacagtggctcacgcttgtaatgccagcactttgggaggctgaggaagatgattgcttgagctcaggagttcgagaccagcctgggcaatgtggcaaaacctcctttctacaaaaaaaattcaaaaacttatctgggcataatggcacacacctgtagtcccagctactcaggaggctgaggtgggaagattgcttgagtctgggaggttgaggctgcagtgagccataattgcgccactgcacttcagcctgggcaaaagagcaagaccctatctcagaaataaaaatacaatacaatacaatamaataaaacactaagcctctttcacctatctgtatatgttagcagacagattggttcttgtgaaaagtaaataactggaatcatgtctccctaagagttgggttccaaagtcatgtaagggcacagatgatgccctggggattattttctaggactgagaattttaatggaaaatgtcaagtgttggctgagaaattcaaaagtggaggaatttggggacagacatggcacaaagaatgtcaagtcaggatagagatgaaggtgagaagattccgagagaaaacagaaggcagagagtctagttctatgtccatgtgtgtcaaccaggatgaggggccttgtttgtcatttgatcaggagcaagatggggaaaatgagtcacatctctcacacattctccccaaagagagttggctccattagcactgccctgcccaacttcagctaagatgcatgggggagatccctttctgacccattttcttcctccataggaatttcacgcttttccaccacccgatgcatgggaattgctatactttcaacaacagagaaaatgagaccattctcagcacctccatggggggcagcgaatatggtaaggaaacctgtgccaaggagatcttgaggccctccaatagtggacatgggggcagcagsacagtggggatgcgggagccctctggaaaagcgggatctctcccacttggccagaaaccagggatgcccctttttctatcagtgtttccatcagtgttcatgctggttccttccttccaagttagtgtttgttttcctttttgacttttcttccatctttgagagagcgacagggacatcactggggttccttctgctagggaactactctggtttaaactcatagctagggtgagtaatgcaggacaggtggtttccaaagggagttgagcccagatatgctgaacagattagggaagtagacgcacatttatcttagttcaggtgacagattctggacggagccgaaacccagcttggccactcactgtgtgaccttgggcaagttactgcgcttcgtctataaagcgggactaataatagtatctcccatgtgagattactgacaggacttaagatacagacttagaataagacctgctctgcactctgttagtctgcttggaccgccataacaaaataccagagactgggtgccttggacagtagacatttatttatcacagttttggagactagaaagtctaagatcaaggcacaggcagactcggttctggtgaggcttctctcttwgggttgcagaaggctggctgtcttctctccatgtcctcagatggcctttcctctgtggtgtgtcaacagagagaggcctgtgatgtctcttcctcttctgatcaggacatcaatcctatcagattagagccccctgcttgtgacttcctttcaccttaattaaagtcctatctcaaaataatatccctttgggggttagggcttcaacatatgaatttgaggcagaaaacaattcagccataacacataccaagcacacaataagtgctagttgctattgttattactgctattattaccgttactagcattgctacsagtctaccaccattgctgctgctgctactaccctcaaaataataccactgcaatttccagcactactattccactatgattacatttctagggaaggtaggaactgaacagattggcctggcttatgcccaaaaggaattcttgaaaggtcccatgcaaattgaaaatgatgtgatatgtagatatactcgcaccaggacaagggagggcctgtcataaaggaaatccacacttggaatcctggcctttgtccctgtgtagtctgtgctcttactaagtctgcaagaaatcataattcagtgcacatattccatggggaagaagtaatctggaaactgaaagtgaaaagttgcagagtactggctctgctatggaggggctgtgtgacctcaagcaattcacttcccctctctgggctttgtttgtaattgtttacaacttatttacaaattgtttgcaattgtttacaagttgtttacacattgtttgcaattgtttacaatcgtttgcaattgtttaccaattctttgcaattgtttacaaattgcccttgtttacaaattgaatgtcagaataactctcaaaattctcttctttccatccatatagaccctgctgattcactcatccacttaccaagcatggagtttctcctgtttgccaggccctcttctacgtaccagggacacagcagtgaaaagatagatgtcttctctgctgttaggaaacttacattttcgtggggagagagagatgaaaaatgagtacacaactacacagacatgatctagttacaaatcctaaagactgctattcagggaagaaagaggcagagtaggaagacagagtggctggggtcaggatgggggggttagtttggataagaaggcccagaaagatctctaagaggagggctatttaaggagcaaaagattcatgttaaggtctacacaagaacattccagggactagcaagggcaaaggccctgggaaggatgtgaatcagatgtgttctagaaacagaaataagaccagtgtgcttggagcttattgaggtggggagacagtgggaggagatgaggagggagaagtaggcagggctgtatcatcatcaccttgatagatgcagccaggtttattctgtggcattcccatatatccagtgagatgccactgaagagtttcaggtttcagggagtgacctggcctgaggtccaattttcaaaggacctcagcccatacatgaatgagcagggtctctacggatggaaagaagagaattttgagagttatactgacattcaatttgtaaacaagggcaattggtaaacaattgcaaatgatttgtaaacaattgcaaacaatttgtaaataagcccagagaggggaagtgaattgctggaggtcacagccgatccatggcagagccaggactctgcaacttttcactcttagttcccatgtgcactgatactgtgtttactctggtgctgtgtccgcatagacttcagggggcaagagcaggagtgggaggagaagttgggccagtgatgagaaacaccattagtgattcatctcttctctgagtgcccaccctgaggggttaagcagccggagcaatgcatcttcttttgaatgttccgagctccccatctcaaaggaccacatggagattcatgtctcaggcagagtggcaatttccttacacttggcaaaaacgtatgcttggcaagaactgtgacagtaatactgtgtttgaacccctgttttgggctaagctgtgggggcacagcagagagcaagtcaggcatgcattccaatctcacrgagcttccagtctagccctcgtccacctgtcacttgctagaaatacctggtcttgggtttgaagctcctgaagcagtgggagaggtggtttacccccaggaaatgttttcctagccttggatcacagcaggttgtcttatcctcccagggctgcaagtcattttgtacataaacgaagaggaatacaacccattcctcgtgtcctccactggagctaaggtgatcatccatcggcaggatgagtatcccttcgtcgaagatgtgggaacagagattgagacagcaatggtcacctctataggaatgcacctggtaagagaatattctcatttccataggcttggagagaacagatctttttttttccaaggataaccaatggggtgcagcttatggaaaagggtgtttgtttcaaaagggaacatggtcccagattttcccatggttatcccattcatttcaggagttacattaaaggttgtgtttgtatcttctggccggctgcagtggctcacacctgtaatcctagcacttcaggagaccgaggtgaggtcaagagtttgagaccagcctagccaacttggtgaaacctgtctctactaaaaatacaaaaaattagttgggtatggtagtgtgtgcctgtaataccagttactagggaggctgaggcaagagaatagcttgaacccaggaggaggaggttgcagtgggccgagatcacgccactgcactccagccgagcaacagagcaagactccatctcaaaaaaaaaaaaggttgtatttgtatggattaataggacagggtgccatttggggagagaatttcaagacaccagcatttatggaacctatgctggaagcaaggcattaggacactaactatatatttgtcagtaatacaaacagataagattaccgtctatctttctgggctgcttagaggcctatgaggcatgtcaataactgtattaaagcctagtggaaagtcactcagctatccaaagtctatttagcccattacactcctgtcaattttacctcatttaccaagaaccccttctccctccaaatttgacctttgtggacctcattgggcactgagaacatgcaaacctatcaacagaagcacaagtaagccgcagactccaatccccgagtcagccttgcccaatgggagctgaatggcaagatgaagagtggactctgatggccttggtcactccactgcttatggagttttcttgtttgcaggcctggggtctttttattccagtatctatctgcctctccctttctctctttcatagaatgactgttaagaacttatttagaccgggcacagtggctcatgcctataatcccagcactttggaaggccaaggtgggtggatcacttgagcccagaagtttgagaccagcctgggcaacatagcaaaaccccatctctaccaaaaacgaaatacaaaaaaaatcaccaggcatggtggcacaggcctgtagtcccagctactcaggaggctgaggtaggaggatcacctgacctcagggaggtcgaggcttcagtgagccatgattgtaccattgcactccagtctcggtgacagagtaagactctgtctcaaaaacaaacaaacaaacaaaaactgatttaaaggagttaggtgcagtgcatagacttgtagtcccagccactcaggaggctgaagtgggacgatcacttgagctcaggagttcaagaccagcctgggcaacatagcaagaccccatctctacaaaaaatataaaattagccaggcatgctggggcacacctgtagtcccagctttgcaggaggctgagtggggaggagtgcttgagcccaggagttcaagacccagcttgggcaacatagtgagaccctgcctctattttttttttaagaacttatttaaagagagtgtccacaccaaccataccaaggagtgtaccaagcagagtgtatctctcttccactcccgacatccagacttctccttcctctccagagggaccaccactgttgctactgtgtcttggcagggatattctagtcattcaagcaagtgcatataggtataagcatttctccttttatgcaaatacaaaatatttctcacttaatgctatagctgggaaatggttccatatcaaaacatatagatctgcatcattcttttaaaagattcatagtcttccattgcgtgaataagttattgatgcaaccccccattgatagacattaggtcatttcaggcacaactaaaagcaatggtgcaatgtgacgtgtatttgcccagttacttcctagaagtttgtcaaacaggacatgtgtttgccagattgtcccccaatgaggatatagcaattgagaaccmcmccagcaatatgagagtagctatttccccacactctaaccaacataatgtattaatgtttaatctttgctaatctgtcaagagaaaaatggtatctgttatcattttaatttcattctttcataatgatgtttttcttttcttttcttttctttttttttttttttttttttttttgagacagagtgtcactctgtcacccaggctggagtgcagtggcatgatcttggcttactgcaagctccacatcccaggttcatgccactctcctgcctcagcctcccgagtagctgggactacagtcacccgccaccacgcctggctaattttttgtatttttagtagagacagggtttcactgtgttagccaggatggtctcgatctcctgaccttgtgatccgcccgcctcagcctcccgaagtgctgggattacaggcgtgagccacagcgcctggcccataatgacgtttttctttacctgtttrtgggtggggagaaagaaacaaaatctccttgtggactatacatttgttcatgcctttatttaaatccaaccttaatatccccaattaaacttcctagcttttatccttcacaaacatatcctccagagaagtggtttccaaacctggttgattatcagactcaaagccaytgaatcagaatctctagaagatgagcccaaggatctatatttttaccaagttgtagtggttattctaagaggcagcacccttgggagtcttggcttgacctttttttaatgtttaaatttaaaaaatttttagagtcaggttcttgctctgtcacccaggctggagtgcagtgacacaatcatagctcactggagccttgaactcctgagagccttggctttagagcaatgcagaattagaggaaaagctaattgtgtcttcccaagtaaaagtgaagctagaatgacacaaagttctagctatagctttgcattgggttacataaaaagatggtgggcaattagggcttggatatccgcctgtcatttatccattcaattgacattttctgagcaccttctatgtgctagacatgggrcacctcagtgtggaggacaccgtccctgtcctgagagagtctagagtccagsagagaggattgagtaataaaccagaaataatacaaatgattcattataattgccataastgctatgaagaagaaatgtaagaccatatgagtgcatattatgacacgactgacctggggctcattttcaatggggaagatgaggttcaaggaaggctttcctgaggaggtgctatttaagctgagacagcgagatgatgaaccggaatggaagtatgacagatgaaatstggggcttcactgcctcatggtgccccatgaaaaggacaacactggacaagggaaaccatcaaaatggtctttctgggcccccagatgctctcaggaggcatgttacttaggggctttgttccagcatgggagggaagtaatgtgtatcagcttgagctgtgtgaatgaaaaaggaaaaactatctcgaaccctcaatctgctcaaactgtgacttgaaaagacttttttaagagatagccacttaagcagctgggcaactcattcttttgttcactggcagatggcaaaacctcagagcacaatggtgagcattttggtcagacatgtcccacacacttttatctgcaccctgaagtaggatccaggatttgcagcgcatccttcccttatcctttcgccctcttcccccttttcaaactggtgtaagttactagagcttgtaaaagtataagaactaaggaattctgctctcttgttttcttgctctgagcttggaaatacccaccacattgttaagcaaatgttctctttaccagtagtgggtaaacaaagacatgagtgagttttctgctacacctaatttaagatgtagaaaatcaaagccacagagcagggtcagtcagctctaggtctgatttatgagcatttagaacaacaacaacaaaaaaaaacagggtttatgaagaggtcagcagagtgtcactaagaaaaactccaaccaaactagacttccttcctttcttcttttctgattttatttatgtattgattgattaataggtgtgtgaagctggtaggctcagtcaggctggccaggcagttggtaaacaaaacttcctttattcactgagagattgtgtgtccaaagcactgaatattaaaaggtgaacccaacagagctcctaccttcaaagttcctaactttcagaggggaagacaaaagtttgtttgcttttttaaagacaaggtcttgctctgtcatccagctggagtgcagtggtgtgatgacagctcgcagatcacagcaacctcgaccacctggggtcatgggattctcctgcctcagccttccaagtagctgggaccataggcacatgccaccatatctggctaatttttacatttttgtagagatgggggtctcgctatgttgctcagactggtctcaaacccctggcctcaaacagtcctcccatcttggcttcccaaagtgctgggattatagatgtgagccaccacacctgaccaaagacaaaagtaagcacaactttgcaatacagtttccatctctgtggaaacagaccttttctgcctggttccaaagcttacttcttagaacataacagatcctcagtaaatattgatagatgacagatggatgggtgggtgggtgggtggatggatggatggatggatggatggatggatggatggatggatggataggtgagtgggtagatgggtaggtggatggatggctggctggctgaatggatagataggtgagtgggtgcgtgggtaggtgcatggatggatggatgcccagacagaagctactggagaaggctttctaaataatggatttagaaggacaagtgcaggcaaatagtcaagaagagccagtccagacaaagaatgtagcaattacagaggagtcacaaaaaggagtttatttaagctgtgtagagaaacttttcaaaaaatcattttagtggaagtacaatcagtacactggagacagcacatttgtagtaattctagaaagaaatgatgtggacctcagctgaggcaatggctgtggagatgagcagaggaaatagatttcacggatattatagcacagaagcaacaggacttgacagccaatgttagccagaagggccgggggaagttagattgatatttaggtcctggcttgggcagggagatggaggaatgccaggctcagaattagagaatccaagggcagggtatgtttttgggagaagatgaccacttcgatttgggacagacccaatttgttatgcctttgagaagtcaaggtgaaaagaaagcattcattagatgctatggacctggagttaaggagaaaaccttggggggtaattgtagacatggaaataaatgccatcacccaagacctgagacagaamcctaaacatgcaaatgtttaagggctgagcagaaagtaaaaggagaaagagaggcagataagtaggaacagaagccagaaagagttggcatcagataaatcaaggaagagaattttacagaaggtgtgaccaaataagcaagtacagtcgagaggtcaggcaaggtagaaggcaaaagtattctctggttttggcagccaagaggtcaccagtgttctatgccagagttgttttcagtggaaggagtggaacagaaaccgaagtgcagtgggtcgaatggtgaatggaaaatgaagaagtggacgtgggtggaccactcacccagtggggttggggaccaggccctggagaatggggagactccatgtcattacaaatcctgttgtacattttgattctaaagcacatagccagactttatttcacaagttcagtctatgccaaacagggattaagcgctctgatgggtcaggcgcggtggctcacacctgtaatcccagcactttgggaggctgaggtgggcagatcacgaggtcaggagattgagaccatcctggctaatacagtgaaaccctgtctctactaaaaatacaaaaaattagccgggtgtggtggcaggcgcctgtagtcccagctactcgggaggctgagacaggagaatggcatgaacccgggaggtggagcttgcagtgagccgagatcatgccactgcactccagcctgggcgacagagtgagactccgtctcaaaaaaaaaaaaaaaaaaaaaaaaaaaagagctctgatggctgagattcaaacccaccccagttttgcacattggttgtataatctctgcctcagtgatctcatctgtaaaatagggatgataataatgacgttacttcatggctggtgagaatttaatgagttggtgcatgtgaaacgcttggaaatgtgtttggcatatagtcagtgcttaaaatatattggcttggctgagggcagtgacttacacctgtaattccagcactttgggaagttgaggccagtggatcacttgcacctaggagatttgagaccagtctgggcaatatggtgacaccccatctctacaaaaaatataaaaattagccagccgtggtggcacacacctgtagtcccagctacttgggaggctcatgcgggaggatcacttgaacccaagaggcagagattgcaatgagctgtggccatgccactgcactgcaggctgggtggcagagtgatactccatcacaaatatatacatatatatatatatatatatatatatatatatatatatatatacatatatatatatatatatatatatagagagagagagagagagagagagagagagagagagagagagagactattactatatattttttaagaaaagaggtgaagagaaggaaaaataactttgagtgaaaaaggaaaaagaggggttagggaaggtttctattgtcttttttgacacctctctcctttatgaattttatatatatatacatatataatatatatttatattatacactactagtacattatatataaaagatactattaataattatacatacataaaggataatgattatttgccgtatgtgttgcaaacatctttcccagtttgtggttttctttagggtactttttcacatgcaaaatagtgaatgtttacatagtcaaagtctttgttttcttctttaatcattatgttaatgagagttcttcctctttgagaccagatactaaattgagtttgcttccagttattttattatttcatgtaatattctaaaccatcagaatttttttcaccgggtacagtggctcacgcctataatcctagtgctttgggaggccaaagtgggagcttactgccgctctgacctcctgggttcaagcaatcctcccacctcagcctctcagatagctgggattataggcgtgcaccaccacacctacctaaatattgtatttttagtagagacggggtttcgccatgttagacaggctggtctcaaactcctgacctcaagtgacccacccgcctcagcctcccaaagtgctgggattacaagcatgagctatcatgcctggtctattgttgttattgtttaatcaaaatcaaatagccactaggtagcacagtgggaatctgatttcagacttgttcggatccaagcctacattcctgaccccttagctagcctgcctggtgctcccggttgtttaggggtgaatgaccattgaccataatacggtccgttgagaaaaagccttctagaagggcccagaattcaacccccttacgcccacggtcagaggagaccatcaggacagggtcatgggaggggccctgagacagcctagagacccaaagcaaacaaaacctcctcaataatgagtccaagctgggcacagtggctcatgcctgtaatctttgggaggccaaggagggcagatcacctgaggtcaggagttcaagaccagcctgaccaacatggtgaaaccccatctctactaaaaatacaaagaaattagccaggcatggaggcacacacctataatcccagctgcttgagaggctaaggcatgagaatggcttacacccgggaggtggaggttgcagtgagctgagatcatgccactgcactccagcctgggcaacagagtgaggctccatctccaagaaaaaaaaaaaaaaagtccctcccaggtctgcacaggttcaagaagaaaaccatccacctgttccatccccagcctggccatccctgctgtcccctccctggcagaagcagcagcagtccattctgagaaacaggggtatagcatggaaaccaagggaaagaaaagccccccacccacccccagagcccagctgccactttagcctgttgactggggctggtagacacctccaccatgccctcagtggctgggggaggaagtcctttttactactgggagaatctctcactcaaacaaagtcttacccagaaatgtacacaatggaaacagaaatgcaggatgaatgtagctgagcctgggaaaccagcctgcttacygcccaccccgctgtgatgggccctaaaacagggtgcagacagaacagaatttgcaaacctctaagctgtggcaagacaggcaatctttctgagaaggtgacttgggattactggctgggacaagagttaccactgaaatgtgagaacaatggtctgatagccaccttgtctgggaatagcttggctggactgaccaccttacagatgagaagtgattatactggttggaaggtctcaaggttgcaagaaggtgggagctggctctctaaccccagaagctgtgggggctttgataaaggccctcctcttgtcacctcccttcccctcaggctctgctgccatctgggctttcccccttagcactgtttataccttaaagaatgagcttgctgggtgcagcgccccatacctataatcctagcactttgrgaggctgaggtgggaagattacctgagcccaggaggtcaaggctgccatgagccatgattgcaccattgcactccagcctgggtgacagatcgagaccctgtctcagagagagagggtggtgagctaaggactcctatacaattgtctccttcccccaagatcttcagaaagaagcagaaagaatctggtttgatataaatgggctccgtgtcccacacatatacccctatacctacacatacatgcccacatccactcacacacatccacacatacctatgtgtgcacacacatacacacttttacatgcataagtgtatgcatagatacacatacaaactcacacatatgcacacatatacacactcttttttgtgtgtccctaggggtcaggatagaagtcaaaatgtcttcctagcctccacaagccagcagttctagaaaactgaaagctggggccgagggaagagcattctgtcaaagttcatgcattcgaggcatgaacagaaaatttgctccatttgctctacttctggttgcttcggaaaacaacctgaacctttcaagagctgtgagtttgataagcatcgttgcagaatgaagggccattgagtactcagaaagcgttgaaatccaaatggtttctcataatcagtttcctggaagcaggccatgggctggttttcagggtagagggagccccagccacccctgctggctgcactcggcttgcctaagtggacagacccctcatctggatgccagagtattatgctttcctaccccaggaagctagagcctgtagctgacactctagactctgggaacagttcagcaggaccggggggaccaaaggaacgcttctgcccagggatcctgctgcttggagaagcttagaggatggcaaggaattgtgacctcaaggaaggccactgcttggcatctttgcacctctgtgcccagcccagccctggtgtgcactagaggccctgcatgcatttgctacccatctattaagtctatttattctgtactgacatagaaagacactcactcttgttagtgagaagggcgggttgcagggcaaagtaaatgtatgagtccatgtctgtctgtctgagatgcaagatctgatctgctagtgcgggcaccctgggaaagaggggaggccagacagccactttcccctttgtttgcttctgttgtttaaacagttttaaatgagcatcgtcaattgccctggaggtacttgcagctaattgagggagactaatgggtcagcagatgaaatgcaatacaaacagaaagggattataccagttgagatggctagtttccacctgcctcaaacctcttaattccttccccctctacccgtkttcattctttcttcaaagagaaaataattttcttccctcccacaaatctgccattctttttstctttacccccatctccccaaccaaaaaaataaaaacaattatacatgggcacgtggatgcacacagcacacaaacacacagttgtaataaactggtcactatttatcttccattgagttgctgaccttagaagatgttatcctcccacccccatttttgcttgtttggcttggctggattatttatttgcagtgacaaatattaagctagagcaaaatttagtaatccacaataaaacatcattgaagccaggtgcagtggcaggagcctgtggtcccagctactcagagaggctgaggcaggaaggtccattgagcccgggaggtagaggctgtagtgacccttgattgtgccactgcactccaccctgggtgacagagtgagaccctcatctctaaaaaamaaaagcaaaaaaaattattgaataaggattttgaattttgagtgacaatgctgtttacctcctctcatgatcagggtagcattctactctgttgagctttccttagcttttttctaagaaagtcaacatccttcaagtcaacttctgggaccagaaaacaaggcaatgggtccttcacctgagcgagaatcccaagcactcacagtccctgctcccgcttcctttctctcccttcccttcccttcccttcccctcccctcccctccccttcccttcccgcccttccttcctttctctctctctctttctttctctctcttctttcttttcttttttccttcctttcttccttccttccctccttccccccttccctccctctctctctctctttgttttcaaaatagggtcttcctctgtcaccaacgctggattgcagtggcacaaccatagctcattgcagcctcaaaccctggactcaaggaatcctccctcctcagtctcccaaaatgctgggattacatgcatgagccactgagcctggcccctgctcatctttctaatccctcctcccacgtcccagtggatttgccaactgcaaattcatttcattcagacaatcaaatccaaatttctcagctgggcatgatttggcctcaacctccccatctgactttatctccagcaatttctctattttgccattttcagccataccagcccatcttgcttcaagcctttcctgtttgctctacccaatcgtactctgtccacttcatcctcttttttaaagatagagtctcactctgttgcccaggctggagtgcagtggtacgacgatggctcactgcagccttgacctcctgggctcaagtgatccccccatctcagcctccctagtagctgtgactacaggtgtgtgtcaccattcccgacttcctgtccacttcttgacaagaccagctctttcttgcagttccacgctaagccaacaggtccctttttcggaaataccttccctaatcactctatgggaaaaactgcccatctgctcttaacgcctccagtttccctacccyatttcattaaacaccatccagatttatccaaaatatcttgtttatttatttgcttgctgaccatttgtttaccccactggaagstaygttccaggagagcagggaacttatctatcttgatcattgctgatttcagtgtctaccacagtaccaggcacctaataggttctcactaacttttcattaaatgaatgaccaaatagcttctcagctcccaagggctgcttgcaaagtcccctgtctggtgctccttgcaaagcccccgcctgggtccggggggaggacagggctgagtgtgtgctgctgtgattgcagacagagtccttcaagctgagtgagccctacagtcagtgcacggaggacgggagtgacgtgccaatcaggaacatctacaacgctgcctactcgctccaggtaacagattggcrggggcacccagccctgggtttatggcccggacccaggagacaaagttatatctargctggggtgtggcttgcaccaggaactctggtgaggatccctggggttcatccagagacctcaagaacaaatgatgccggctggttccagtcctctgcagttcgtctgtaaccagagcttaattgatacaccgaggtttcygtggaactcaatgtacagctgagacagrcccacctcctaagtaggccttggcaagggaggaacaggaaagaagcggtctgggagagacactggctgaagggtcaagagcatggcttccgggcctgctggtgcccctckctggatratggccttgggccagctgggttcccctcagcaaccacaaggggaggtgggattggatcaggggctgctaatttgcagctcccagtcgccttccaggtggcatacctggtttttcaagagcctggatggtgttcgaaagtcaaggaatttcacaagaaaatccagattyccagcctctcgaaaaaatgaaacgatacrgcaacattgagcccatatttcctgcaggataaacagtgggtgtagctaccccaataaatgaagcaggtgttctctggctcccacagttttcactacccctccagtatgtcacttmcatcactgtctcctgtagacatctgacttttcaacacttaagtgagatgatctgttctgcctcctctcacattctgggaatttatagttcacctcctaccaggataccccagagagtccatgaraatcatcccagcagaacaaaaggaccagaaaccttcagcactgagtcttccaacttagataagagctgagctgagaggtggtgtagacactgagtaaaagaggacttttgggccaggcatggtagctcatgcctataatcccagcactttgggagacaaaggtaggaagatcacttgagcccaggagtttgagaccagcctkggcaacatagcaagaccttgcctctaaaaaaaaaaaatttgttttaattacctgggcatactggtgcacacctgtaatctcagctataagggaggctgaggagggaggatcccttgagcctaaatgttcaagcctgcagtgagccatgatcacacgactgtacttcagcctgggtgagagaacaagaccctgtctttaaaaataaaaaaagtgagctcatcagaaagatacttctggatgacatttagtgagarctaccatgcacacacacaccttacatgtatcaattcatttcatgctcacaacttcatgaagttgatattattataaagaaagcaaagcatctgagaggttaagtaacttgcatgatgccaaacagcagaaaaatagcaaagatkggatttgacytgagtagcctgccttcaggaactctgccattagcttttatgctataagctccayggatattgtggtagcttatgatccatgaagatccaacatggaggggttggrcttgagaataggaacacagggactgtgtttatttctctctgtttcttgacaactcctctaattttcccacttatctttgtgttggcacccacatgatggaaaatgaccacccaactactgcagccccagctcagccccatctccatatctcagttagtctaaattcttaatacatcggccaggtgtggctcatgcctataatcccagcattttggaaagccaaggtgggaggatcacttgaggtcaggagtttgagaccagcctggccaacatggtgaaaccctgtctctaccaaaaatacaaaaaaattagctgggcatggtggtgtgcatctgtaatcgcagctacttgggaggctgaggtgggaggatcacttgagcccaggaggcagaggttgcagtgagctgagatcatgccactgcactccagtctgggcaacagagcaagactgtctcaaaaaacataaaaaataaaaataataagtaaattattaatacatcttccaggttgggccctttgcagttccgggaccatgcccagcccagttggcataaggggcaggttcatgtggttggccaaggttaagggaggctgaccccctgggctgagggatgtgcaggaaacyccctgacatccctgagcaaagacatgaatggcattcctgggtctcctctttcagatctgccttcattcatgcttccagacaaagatggtggagaaatgtgggtgtgcccagtacagccagcctctacctcctgcagccaactactgcaactaccagcagcaccccaactggagtgagtgagacccagctccagccttgcatgccccaggaccagggtcagcctagtcctggcaataggcactcctgggactccacccctgttgccttttgcgtgagggaggtattggttgagagccattaactagagttttacttctgttgtcaagcctggcttaaattatactttgcaactgaccaccttagtcaactccaggaggtaggaacggtggatattaccttttcacagaatagataaccaaggccsagaaaggctaagtggcttgcccaaggtcacacagccagaaaggaacagagctggatccaaaccaagggtggtctgaccttcaactcacatcctcaaccgccattgctttctgtttcccaacatcacaatgcaatatgtgtttccagagagttggtagaaagtgggaggagaaatcattaaaatgagactgcggggctgtccttggtgacctggggatggccaggaagggtcctgtggctccaaagctcatgctgccctctcccttgtccctcagtgtattgttactaccaactgcatcgagcctttgtccaggaagagctgggctgccagtctgtgtgcaaggaagcctgcaggtatgtggaccccaaggggtgagacgggyggctgggttgggttgggctgcctacactcatgctgtcccctcctcccttagctttaaagagtggacactaaccacaagcctggcacaatggccatctgtggtttcggaggtaagttcttctgcccacccttccccactgaagcccccagcctggagccccactgacatttttgctgtgtcctctggcctgggacatggtccagggggaaaagaattaccttgtggaggctgggggacaagttggggagcctgaggcgggaggctggccctagcctctcaggcaccctcaggcccacgctttctctctccrttgtagaagtggttgctgcctgttctcacttgggaccaaggccggcaagtaaacaaaaagctcaacaagtaagttacctctaccctgttcctctgtctctkcccaccacagcccccagccttctcacttgcttctgtatgtgtatggccaaatcctctttttttttttttttttttttatggagtcttactctgtcacccaggctggagtgcagtggtgtgatctcagctcactgtaacttctgcctcctgggtttcagcaatcctcctgcctcagcctccyaagtagctgggattataggtgcgcaacatcacatctggctaattttatatttttagcagagatggggtttcaccatattggccaggctggtctcgaactcctgacctcaagtgatccacctcccttggccttccaaagtgctgggattataggcgtgagccaccaagcctggccccctctccttttcattcactcactcattcatttcctcaaagctgggagacggtgaactcacatctgtgaatcatgccatgtgaactcacatttctctaagccatcactatctccctcatgcgcactgctgggcctgcctgccatgagagccaatctggccaatcttgcktccaacattcatagagcaccccctaggtgccaggtgctgtgtgaggtgctgggggaaccaggacaatcaagcagacatagtctctgtcccccgaggtacttacactctaatgagaaaatagactttgaccaagcaattgcaaaccattaaaccaagtgttgcaagctggtgactgatccttggcccaaatctagcctcatgaaagcaacccattatttccaacttttcctgaaaattcaaaagttctggcaagaacgaccctccactgttttgtagcaccaaacagctgagtaatacttgctcttttggctgagtcatggtccagttcaccatcgtcctatcaagaggcagtttagtgcaatggttaagagcatggactttgaagctagatctaaatgagttggagtactggctcagccaattattgacagcatagtcttggacaagttccttaaccaatctgcatctcagtttccacatctgcgaaatgaggatgatgaaaatatacatacctgcctcatagggctgttggtagaattcaatgagttagttcacataaagttcttacgacagtgcttggcaacacaggaagtgccccataaatgcttgttgccattgtgcctattatcatattacctcaactaccctgctcatgtacattacctgtacatacttgagattgcaatcaatcaattacaaatgtcaatgtttaatgaagaacagggtacaatggcagtatggctgggtcgactgacttaatctggaagttggggagcagttcttgagtgaatgaatgacctgtggaccagatccaggctggagatatgctctggggtgtagacggagcccttatgggccaggttctaatatccccaaggagctcagtgccttggccatgctgccagcttgggtaggagggagacagccatgctgaggactggtaatctggtaggatgccaaggctcttgattcacctgttggaattttgcaggacagacttggccaaactcttgatattctacaaagacctgaaccagagatccatcatggagagcccagccaacagtgtgagtagagtggcttccttccaggacctgtcctgggcctacaaatgtgagcatcttcctggccttggggagcagaatcagggtagggggttccagcctactctaggagggctgttgtaggctagccaggtctcaggtcggaatgcacagagtaagaggaaacaggaaggctgcctgcttcttcctcccagcctgtgcagggtcggggctgacccgtggctcccttgggaatcagggttcctgtgtgaggccaacttggggggaggttcctcttgatggtgtggcttggcctgtcttgcagattgagatgcttctgtccaacttcggtggccagctgggcctgtggatgagctgctctgttgtctgcgtcatcgagatcatcgaggtcttcttcattgacttcttctctatcattgcccgccgccagtggcagaaagccaaggagtggtrggcctrgaaacaggctcccccatgtccagaagctccccgtagcccacagggccaggacaatccagccctggatatagacgatgacctacccactttcaactctgctttgcacctgcctccagccctaggaacccaagtgcccggcacaccgccccccaaatacaataccttgcgcttggagagggccttttccaaccagctcacagatacccagatgctggatgagctstgaggcagggttgagaagacagatctagtcaggaccaccagccatgktctaaggacatggatcgggtgcccccagacrtgtgcacaggggaccctctgccccactctgggcttttcagatactctgaccaaaaagcctgctttaaaccgcaagatggggcckgggcatgcgcaggaggagccatcgggtactacgcagcaacactcacaactgtccaggctgagataaatcccgggacytgaactattagcacgtcactagagactgggarccgaggcagtggtgctggcccaagtgaaggccagagtgaggactgatgcagctctttacgggtcttgagagggaaggactcttccaaagccccaaagccgagggtttcacccacactgccagcctgggttggggcccaaggatgtgaccttgagtgtcaaggctggacagctactgccagatgccaaagataggagaaagtgccagccctgaagctggagccgtttgtgaataaactgttcttcatcattgacactggagaaaggtgtcctccatgccctcaggcagcagagaactggcccagrgcccttggagtgttggtggagatcagagtgccgwggtggaggtctgggactatgtcagagtgtcctcactttggggcatgggtgggcccaggagatggatttrgttattcaattttgtggatgaataaattgaggcacagaaagattaagttaccggcccaaggtgacacagtgaggaggtggcagagctaggatttgaacccagacaatctgactccatgattttgcatccaattcgtgtctgtgccttttaaagggtgaggtctgtgtcactttgggtggggagggggagcatggtgggccatgctctgggcagctgttccaagacagagctgacccttccattaccaatggcctgtccctcaccaacaagccaactgccacagatgacccacttcataccacattcacatctttccacctgaaatggctaacaggtattaaatccttggttggtgtttaaagccaacccaagaacagggtgttaggtactgttttaagcacctagataggttagcataggggactgcaaatggtgttccgcaaagcaaatcctgtttttgaccatgaactaagaattttattttattttattttttattttttgtagaaataggatctcactatgttgcccaggctgttcttgaactcctggcctcaaatgatcttcccacttcagcctcccaaagtgcagggattacaggcacaagccaccgtgcccagccaagaatttttatttttgcttttaaatagcaaaagaagaagattctgtgactcatgaaaatgatatgagattcgaattccagtgtctataaataaagttttattggtacacagccacatccatttgttcaagttttgtttatggccattcatgcactacagtggcagagttgagtagctacaacccagacctgcaaagccagcaaaccctaaaatattttccctctgtccctttacggaaaactgtgctgacccttggatgagcacattcaatgggtatgattatcccattttgtggatgaagagactgaggcataaaagattaagttacttgcccaaggtgacacagctaagaggttgcagagctaggatttgaccccagacagtctgacaccagagctggtgccttttatcactccattattttgcagccattctggtctgtaccttttaagagtgagtccgatgtcattttgggtaggaagagggagaggctaaataccctggctctagggctaaaggaagtccttcatccatgggtggggaaggtccacatttcaggactaatcccttcatgagaatggctgctagtaagggcaagagtcttggtaaaagagaggggctgtagggaccctgtctggacctgggcatccctggtccaactcaaccccaggcctgtggctagagtaagcctctgctctatctggtgtttccaccagaccttatagggcagggcattgccaggaggcatgccagccagcaaggaggaggtcatagagaccccagactggagggagctcccctgtgaagtgggctcaggagccaggcccatgcaggtgaggattgggctacagaggccgtgagcctggctttcgtccatgctgggctctggcggctgtagccggtgccgacagggaacttgcagctgatgtctacctgagcacagcacagacaggagcttcctcctcctccccaatggtggggacaggaggtgccctcagattcgtggaattggccagcctctgcctgatggaggaacacttctagtaggcttgtcaaaggcaaggccatgagaatccaaagccaacagccgctcaactccccccaagcacacgggcgtgcacacccagcaaactccagctgtctccattcttgtttggctcttgcagtgcccagcatcgtcttccctccttctccacttcacccttccaggccagctgcaaatgtcagcacctctgtaaagttttccctgaccctcttcccttgccccaagaagttggagcttccaccattacacaactttcacccatatatatatataatatatataaaatatattatattatattttatatatattatatattatatatattatatattatatatatatacgtatttatatattatatatatatatacgtatatatatatatgaaacaggcagggtcttgcctctgttgcccaggctggagcgcagtggcatgatcatagctgactgcagccttgacctcctgggctcaagtgatcctcctgcctcagcctcctgagtagctgggattacaggtgcttgtcactacccatggctcatatttaaattttttatagagacaagatctcactatgttgtccaggctggtcttgaactcctggacttcaaacaatcatagctcactgcagcctcaacctcctgggctaaagcaatcctcctgcctcagcttcccaggtagctgtaactatagaagcacacaattatgtctggctaattttttattattattttttgtagagatgggttcctgttatgttgcccaggctagtctcaaactcctggactcaagctattctcccgcctcagcctcccaaagtactgagattacaggatgagccatggtgcctggccctgtatacaattttttatccacatctgcctctatcattagactatgagctctgcaagggcaggaattgtgtcttatctccttgtccctagatggggacgggacagagtacagtgttggcatttaggaaaagtttgtggcgcttataaaaacagtgacaatactaacaatggctaatatgcattgagctcttatggtttgccagggattctgctaagcacttcacacacatcagcttgtgtaattctaacagctcaggaactcataaagaaagaaatggaggccggatgtggtggcttatgcctgtaatcccagcactttgggaggccagagcgggcagattgattgagctcaggaatttgagaccagcctgggcaacatggcaaaaccccatctctacaaaaaatatgaaaaggtatctgggcatgatggtggcgcacgcctgtagtcccagcagctactcaggacactgaggcaggaggatgtcttgagcccaggaggttgaggctgcaatgagctgagattgtgccactgcactgcagcccggggaacagagagagatcctatctcaaaataaaataaaataaaataattaagagaaaagaaaagaaatggagtcacaaagagttctcacggccacactgctagtaactgctgtgcccaggctagcaggcagagccaatgcacttaagcactgtgcaaactgcctttcagatagaagcttttccctagaggctaagtgtgtctgcccctgaagttttctccagccctctttagcttcagatccggcctactcagctgaggggccttcttttcccaggacaaaggtgaggacagagtagaacaacttcattcccagacccctttcataagcaactgccatagctaggagctactgattccaagggacaccgactccatttgtaagtcacaagaatgcctgttcttaatgtacccctggtcttctcaaatggagccaccaccctcactagtcctctgagtcactgaatcccagaccctagtgtcctgccacccatggaccacctccctgatgaacagaggcactgcagactcagcctatgtcctgtgatcctgcacaagggaagatattagataaacatgctagtctcttctggggttaaaaactcaggagagaggtctgggctagatggagacatgggcatcatccaggcaggacaaagccaggggtgtggattaggtcaccatggaggagaagcagatcagaagaggagaaaagggttcggtgcagtggctcgcacctgtaatctcagcactttgggaggccaaggcaggaagactgcctgagcccaggagttaggggctgcagtgacctgtgagtctgtctgtactccagcctgggcaacagagcaagatcttcatctcaaaaaaaaataataaagaagagaaaagagtcaaagatggagactccgaaacactgacgtttaagaaagagacttaataaggacaaaaggtgaagtgacaggaagctcccctcctcttcatgaatctcccttcttccagctctccttcctccttccctactccaggctatgccaagagaatgtctccgaagtgcagactggaccacagcacctcctgcttagacacttcttggcagtgccccatctgccccatctgccccatcacaccttggccatgtttctcaagttgcaggactcaccctacggtgataattttaggcagcacacagacttatctgcaactctgaatggttccctctctcttcctccactcaccctccactcattcacgcattccttcaagatcagatgcaaatgtcactctctctatatggtcttcccttgcaagttggagcatcaaatatcattgacaaacagaataagaaagctagtccattttccaatgtgcaaaaacaaagttcagccagtgtggtggctcatgcctgaatcccagcactttgggaggccaaggcaggaggattgcttgagcctaggggttcaagaccagccacaacacagggaaaccctgtctctacaaaaaaatatacaaaaattagctgagtgtggtggtgtgtgcctgtagtcccagctactcaggaggctgaggtgggaggatggcttgagccagggaggtcaaggtcacagtgagctgtgattgaaccactgcactccagcctgggcaacagagcaagaccccatctcaaaaataaatccccaaaaagcaaaaaacaaaatctcggttcgatgttcacatgtcttcaatactttctaacactgttcgtctctcttttctaacaaagagagagctgcctcagagcctgtagctctctagctctcttgctatctaatttgaacttagcagcatcaattcttcactgcctttgttttctcagtggtcttctgcttaatgtaaccaatgcttaatgtaatcaatagaaaaaaaagtcaattgattgaccgagatttgccaaaaaaaaaaaaagtgcaagatcatgtactatagaagaacgcatctcctttagtcactagtttaacaatcacttattcatgcaacaaacgtttattgagcactgtattcatttcctgtggatgctgtaacaaactaccacaaacatagtagcttaaaaccacagaaatctattctcttacagttctggaggccagagctctgaaatgaatcttatggagctaaaatcaagctatcagcagggctgtgctccctccagaggctctaggggaaaatctggttttttgccttttcgaacttctagaactgcatcccttggttcctggccccttcctccatcttcaaagccagcagagaagcctcttacttcagtcatcacattgacttctgttgttgccaaatctccttccgcctccttttaataaaaacacttgtgattacatttagggtacacccagataattcaagatattttccacatctaaagatccttaacttggcggggcacagtggctcatgcctgtattcctagcactttgggaggccaaggtaggtggatcgcttgaggtcaggagttcgagaccagcctggccaacatggtgaaactctgtctatactaaaaatacaaaaattaaccaggtgtggtggcatgcacctgtaatcccagctacttgggatgctagacaggagaactgcttgaacccaggaggcagaggtagtgagccaagatcgcaccactgcactccagcctgggcaacagagcaagactctgtctcaaaaataaataaataaataaaataagtatattcccagcagaatattattcacccattaaaaagaaatgaactccaagaggtaggaaggtgggaggaatgaaacactacctattggagacaatgtacagtgttcaggtgacagctacactaaaagcccagacttcactactaatgcaatatatccgtgtaacacaactgcatttgtatccctaaatccataaaaataaaacaaaaagtttaaaaagaatgaactactgacatatgaatgaaccctgaaaacatcacgctaagtgaacaaagccagcagactcaaaaggtcatatatggtcccattccatttatacaaaatactcagaatggataaattcacagacagaaagcagattgcagggaggagaaatggagagtgattgcttaatggatatagagtctcctctggggataaggaaaaagctttggaactagatagaggtggtggttacatggcatggaggacataataaatgctgctgaactgtgcactttaaaacagttacgtggctgggcgcggtggctcacctctgtaatcccagcactttgggaggctgaggagggtggatcacctggcgtcaggagttcgagaccagcctggtcaacaaggtgaaaccccatctctactaaaaatacaaaaaattagccaggcatggtggtagatgcctgtaatttcagctactcaggagactgaggcagaaaaatggcttgaacccaggaggcggaggttgcaatgagctgagatcatgccactgaactccaccctgggtagcaagagtgaaactccatctaaaaaaaaaaaagagttatgtgattaaaaaaatacaaaatccaaaaactaaatttatttaaatgaaaagagagcgagttgacctaatgaaaaataataagtgaaattataaagaaaagcaagatgcactgagcacagttagaagagcata

SEQ ID NO: 12193 - DNA, 30967 bp, Homo sapiens
acaaaaatgctccatcattctctcctcccctgtccccttctcccaccagcacccatctgagggagaggcaagagactttgggtggaactcttgctgtaagaagtcagtacggtggtgactcaggctggagagtatctgaaaacagggactcctgggtcctgttcctccaaattgcttcgtaaggggaattaagtaggaagatagagctgggtggtggtggtcagagaggctgaggagaattctttcctagggcatctgccacaattaaatctggcctaaagattgaatagtagcaccagcataagtgaggacactaaggctctgctcccagtcgctggtttctggtgaagaggcttaagtggggaggagggggtgactcctacgatgggcaacaggagagatgagtgctgtttttcagactcagacagctgaacagcacttgaatgaatcattcgtatgttgtacagggaaggaactctgtgggcagccaaggctccggagccaggctccttgtatttcagagcccctcactgcccagatccctagctaagatcttctttcctgcttcagtttactaaagggaacacctgctcactgaaccctctgggaaacccagaacttatcttaactcactccacctaatgcctcccacagcctgttcagaacacccttcagggaaagagaatagactcttaggactggagatgagaataaagaaattacaattcactcaatcccagcatctcacaattcaatctttcaatcctgatttgggatctgagaggagaaatgagatgacaaatcccaaatgtacagtgacttgagggtgagtttggcatcagctcactcgaagttatttcttctgctccccaacctccctacccagcaagttagaattcaatctgattttaaaataagatcaaataaatctcattttaaaataagatcacagtggctcacacctgtaatcccagcactttgggatgctgaggcaggtggatcacctgagatcaggagttcaagatcagcctgggcaacatggtgagaccccatctctactaaaaatacaaaaattagccgggtgtggtggtgtgcacctataatcccagctattcgggaggctgaggcaggaagatcatttgaacccgggaggcagaggttgcagtgagccaagatcgtgccactgcactccagcctggatgatagagtgagactccatctcaaaaaaaaaaaaaaaaaatccgggaaaagtgatgccacctggcttttcactgctctgattaagaaattcctcctgtgaggctgagcacactgactcactcctgtaatcccagcactttgggaggctaaggcaggtggatgccttgagcccaggagctggagaccagcctgggcaacatggtgaaaccccatctctgctaaaaagacaaaaattagccgggtgtggtggtgcatgtctgtagtctcagctacttgggaggctgaggcaggaggatcgcttgagcccgggaggtggaggttgcagtgagtagagatcatgccattgccccaagcctgggcaacagagcaagactctgtcttaaaaaagaaataaattcctcttgtggtttaactataaagtgtaaccccctttttggacttcatttcctcttttttgcccatcccaccttcactggagctagaagaagatggacccataaagtaggtctgtatttttatagcaacactggacacattcttccttggatttgaactaccattttactttttttaaagtaaaaatagctatagcaatcaaggcactcaatacctaggaataattttaataagaagtatgtaaattctacataatgaaaactaaaattctactgatggggtaccaatgacttgaatgtataggaagataggaagattcttatcatacattctcctttagataatctaaaaatatgtgattccagccaaaataacagtaacagaatagaagagtaaattatggttcaatatagcctcacaatattataccacacagtagtcagaatgaagggactaaaactatacacaatatggctgaatctcacagaaataatttgaacaaaggaagccagacacaaaagagtacatactctgtgattctctttatataaaaagcaagaacaggcaaaattagtttatggtatcaggagtcagaagagtggttgtccttgagaagagcagtgactgagagggaacacacaagtggcttctggggcactagcaatgttctgtttcttgatctgctgctggttacacaaatgtattccatttgtgaaaattcatcaagatatatacttgtcatttgtgcatttttctgcatgtatattataaattaattttttaaattgtggtaaaaaaaaaaaccataatgtatacaatttaaaaaatttttaggccgggcgcagtggctcatgcctgtaatcccagcactttgggaggccgaggcgggcggatcaccaggtcaggagaccgagaccatcctggctaacacggtgaaaccccgtctctactaaaaatacaaaaaattagccaggtgtggtggtgggcacctgtagtcccagctattcgggaggctgaggcaggagaatcgcttgaaccagggagttggaggttccagtgagccgagatcgtgccactgcactccagcctgggtgacagagtgagactccgtctaaaaaaaaaaaaaaaaaaattaatgatcaatggaacaaaatgaaaaaaatccagaaatagacccaaatacatatggcaatttggtattataaaggtagcattcaaaaacaatggagaaaacatgggttattcaataagaaggatttgaataaaacaaaacaaaattggatctctatctcacacctttacaccaaaataaattccagatgaatcaaatatttacatatacaaagacactatcaaagtactttttaaaaaaacataggagctttaagaataatcttaaatagtgggagactttactaaaaattatatgaaacacagaagttggccaggcacagtggctcacgcctgtaataccaatactttgggaggctaaggcgggtggatcacttgaggccaggagtttgagaccagtctggccaacatggcaaaactactccgagtctactaaaaaatacaaaaattacccaggtatggtggtacatgcctgtaatcccaactactcaggaggctgaggcacgagaatctcttcaacctgggaagcagaggttacagtgggccaagatcatgccactgcactccagcctgggcgacagaatgagactctgcctcaaaaaaagaaagaaagaaacccagaaattatcaaagaaaatattgataaattcaattacataaaaatttttaacatttgcaaagaataaccataaacaggctgagggcaatggctcaggcctgtaatcctagcactttgggaggctgaggcaggctgatcacctgaggtcaggagttggagaccagcctcaaaatatgcaatatacatagaacaaacttggaaaagggaaaatacttgttatatgtataaacaatatacatagaacaaactgggaaaagggacatactttttttttttttttttggagatggggtctcgctctgttgcccaggctggagtgcagtggcaatctcggctcactgcaaccaccgcttccccagttcaagtgattctcctgcctcagtctcccaagtagctgggattacaagcgcttgccaccataaccggctaatttttgtatttttaataaagacggggtttcagcatgttggccaggctggtcttgaactcctgacctcaggtgattagcctgcctcagcctcccaaagtgctgggattacaggcgtgacccaccacacctggccggggaaaatacttttaacttatatacaaacagcaagtattaagaaatgaccctataaccaataaaaatatgaacagaatataaaaacagagaatttacaaaaaaattgccatttaaatatattaaaagatgctcaactttacttataagagcaatgaaattttatcttgcaatgagatagcatttacactatcagattgtcaaaaatcaggaagtttaacagcaccagtgtgctatcaaacaggttcttttcatacattgctgacaggagacaaaattggtaaaatttccagggaaggcaatttggtaatactaactaaaatcattttcaaaaattgctggtgggattaaaattataaaaatctttgtgggaggaagggaatttacaaaattttatctatccaaatgaaaaaacaatgcacacatttctttaacttggcacttgcatttctaagtatttatcatacacatatgcaagagggaaatgaagtatccttgcatatcaatcaaatgttaaaggactggttaaatatatcttcatatatccctcaggcatactatgaaactatcactatgaggcagatacgtatatgctgctacggaaacatttccagactgtatcaaagaaagttgcaaaatagtatgtatgttatcaactgggttaaaaaaatatatgtgtgtgtatatatatatacactttatatattacacatatacacacgttaactatagaatatcttgtgaaatttttcacaagaaactggtaaccctagttgccttgaaggaaggaaaatttattcactataataaccttgtttcttctgaattttgtagaatgtaaatgtattacttattcaaaacgcatacacatttttatattaatagaaagcaaaacctgaggcccaaaggcatctgcctaattgacaaaagatacaaccttgcgttctttcagcaaatatttattgctcatcacctgccaggtattgtgatggaagctagtgcggaagatcccccaatgaccaggatcgcccgacccctgtycccagggtgagcccctagcgcggagcggggacagggtggaccgagtagggcgcagtgctggtctcgcgaggctccctgccccacggaggcagtagcaggacccaaccgttcctaaccgtccagggaccaggacagcgtctggaataaaatcttccaaagcaaacttccgcctgcggagacccgctcccttcctcgcccccacagaaacgccccccgccaccaccccctcccccggcgtaggccttcacgctgtcgcctcgacccgtttcctcgaatccccarggaagggtgggcccctggcgcccctatggcccgccgcccccttaccaccgcggtcggagcccgggtctcactctcctgccgctgtttcgggccacaccgtgtgtccgtgcctccgcaaaggaatagaagagtgggtcctcgctctctgcggcgcaccgcttgtcccttgacttcctgtccatctacaaagcctatttcatgttttccagaaagaaaacgttttccgtgtctcttgagtcctcatcgccatatgcggggcgggaccgatctatgcaaaagatcgcaagagaaaactgatggagcatcgcccatcatgaggctgctctcccgatggtcactgagttgtgttgtggcactgtctttgtacaaagacaccaatttttgcgaacggtgccactcatgattcaacgctctcatgcctcggtcccagctgctggagcgcagattttcctccaagggttagaagatagaaaactcctcggtaattggcctagaggtggtctgcgaggacgccgggaagyttgtaattggctgtttaattctcagcaggtgcggtctcagttaacaacatctgcttttcctggatcttattggctgacagggtgggcctgctttggattccatccgggtaattgggcagcggctagcagcagccacgtcgctcaggggcagcccgcggaaggattggttgtgacgggagaaggcgattggtcggactgcgagcagggtgttgattggtgctgtcgggctgcgggggcggggaagtggcggctgaagcgccgccggcggggctcactgtggtggtgtgagtgggaggcggcggcgctggtggctgcagctggggtgaggcgcgaggcggcgcactcgacggctgactggagcagcggtaaaggcgaggatggagaccgaaggtttggggagtgggaaagacagggtcatgggcagccctggccactaggagacggaaatgcgggagcgagggaagggaggggtctggcgtgccccggggcgagggaaggatgtggggcgcagcgggggagtcagagccctgggctgtgagacgccgctcgggggcaacttgacccactgggaactcgtaactgtatctgaggaagatgctccagtcacccgcttacgccacaacggacccggtgcgggagcgtttgtgtttgccctgagtcagttcagactcttccrctgggcctttttgagactgagagctgccatccgtatatcactttgcctttaactttccccagctttttctttagttatcgctaataggatggctgtttacagtcgtcagaataatacattggggtttttgtttttccagtatccctcattccttaatccaggtatcatcgtgggggttggctggagacccctatttcaaagactgacttttagaccctttccttgttttgagagaaaggggttgacacttttttttttctcstgaatttaaaataaacgtaccaaggatgagaacattgagctgcttcgattcaagcatgtcaccatgttgtaggttctttgtaggttctggttattaggagatactggaatgagttatctatgctttcatggagctaacaatgtgatttgacttctcatcacatcctatttgactcctgtcattttaaatgataaagtaarccttagcgatgcatatcagatagtttttggcaattgttcaatacaaatgtcaggaaatttcaaagttagctttcactgaaaaccattatctaaccacattcctcactgaacaatgatcctcatcttctcttcttagcttcccctagaaactgtggtcttaagttctagtattttcctccttcccattcaatttttaagtaataaaatcaaacacaagctagcagtcagtactatgcagttatycccgtttacattatattattttccatttctctttaagagaaacttatagctgaaaggataygaaaattgtgaacaaaaccatagtgacagatcaagtagagtctcattttttgagacatcagctgataactcaattagcacaaattcatttgtaatgtttgaagaggagttagtgaaatttaccttttgcttcaaatagaagtcggccaaaaccgcacctataatctcagctacgccggaygactgcgggagttcaaggctgcagtgagctattatcattcactgcattccatcctgggtgacagaccaaggctctgtctctaaataaacaacaacaaactctccaattcatctgttctccatctccatcattgacacctggactaggccctgattggtctcctgcagccacggttgctgccttcaattcattctcctcaccacggacacagatgttaatcaagaatgacaagcatggcatgtgttatcaagggatattggggattctgtggaaacccatagcaatgtaattcaacccagtgtagggggtcgagattgaggggccttggctgcagagacccctctgcacttgatcttgatagtgtcagaactggaaaacaaaagtgctgctagtcctttgggcctctgtaaagaggtgtgattatgactggccatcaaaacagacttatttcyattgcacactgtattgtgtagaaatgactaatgagctgtgtgatcttagatcaatccttttctatcccttagccgyagtttcccaaattgcaacgttattaatggaatcaaataagttctgtagtcccttctagttataaaatcttgtgatttctatgccccataagcatcaattatggccagtttttaaaagcagacagcatgaaaatacagatccagtttattcttgttcacagggctagatttcagtttcccaaagcccttaagacctaaagactcctgcctgtcaagatcttccttgccagacaggaaactccatgaaggcagctgccaaatctatcttgactgttgtgtcccgagggtcaagcacacatcagaaytcgatatttattggcttgaataaatgtccatttagtgcagttcattcatgtagtataggtttgcggaagaaaagtgagttgtattttaatgagatgattttcaactatacaccatctaagaaataaaccttaaggttctagctactttcaactgtcgcattgaccaagaatttatacagttgtccctcccttcrttatttgcaggggattggttccaggaaccctgcagaacccaaatccatagatgctcatgtcccttgtataagatgcatattatttgtatataacctacacacatcttgccctatactttttttttttaaaccccttgagacaaattctcgctctgttgcccagggtggagtgcagtggtgtcatcagtttactgcagcttccacctcctgggctcaagccatytcccacctcggcctcctgagtagctggaactacaggtgtgcaacaccacgcctagctaatttttttttttttttttttttttttttttttgtagaaacagagtctcactatgttgcccaggctagtcttgaatacttggtctcaagcagtcctcctaccttagcctctcaaagtgctgggattaacaggcatgagccactgtgcccagcctgttttggtgtttatgtttcctagactatgaatrtttccaagtagaaattcttcttcctccttctgtccccaacgtgctcagcacacaagaaagagctagcactatttaaccaagatgcattaataatggaaacaagctttgcactttagtggtcatataagaaaatacctaagccaggcgcagtggctcacgcctgtaatcccagcactttgggaggccgaggtgggcggatcatgaggtcagcagttcgagaccatcctggccaatatggtgaaaccctgtctctactaaaaatacataaattagctgggcatggtggcaggtgcctgtmgtcccagctactcattaggctgaggcagaagaatcgcttgaacccgggaggcagaggttgcagtgagctgagatcgtgccactgcactccagcctgggcaacagagtgagactccgtctcaaaaaatatatatatctaaagtaatcaggggacaaaagaagtcaaattctttctagacaccaagaataaaccatctcaatgtaggaaagtagcagtttgggaggtgtgtattcaagaattatttaagtcaaaaatctcctttatgaaacaacttgtttcctttcctttggtatatacaacgatgcttatataataccatccaaactttcaggatggtgaaagcttttatttgcagtgtatttaaaaaaagagaagcttatccaatgacttgggaaaagaacctcataaatgaaaacaaacagcctacattaacctcaaccctttctgtcctacattctaaaaaggtcgggagagaacagtattccctcagattgatagtctctaaaaatgatatactgaattcactgagtaactaatgacccaaaatagacgacacccttgaaaagaggtacccatcccccacctcgggtagtaaaaggccgttttattwtttgctcaggcttttgagtccgggcaagaaggtggattaaatttgtttaaaaccaggatatagaaaaaatagatttggcaaacttctggtagttctctgaagaactttattcagttctrttgatcagtaaagctgtgaggccagatgcaaattctggtcatctgtatgacagtgtagtagtctmcccttctccgtggttttgctttcacttacccatagtcaatcctggtccaaaaagattaaatgggaagttccatacgtaaacaattcttaagttttaaattgtgcaccattctgactagcatggtgaaatctccatcctggcccagacgagaatcctgcctttgtccagcatatccatgctgtatatgctacccgcctcttagtcacttagtagccatcttggttatcagattgaaaaaacctatagttttcagtactccaaggcatccactggggttcttggaacatattcctcgaggataagagaggatgactgttgtaagaaatctacctccagcctcccttacctgactatatctgctcctcagtgagatttcggtgctagatgttctcctttctctctttactcttccagattgactgtgctttccctgaaagcctaagttttattccacagtaggttttgtattaatgagtatgtttttagccttaccaggatatagccagtttttccccccagggtgaaatacatttttgtttattataattatttgggttgaatttttgtacctggaggtaaattatggcataagttacatttactcatttttaagcaaatcttatttaaagccagcttgctttgttctactagattgtaatatctggaaatacagatatttagttttcagttttttatcacctatctttagttttttagtcttcagtgyttttttaaccacctacagtactttctaccagtattaattttgaattgaatatgttgatcaaaataaagaataaaaatacaggtgctgttaccctaagagcttaggtaaaaggaagagtggggaaggatttctaaaatcactttacaaggttttttacaagcaagaataacccagactctgggttagagattagataacctcttcaagcatgggtactcttctatgggattaatatttcctgccttacagggttatatgactgtaaaataaaattatgtaatttgcctggcatagtagctactcaacacattatctcttcatttttgtgtctttagtgccacagtagcatctagcacatagtacttactccagctcttgtgttgagaataaactgaatggacaatggcaaaggcaggaacgtaattaagcaatgcagtaatctarggaaaagataatggtgttttagagcagggtcatagaactgcaaagagaaaaagtggtcagattctggatratttgaaggtagagcaaataagatttgttgacaggctaggtgtgcagtgtgagagagaggatgactaagggagtaagagaatgcagtcgaggcagagcacagtggttcacacctgtaatctcagcactttggaaggctgaggttggtggatcacttgagcccaggagtttgagaccagcctgggcaacatggtgaaaccctttctctacaraaaatacaaaaattagccgggcatggtggcatgcacctgtagtctcagctactgggaggctgagagatgggaggattgcttgagtccagaggttgtggctgcagtgagccatggttgcgccactgcactccagcctggcaacagagaaagaccttgtctcaaaaaaaaaaaaaaaaacgaattgccatttgctgagatggcaaagattatgggaagggggtgaatcaggagctcagtgttaagtttgagatgtctattagacatcaaatggagatccatgtaggcagttgagaaaggtcctaaatggatctattaatttggaagttatcagcatctagataggagttaaagccagtccgtgaatgagacttgagatcaccaagaaagtgaggtagaacagagaagagggcgaaggacagatccctgaggcactccagtgtttagaggttagaaaaatgtgaagaaaccagcaactgggagactgatggaatagccagaaaggaaagaggaaaaccaggagggtgtgctatggagaatgtgtttcagagaagagggaatcatcagctgtgccaaatactgtggggacatctggtaagatgaaaactgagaatcgatctttggattgagcagtatgaaatcattggtgactctgatgtgagcagttagagtggatttaagaagagaacttgaggacagatatattgacactcgagttttcctttaaaaggaagaaaagaaatgggaagtagttgaagtgaaatccaggaagggttttctttaagaacagagaatgtttgtctgctgatgggactatccagtagagaggaaagaaaacgttaatcatgtagtagaagcaaggagaacttgtggagcagtgcttttatgaaagacttcagtgctaggagcagagacagttcatctgtggtcacaggagagaacagcaagcatttaggcacaggtggaggaaggtgggcaaatgtgtagaagcttgtggatattttctctgaatgctctccttttttagtgaaatagcaaggacctcagttgagagaggttggaggaggcagcacgagacgtttgagtggagagggaggctgagaaactatgtggaataaggaaatataatgaggaacatgttaaaatttgcttggcagcaaaatgaagatacagtgtcaaagagaaactcagcacaaaagcctgtaagaagtccactgctgtggtctaaataagatttgagcttctgaatcaggccagatgcagcattgttgatgtcattagcatataggtagtaattgaacccacatatgtggatgaaatggtctaaagagagcagagtgacattaacaattgatggcacaggatgagaagcccaaacttggaaggaccctccagggaaataagaggaaaccaagagaaagagggcacagaaaccaaggaaagagttttgtggagggagtggccaccttcctgctaccgcagagagatgggtgagataaggctccatgcatgacctgtaggttgattatctgggaagttacagttttggcgatggagcagggaagaaccccatttcactgttcgttaaggagtaaataaatagaaaccaaaagtagagacagtaaatgaagactgtacttccaacaaagataaatagtaaggcctttactaagcctggaatggcatttcttgcagaggcagcagcttctggaaagccctggaggcataaaaggacttagataagtaattttaaataatttaatatgaaatctaagtatatatatttcaaatatttgattcatttaattttttttgtcttttaaaactgacttgggtggggaaagtgaagtatgcttctatttaattctatgtgtaccttagctaacttttaaaaaataccctgagccctttttatatgaaataaattttgaaattgctgaagctcttgaaattggaaggtaggcagtagtagtcttttcagtaataatgtgctcccatgcctctctgctattcataaaaggattggatgaaacctccctcttttccctgctttgcttgtttcaggatataagtcaaagagtacagcagaaaatgtctactgaacggacttcttggacaagcctgtccaccattcagaaaatagccctgggccttgggatcccagccagtgcaacagttgcctatatcctataccgcaggtatagggaaagcagaggtasgtgaaccctatgactgtgtgtgtgaaaatgttcagacatgctcctgccttgttaaattgaaaaaaactctttccttgccaggtattgtgtgtgttttgttttggggttttttgtggggtttttttgagacagggtctcactctgtcacctagcctggcgtacagtggcacaatcttggctcactgtagtgtcgacctcctgggctcaagcaatcctcccacctcagcctccaagtagctgggaccacaggcctgtattttttgtagagatggggttttcccatgttgcccaggctggtcttgaactcctgagctcaagcaacccacctgcctcggcctcccaaagtgctaggattacaggcatgtgcctccatgcctgacccaggtattttaattgactttctgtgaggaatctttgactaaaattatttagtcttttttttttctttgagacagagtctcactctgtcgcccacactggagtgcagtggagcaatctcggctcactgcaacctctgcctcccgagttcaagcagttctcctgcctcagccaccctagtagctgggattacaggcgtgtgccaccactcctggctaatgtttgtatttttagtagagacggggtttcaccaccagggtggctgacctcaagtgatccacctgcctcggcctcccaaagtgctgagattacaggcatgagccactgcacctggcctagtctttgctatgttcttacatagcaaagtaagctagtctatgaaatgaactcattttataactccattgatgtgctttcttcagcaacatcaacacagcaaagagttcttttttaatttctatactcatcttttttatatattccttttctctaattagttgttagtagaaggcacttacctcaaaggctggatctagagaataggacctagagaaatgacttatgtacctatcagtcaggagaagttctgagcctaatggacccctcaggtaacttttggccttcattcttctccagtagtcatgtcttgggagaagtagtttgcccaaaccccagcacctgtttattgcagaatctgcttttcccattttagcatctgaaacagtgtcccagagaaaatgcccatctctgatcctttgggaccttctaattcccattcagatgccacttttccttgttgttatggttgagatcctcactttatctcttggatcagtgtctctttgacagccagattctggggaggactggtagttatactrgctttgggtgttatctaagtctgatctgatgaacaatgatctgtgcagaagagcggctgacatttgttggggaagatgacattgagatagagatgcgggttccccaggaggctgtgaaactcatcattggccggcaaggagccaatattaaacaggtaagtgtgtgagtaggcagtctgctttcccaaggattgattctgttyattgatttcttgtttccttccactgaccccatatcacaaaacattcacatgctctgtgtgtgtgtgtatgtgtgtgtgtatatataaaatatatatatattttttttttttttgagatggagtttcgctcttgttgtccaggctggagtgcaatggcacgatctcggctcactgcaacatccgcctcctgggttcaagtgattctcctgcctcagcctcccgagtagctgggattacaggcacccgccaccacgcccagcgaatttttggtatttttagtggagmcgaggtttcgtcatgttggccaggctgatctcgaactcctgacctcaggtgatccgcctgcctcggcctcccagagtgctgggattacaggtgtgagccactgggcccaaccactatgtatatttttaaaagaacaaatagaggaactttttagctaactaaactttttagctacttcccttctagagaagagtacttctccctagagaaaggatgacttagcttgaaatacgggtttttgactgggtgattgtcagcatggtataacttgaattatcctttttttttttttttttgagacagagtctggctctgtcacccaggctggaatgcagtggcatgatcytggctcactgcaagctccgcctcccatgttcacatcattctcctgcctcagcctcccaagtagctgggactacaggtgcccgccaccactcccagctaattttttgtattttttgtagagacagggtttcaccatgttagccaggatggtctcgatctcctgacctcgtgatccagccgccttggcttcccaaagtgctgggattagaggcgtgagccaccgcgcctggtcaaattatccttttctactatggaattaatgaactctcattaattgacagtaaatattgaatggctacctggttcttcttaccatcttccattgttcagctgaaatgtcaagaaaacaaaatatttgattctctaatccaaataaaattagtaaggggaaaggattctaaacacaaagataaatgggtttgaatttactgctatttggggttacatttgttactaatctccttccataaagtgaggactggttgtatagatagtaactgaggttgtatataaagtaattgaggactggttgtatagatagtattagctaattcctttggctaattctatctacctccagggtttgttttagagtgtctgtagctgggctcaaatgggagctcttccagaatgtactgccaaatgtccttttctttgcagctgcggaaacagacaggtgctcggattgatgtggacacagaggatgtaggcgatgagcgagtgctgcttatcagtggttttcctgttcaggtgtgcaaggccaaagcagcaatccatcagatcctgacagagaataccccagtgtctgagcagctttcagttccccagagatctgtgggcagaatcataggtaccactggatggcttcctctattgtttcctttattctttacytttgcccctctttcacaccttcccagggttttttctggcctagttccccttcaccatgtgaggggaaaaaaagggacattgagaccagaggtttactgtttgtagaactggtggtaaaaccaaacctgtttcctcaagaagttgtatgatctgaaccttacaaattgattctttaagggttctagtagatgtattatatttaccttataattgatttttaaagggaagcttgggatgctcatgttatctcaagtctttcaagacagtgctctagagggtaccttttatgctttcccctagagcattgcttagtgctgctgttagaggcagagaaatgtcctgtccttgatccggtgttctgacacactatgtagcatatcttcttgtgacctgatatggccatgctgagtggtcaaaatgaaaatgacatgaagttagccaaagtgtagagtttaaataaaatggaaaaaggaaagaatatggtattctccttttcacagtaatgatttcagtagctcctgatttccattcaacatcttgtattttgttcactttagaaatgagaactgattctcttctcctagtatatacaaaacagtgatttctccagtagctaaggttggccaggagggaagggcaggtttttatatattgtttaatgtagggagaggcggcgagacaattcgttctatctgtaaggcatctggagccaaaattacctgtgacaaagaatcagaagggacattactactatcaagacttataaaaatctcaggaacacagaaggaagtggcagcagccaaggcaagtagctaatagacttgaattatacctgagcatgagaagatccttttactctatcccaggtcagaatatcatcctttctcttgttttccacagcatttgatactggagaaagtttcagaagatgaagaacttcggaagagaattgctcattctgcagaaaccagggtcccacgcaaacagccaatcagtgtgagaagagaagacatgacagagccaggtggagctggagagccagcattatggaaaaacaccagttctagcatggagccgactgcacccctggtgactcctccacccaaagsaggaggcgacatggctgtggtagtgtcaaaggaaggttcctgggagaaacctagtgatgacagctttcagaagtctgaagcccaggccatcccagagatgcccatgtttgaaagtatgtaacaaagagggagcccattaatcattgaagatagaaatactggcttagatattggagagattagaaggaatgcyttctcagtctgagcagccagtataatatggctggggtcaggacagaagattcggtaagatattttgaagatgggatggaggtagaatccacaccaacagttgctggacagtttgaggytgcagatgttgatcactgaaaatgatttatgcaggtataagattctgctcctaattgtaggagagaacttggtgcctcttccactctgaagcaaagttgatgaaagtcttcttccttttccaaaacccaacctgaactacttctttcttgagacagactatattgagacaagttgttaccagcaaaagatagatacatgacctttattaacaaaaatgaattaaccaagaggatatttgtagtttattatttaccccaaactttctgtgtctgggtaccctctgagtaggcctataattcctgccttcactgtatgcattttmtgtaagctagcagacctatgtggtgagaatgcacaggagcttggaggtataaatagacagggtgggaaagagagagctcctttcrccatgttttaccagcccgctctgttataacctcttaggttatattctttaatttccaaccttttaggttagtttctgtaacagaacaaatgagtctgggataaagtcctcaaagtacttcaratggtaattgttttgtttttgtaacggcttaacaaataacctaggttttctgtttaaaaaaaaaagaaatactggcttagggcatggtggcgcaacctgtggttccaactacttgggaggctgaaatgggagaatcacatgagcccaggaagtcgaggctacagtgagctgggattgcaccgttgcactccagcctgggtgacagtgagatcctgtctcaaaaaaaaaaaaaaaaaattaactatttttttaaaaagaaatactggcttagattacccaaaataggaagcaataaaaagtcttttttcatgaatacacttatgtctatcatcacagatattccttactggtaataatattttacttgaattaatactaaacataaatatttttctaaatataaaacagctgatggaaatggcaaaataatgctgacacaggaaacaaatgagtaatacatcaaataattggatttacatgatattgttcctctagacatacttttttttttgagacagagtcttcctctgtctcccaggctggagtgcaatggtgcattctcggctcactgcaacctccgcctcccaggttcgagtgattctcatgcctcagcctcccragtagatgagaccacaggtgcacaccaccacatccgactgatttttgtattttttagtagagatggggtttcaccatgttggacaggctggactcgaactcctggcctcaaatgatccacccaccttggcctcccaaagtgctgggattacaggcatgagccaccatgcccagcctagacatactttatcaacaagtaaaattctcagccagattttatattgcctttttcattactgtttttaaaaatcatcactattgaaaaggctgtgagctttctcttctgtacataggttttggygtgggcaaagaggacctggrttcccaagaagctcacagacttgtccagggtcatgtaaagagtcagtggtagaatgggatctggaacaggtccatgtccgtcactgtccatgtaaagattgctgtccatatacctttttactgatccatgcygtagctagcatatggaggtttaccttctgtataattggtgaccgatttgamtatgtagcacatgacaaagaatgtaagctgttattactcagttacatggaaaggtacaaaggatagcttagtatctttctttaggatattcttgtttgattcatccagttgcctctcctgccattttaaaatggtaacagccattggtatttgtacctctcactaccctggttagtctcttcattccaaccagagatgggtctgatgtggccaccatccttatctctgtgttcagtccccagtcctgacttcagttttcatgctgatgagtacctagaagtctacgtttctgcttctgagcaccctaaccacttctggatccagatcgttggctcccgcagcctgcaattggataagcttgtcaatgagatgacccagcactatgagaatagtgtggtgagttgccatagggacagggctggggtttaatgaaaagaaggcatatctttttcattgtactcttcctttccctgtggagcaaytacttttctttcttcctcctgcaattctgtttatgagcctaccactttgtaactctctgcctttctcctcctccccacatacagcctgaagacttgactgtgcatgtaggagacattgtagcagcacctttacctacaaatggttcctggtatcgagcccgggtcctcggcaccttggagaatgggaacttggacctctattttgttgactttggagataatggagattgcccactgaaggacctcagggctctcaggtcagtgctgaggtcagctcaatcccaactgctgactcagttctggccatagggtggtgagctgttggcagttgtcagggggatttggaagggaacctgtttacagagagcagatggttatcgtctcatgttagttggttctttctkaaagcagcaatgtaagaagatgtttttggccccaggattctaattttagtttcttttacttcaggagtgacttcctaagccttccatttcaagcaatagaatgtagtctggcacggattgctccctcaggtaaattggtcatgccatctattgagcttacctccaaatagaataacttcatacagttcattggaaggaattctcacattcccaggctttttgaattctggggactcaggtgccttttcctcaccagcactagcagcagccagaaacttgcctggcagacccaacccaaccagagaagacacaggtgccttcctgagtagaaaagggtagttccaacttccctccagggtataagccccacccctatcagcagtaacccctacaatcttttgccaggtgaccagtgggaagaggaagctttggatgagtttgatagactcactcaytgtgctgactggaagcctctggtagccaagatctctagctatgtccagactgggatctcaacttggccaaagatctacttatatgatactagcaatgggaaggtaagactggcattcactcactgcttgccatatcttcagtatatttatagcctaatttactttttcttyctcagaaacccttatctgatattactcttactgtaagatccttctcaccatctcaccaaaggaatrtctttaaagtatcagtccttctgccttgtttcctcaaatttgcccttgcttactgagagaacatcattcccttttcatttttcttctcagaaacttgatattgggctagaattagtacacaaaggatacgcaattgagcttcctgaagacatagaagaaaacagagctgtcccagacatgttgaaggacatggtgagctattgtagttatatagggtgctgcttccaggcaaatctagcacatagacactaagggcttctagtcctgatactgtgttagctttcctaaggactttgagctcctccagtagttgaccaaaggagcattttgtccctcttggtagccaaatgcaactgccttaaccaggtcctatgagaagaatgaaagggtggcctcttttttcctaaaagccaacatgttcctccttttttcctgttttcatccactcaggccacagaaacagatgcctctctcagcacgttgctcactgagaccaaaaagagctctggagagataacacataccctgtcctgcctcagcttatcaggtacaagcagtatttcctccctagagcatctttggagattaacttttctcattcagtctttccagagtagggaggttaattgaaggcttggttcctagtcaggtcattgagtaccaagaggtccatttttcttttgagcctcrctggcattgcctgctagaatagggcagtgtctaactttctccttcttatttatcttcaatagaagctgcttccatgtctggtgatgataaccttgaagatgactacttactctgaagtctgggcttcagtttgctcagccatctgctttgctgtgtgagtgcagctatcatctatctgtagcaacaggaaagtaatgagggcgacagtggggcacttgctttgattccctctttcccatgccctgtcttaatatacttctctgcagctgctttcctgcagcttaacttgctctcagattgagcactttcaagctttttgtgtatttctgtctttggcaggatttggcataggaattggtgcatggaggagaggagtgtatgataaaggatccatgcagtccttcctttattacacatatagtctggcttgctgtggaccaaattaatattctcctcccatcagactacaaaaaaattggactaccacgctacaagtgtgtctcccccattccacctcckgatccctccccaaccctccagtgtttgaatactgctgtgttacttccaggccgttcaacgtcaggctcagtcccctctaccagtcatgattcacattactactaggctgtatcctttttgaggctgggaaacagtcaggctttcgtcattggaagtgattctgcagacttctgactcaccttatcaggtgactctggttaaggaaagcttttgagtggtgaactcaaagactccagttgaatcaggaggcaaaggcaaaaattagcataattatatttaaaagcctcargaagtgggaagagaatactgcctcccagcctcaattgctgatatgttattggagacaggcttttgaaactgctccagctatttctctgtaacctttagttaaaatataagtagaaaggagacaggaggctcaggaaattttytaaattgctagtawaatatctatatgtatacmcacatatacacccgtggagagagaggaagagtatacagtcctgtttgaatcatttggaggatttttttgctgaataaagttctcaagaaaattttctaaaaccaaattctgattgaatcacaaggtggaagcaggctgtgagcctaaatctggtgaaaactgccaactgcctcacagaaaggatcacatctatgaaacaagtgtccctcccatatacacattcatattctttctctaaagtcacttcagaaataaccattcactggctgggcacggtagctcacacctgtaatcccagcgctttgggaggctaaggcaggcagattacttgaggccaacatggtgaaaccctgtctctactaaaaatacaaaaaattagccaggcatggtggcatgcacctgttgtcccagctgcgtgggaggctgaggcaggagaattgcttgaacctgggaggtggaggttgcagtgagctgagatcatgccactgcactccagcctgggtgacagagagagactctgtctcaaaaaaatacaaaaatacaaaatacaaaaattagctgggcgtggtggcaggcacctgtaatcccagctatttgggaggctgaggcacaagaatcacttgaacctgggaagcggaggttgcagtgaacccagattgcaccaccacacaaccttgtctcataaaaaaaaattcactaggaaccagaaccaatttaggtttaggctgtgtgagtaagaccccacctatactattcaaaagaaaaggcccagattaagattctagaaacctggattctaggagcagctctggtaagtagctcatgtagtcttggaggaatctttaaggagtagatctccactgtaaactttttgcaaaattttaacgtgtttccttatagcatctttctgacagtactgtgaggctcaaatgcgaggcttgaagtacttgaggtgcttgaaagtaaatataaatgtatagtaatgtggatggtagaaaaatggcaagtgaattttttttaaggataaagcaagataaactagaaaatttaaaactagcacataaggatgccttacacaggtcttttttttaaatttagggattagtaacgtctacctctatactacatggcarctatattttctcacaaccacaattctcaaaatttattttctcagaaaaatctcagtattagccaggcaccggtggctcacacctataatcccaacactttgggaggccgaggcgggcagattgcttgagctcaggagttcgagaccagcctggcaccatgctgaaaccccatctctaccaaaaatacaaaaaaattagccaggcatggtggtgtgtgcctgtggtcctagctacttgagaggctgaggtgggaggatcgcttgagcccagggaagcagagggtgcagtgagtgagccaagattgcaccactccactccagcctgtgtgacacagcaagatgctgtctccaaaaaaagaaaagaaaaatctcagtcccaattagcagaaaggctctagtgaaggaacagttctggtgagtagttcaggtactcttggaggaatctttaaggagcttccatttatttgatgtttcagatgttgcctgcaatgaactcgctgaagcrtgctcagccctggaactggtgctaccagagttccgtagggaacctttactctttagaggttccctgatataaatcattcataagacttcctaccctggaaaatgagtaatgtctcattcttacctgcagtttgttactatgtataaaagtctttttctttaatatgcctttaagtcttacctgtttacagcccattctgatgggttctttgtcattctgttagtataacccagtacttttcctgctgcctggaatgccctcttctrtgttacctattctgtccgttgagatcccccaacttgggccaaagccaagagatctatgtgccttctctggttttctccacatctatagcacctcaactgaaatatatggataaaaacagcctaacaaagctcagtctttctgaactaggaagttcactgattagtgctcagtaaatggttagaataaatggggaaatagtttggggcatggaggaaggcaaagggaaccaaaaatccttaggtactttcctccgtagttcaggtccctgtgatcttttcagtgaatttagctctgttaaggtgtatatcccactccagtcaaccctattacccacccccccaagaaaccgtgaacacttgatgattgcactaccctttattcctaggatggaaagtgtcctgaatcacatcccgggcccctgattccatgtgtcaaggcttccagcccctcaaagcgttggaataagcatgttcaaggaggctcactgggcaggtggccaacatccctttcaaggggatacaccataaagatgacattgtccaagggagggagggcagggtgatctggtctgaccacctcaaagcccatgtagctgaaggcccgcagcagggcacctgtgaaaggatagaacaaatgattagaacatgctttaaaactcaatacatgtatgcccccagatttgatttcttccactagggagtggccctgggaagcagtgtagtgcaggcatataggatgtgctttagtccaacagacctaggctctaactctggttttaacacttgttctgtgagttagtcctgcagaacttcagtttccatctatagaattttccatttataaatcatagaaccttcctcctcacagaatttaagatgaaatgagatgttcatgaagtgcttaacactagagattagtgaggtctacctatatactaatacaatgatggcatagtaagctctgaaatagtatctatcacttatgaatggttattcaccatcccttatatccaacagagtttgagctccttgaggcaagaggctatagtttctgtaacatatgctccaggcatccggttaaatatgtccccgttcccttggccttatgtctgaccctttcacattgtaggtgctccatatgtttgagatccattttgtcctgctggccacatcccttgaatggattctgtgtaatttcaccagtgctccttcagtctggcccctaacaccacctgcaggggcttcctcagagtccagttgtaacttgatggaacaagttacaacttcccaccttcgtggtaggtgggaagaaaagaatccctgaaatgcctgagggtgcatttttaaagacaggggaagagggtctcctgtaaaggaaaaggagttatccagctgcctcagcgcgaaaagcaaggaagaacagcagatccccacctctgtcgttccgatcattctggaagttcacaaacacagagtccacatttgtcttctcttccacgtactccagggttgcagtcaaactaggagccacagaaaaacagttaaaatgtttggccgctccctctccctctccctctccctctccctccacggtctccctctgatgccaccaaagttgtgaaagccgaagctggactgtactgctgccatctcggctcactgcaacctccctgcctgattctcctgcctcagcctgctgagtgcctgggattgcaggcgcgtgccgccaygcctgactggttttcgtattttggtggagacggggtttcgctgtgttggccgggctggtctccagctcctaaccgcgagtgatctgccagcctcggcctcctgaggtgccgggattgcagacggagcctcgttcactcagtgctcagtgttgcccaggctggagtgcagtggcgtgatctcggctcgctacaacctccacctcccagccgcctgccttggcctcccaaagtgccgagattgcagcctctgcccggccaccaccccgtctgggaagtgaggagcgtctctgcctggccgcccatcgtctgggatgtgaggagcgcctctgcccggccgtcatcccgtctaggaagtgaggagcgtctccgcccagccgcccatcgtctgggatgtggggagcgcctctacccggccacgaccctgtctgggaactgaggagtgtctctgcccagccgcgaccccatctgggaggtgaggagcatctctgcccgtccgccctgtctgagaagtgaggagcccctccgcccggcagccgcctcgtctgggaagtgaggggcgtctccgcccggcagctgccccgtccgggaggtggggggcagcccccgcccggtcagccgccccgtctgggagggaggtggggggcagcccccgcccggtcagccgccccgtccaggagggaggtggggggcagcccccgcccggtcagccgccccgtccgggagggaggtggggggcagtccccacccggccaccgccccctccgggaggtggggggtgcgtctgcccggccgccccttttgggaagtgagcccctctgcccggccgccacaccgtctgggaggtgtacccaagagctcattgagaatgggccatgatgacgatggcggttttgtcgaatagaaaagggggaaatgtggggaaaagatagagaaatcagattgttgctgtgtctgtgtagaaagaagtagacataggagactccattttgttctgtactaagaaaaattcttctgccttgggatgctgttaatctataaccttacccccaaccccatgctctctgaaacgtgctgtgtccactcagggttaaatggattaagggcggtgcaagatgtgctttgttaaacagatgcttgaaggcagcatgctcgttaagagtcatcaccactccctaatctcaagtacccagggacacaaacactgcggaaggccgcagggtcctctgcctaggaaaaccagagacccttgttcacttgtttatctgctgaccttccctccactattgtcctatgaccctgccaaatccccctctgtgagaaacacccaagaatgatcaataaatactgggaaaaaaaaatttggccaactcagaatccagaaagacacctacttggagcagtaaaaatattattggtcgttttctgccctccacccacccaagccaggaaatgaaagttgctaaactagttttggtagatttttcttggaagccaagagattgcacatcactggatgtaagccacagaaggggtctggggagaaaggactactgagatgaacagctagaaagtacttcccgttattcaactatttctggatctgagtccagcttcccatggactcttatcccttgaaccccagatcctggctcagctcacaggcttgtctgcatgccaggtgaatggattgcttatatctagctccagaattagccttatgtactatgacatgatagaagggtgaaatcccctacctattccctccccattctcccatccaggctcagtcacctttcccggttgccttgatccaaggcctgatatgggatatccargaagagtcgacggtcacagagaaggccgtgccaatgggcagaggtctgggaggtaaggcggaagtgaaagtctaactgtactgggtcctggtggagcagggggtcagtagccagcaccgtcaagttcccagcctggaaaaggagtaaaaatgctcctctagtcttcaaatcagacctcaggcagattggggtgtgtccgttgaagcaaggtgggcattgatggggagagcctgggagaattggagccaagatcttaaagatgcaataatatcccttagtcccaggaactaatagcctatgcctattgtggagttctcctttatatcaaacaatccagctgaggcagtattactgcctgttgacttcaacccaggagtacaataaccatttaggaacttagaaatgtttacatcagagagcttaggatttaaacaaagctttataatgtgcttcctttctcactaataatttccacttttttcattatatgggttttctctaaattcttctatttaaaatgccatggttacaaccaggcttgttattgcaatatgatatgtgggcaagttctggattccagatcctgcttagcatctttaagcaggatcttggcataaacagctttatgtcccagaagtcctacagagtttgttttacctttgtccccactccctcttttcccaatcctgattttcactaccatctgtatgaccttgattttacagtctgtgggccagaatgcttgtctatatagcaagtagcttttacacatgcgttccaagattccatctacctctgtaattcatcttccaacttgctaatgtccctcctctgcaaggtatgcaagaaaagggttgccctgtcacagcactagctcacagtccacttaccgaatacagttctttaagctggtcgtggttaccctgctcggtgcttttgccctcctggaggcctactagggactcaggagcactggaggcaggaacggggctggagtgtcaagtcctcctcttccttataagtgatgctggttgggaaagagacccaaattagtttatcttggaatctgaggtgggaagatacacagtaccaggctctggcatgatcttctgtattttctgttgtccagcctgtttctatgttcctgggcccaaccagatggaaaaattctaaagttccatgccagctttccaccccctattctgttgttatttcttgccatttgggaaattctttcaaattcttttactttttccttacattttatataaacaactacaaatagagatgaaaacaagtaccttttataacaacgaggcagcatcttctcccggagagtgatccggtacttgtaacagtaaaggtaataggcgtatggtgaccagatcgggtagaggtagttacgtgtttttcccctcttgatataagaaagggagtagacagaggggcgacacctcttacaaggcagtttttcagttcagtgcctccctgtggcaaagtgaagttcacaggtgggtggcagaggtttaggcaacctggtggcattgtgacccagtgggcactatgacatggataaggggtcagcccttatgtcacctcaggactccactctgctgcttatctaccctaatcccttatccaaggctcatattcgactagtatgcatgttatggctgtatgaatgattaaaaaatagaacttgaagacttctgtactggttggccaaaagccctgcctgagcacttgtgcccacccaccctgctcctctgtggacactccccttcccccaaaatccagcaagtaaagagttggtatctgactcttccaaggctctgatccagtggtgacctgattagttggttcccagttcataccagttgagtatttttattatcatccctacccttaataacccaggatccttgtagggtaggaattgcaaactaattgtctaggccccttcaggggcctagacagcttatggaaattagtggagtggcagggtagggctgtagcaaaataggaaagctcacacgttatctaaaggaagtccacacaactcaattccatccagttccatgcaagaatgcagacttgatggtgctgtatcgtatgatttttgaacagaaactggaaagacagttttgtagtaaatctcaccaattttaaaaaatatcgactactgggccgggcacggtggctcacgtctgtaatcccagcgctttgggaggccgaggcgggcggatcacgaggtcaggagatcgagaccatcctggctaacacgatgaaactctgtctgtactaaaaatacaaaaaattagccgggcgtggtggcaggcgcctgtattcccagctacacgggaggctgaggcaggagaatggcgtgaacccaggaggcggagcttgcagtgagctgagatcgtgccactgcactccagcctgggcaacatagcgagactccaactcaaaaaaaaaaaaaatcaactactaaaaaattgttgataaaaaaacaacattgtaagcaaaatttggttctgggactgccactttgagacctctgcata

SEQ ID NO: 12194 - DNA, 18108 bp, Homo sapiens
gagtgtagtggtgcgatctcggctcactgcaagctcttcctcccgggttcacgccattctcctgcctcagcctcccgagtagctgggactacaggcgtctgccaccatgcccggctaatttttttttgtatttttagtagagacggggtttcaccgtgttagccaggatggtctcgatctcctgacctcgtgatccgcccgcctcggcctcccaaagtgctgggattacaggcgtcagccaccgcgcccggccgggagtttcgctcttgttgcccaggttggagtgcaatggcacaatcttggctcaccgcgacctccgcccacgggttcaggcgattctcctgcctcagcctcctgagtagctgggattacagccatgcgccaccacgctcgtctaattttgtatttttagtagagacaaggtttctccatattggtcaggttggtctcgaactcccgacctcagatgctctgcccacctcggcatcccaaagtgctgggattacaggcgtgagccaccgcgcccaatcagcctttgcctttttctcctgtccacagagaccccgcaaacaagcgcatcagaggatctgggtggtgcgagagcctcctacagcagccaggtacacacaaggcctcagtttttccatctgtgaaatgggtacgtggacagacctgtccagtagcctcccatgtgagaatcctcggactgagagggtactaggagggctaatacagcgcagccctgtgattccccacctctgtccctggaatgaaggaaatctgggtgttagttctggctttgccgatgcctcttgggtggcctggctgaaactaatctctcctcatcaggccagaagggaatctgtgaaatgggctttgaaacctgccttgcctttctccgcccggtcccagcgggggtccgatcggcatcaaggattcacccactcccagagccttcgggatcagccccaccccatcagcaggacacagcccatgccactggaaatctcgcgagaatcccgcgctgaagcgaagtcgagacgtttgaccttcctccgtttccgtagttccgagttgcggtttctccgttagtgcttccgrgttgcagccagggaagcctccgcggtggtgcaagtggaacccaagccttgaggtttcagtgagtagggggccgacgtgagctttagcgtccccctttagcctccctcttcgattccttgaagaccctggtgcagcttagcaagagggcccaggatttttggatccccagccctgtgacaagggttcctgtccagtttccccctcccaggatttcgactcagttcagcgaagtcaccgccccgtctgagaaatgaggacaccaaggcttagagcacagccccgaggcgccgtctaccaggccccgtcccctcccccggctcctgtcggtcagcactgaaaccccgtccctgctccaggcctccttctctgkggtccaaggtcccatacaggcctctgcctcggccgcaggcccttcagtcaccgtcgcctcgtctccctgactgtccgcaggcctgggcagcatggccgtattccggtcgggtctcytggtgctgamgacgccgctggcctccctagcccctcgcctggcctccatcctgacctcggcggcccggctggtgaatcacacactctatgttcacctgcagccgggcatgagcctggagggcccggctcagccccagtmcagccccgtgcaggccacgtttgaggttcttgatttcatcacgcacmtctatgctggcgccgacgtccacaggcacttggacgtcagaatcctactgaccaatatccgaaccaagagcacctttctccctcccctgcccacctcagtccagaatctcgcccacccgccagaagtcgtgttgacagatttccagaccctggatggaagccagtacaacccggtcaaacagcagctagtgcgttacgccaccagctgttacagctgttgtccgcgactggcctcggtgctgctatactccgattatgggataggagaagtgcccgtggagcccctggatgtccccttaccctccacgatcaggccagcttcccccgtggccgggtctccaaagcagccggtgcgtggctactaccgtggcgctgtcggtggcacgtttgaccgcctgcacaacgcccacaaggtgttgctcagtgtcgcgtgcatcctggcccaggagcagcttgtggtgggagtagcagacaaagatctgttgaagagtgagtaagagggaccctggactagggtggaggatccccaaatctccccacccccgacccttatgccgagatcaaggaagggtagggccattcattacttcccacccttcccaaatgtcacagtggttgacactcaattggtgctaaggccattttgtcaaatgaacagctttctcagcatgtggtccagtcaccactcaatcagaataccccaaatgtgaagcaaaggtatctgcattttagcaagttttccaggtgatacaccctaatgagacactgggaatgaatgggtgagtgagctgcaggtagcagtgccacagacaggaggaggaaactcaagcatggcatgggtcttggaattttccatctgcctctgatgccctctggcactgctcgttctctggagtggtttcctggtggcttattctctggacacatgccagcccttggagtgactattgtgcttgcctgtttcttcaccttcatgctcccctcaccatcaccataggccttaccagttgaaccctttctgccaccccctctggggatactgtacttagggacactttttcccaaactggcccatactctcctccccaataaaaagatctcactgttcttctgggctccttccccaggcaagttgctccctgagctgctccaaccttatacagaacgtgtggaacatctgagtgaattcctggtggacatcaagccctccttgacttttgatgtcatccccctgctggacccctatgggcccgctggctctgacccctccctggagttcctggtggtcagcgaggagacctatcgtggggggatggccatcaaccgcttccgccttgagaatgtaacccctgagggagactggcagagggagtggatgggggacggggaaggccattttgagggggctgttggaagtaccatggccccagaggagagaagtgggggctcagggtggtgggaagaagcaaggaggaactggttctcagtttgcccgctgagtcggaggaggaggagcctgggtaggaaggggaggatgggggggcaggttggatgtcagggtcttcctctcactccctccttccctctttttaccctttcctctttaccccaggacctggaggaacttgctttgtaccagatccagctgctgaaggacctcagacatacrgagaatgaagaggacaaagtcagctcctccagcttccgccagcgaatgttggggaacctgcttcggcctccatatgtaagctcctctccctccttccctcctgcttggtgtcctggcaatgctggagagtagaagctgaggggctcagccccaggcatgaggctgagggccccagtaactgtgggttccctttcacctatccccaggaaaggccagagctccccacatgtctctatgtaattgggctgactggcatcagtggctctgggaagagctcaatagctcagcgactgaagggcctgggggcgtttgtcattgacagtgaccacctgggtcatcgggcctatgccccaggtggccctgcctaccagcctgtggtggaggcctttggaacaggtaataactggggaaggctgaaagtggcctggagtgaggagctagccaggcctctgtgctcagttgtctgtctgtgttgtccagatattctccataaagatggcatcatcaacaggaaggtcctaggcagccgggtgtttgggaataaggtaaacaataacttcctaagggctcctaagccgctactagacccaggggtcagggtccagtggacctctctggtctggcccagaatgccatttccattgatctgttcccaacaccaccttgctcgggctggctgcctcttctagagaaggtaacctctgccctctgttcccctccccagaagcagctgaagatactcacggacattatgtggccaattatcgcaaagctggcccgagaggagatggatcgggctgtggctgagggtgagtgggagggaggatggcaacagctaaggggacagttaagctgtttcttcccctgggagcttccctgcccaacgtgggactgtctgttcaccctgggactgtgttctgcctgggagaacgtcggcactgctggcggtgactggggtctycccacaggaaagcgtgtgtgtgtgattgatgccgctgtgttgcttgaagccggctggcagaacctggtccatgaggtgtggactgctgtcatcccagagactgaggtatctcgccccaccccccacaccatccctactgcagatcctatcctgtgagctggaattcttcctgacaaatgtctcgtctgtgstcaggctgtaagacgcattgtggagagggatggcctcagtgaagccgcggctcaaagccggctgcagagccagatgagcgggcagcagcttgtggaacagagccacgtggtgctcagcaccttgtgggagccgcatatcacccaacgccaggttggtgcccagggcaaggccgggttgtggggaaggagtctccagtgggtactgcctgaccctgccctctcttcctcccaacatcctggcctgtctgaaggtggagaaagcctgggccctcttgcagaagcgcattcccaagactcatcaggccctcgactgaaaagttctcagtggggccagactggctcctggagctgacaagcgaccccgtggtgaggagaaatgggggccttgatgctcaccctggttcaggcccagaggtccaagctatactgtgcaggacatggccaggcctggtggacacaggaagcctacccaacacgctggtatttggccaacactgaggatgtggttcatgggggagcagtcccctccccactcttgcccatgggtgactcttacccacagctgactagggccagcgcaaatactggaacctgtaacagaattaaaggtgaatgttctgagatgttgcttgtatggtgtctgcttcctgttccaatgcccctaagtatctttgggatccttaagccacaagtgcagggcccaggcctgagctggaagcctgggcaatgcagtggttaagagaatggcctttgaggctagccagaggcgagctttggccctcccactgaccagctgtgttcttctgagtaaggtgtagactttctaggtactgccgtgttttattgtttttgttttgtttttaatatgagaggccgcataacctagctagcaggttctttgcaagggttcattccacatgcatcctgccagacactgggctgggtgttggaagatcagccttccgcgcgccaggcggggcctctgccctcacagagcttgcagcctggtggggtcggacgatgtggctgggggcttctctgcccggttcctgacacaccggccagcagtgcaggtccggtgagcgcggggaggccgccctcagggtaacgtggggagccggccggccggacagtgcgcgtgcacacactatctgcggcggtgtgctgacaagccaattgaggggactccatcttacaaaacgcgcttcatgtcgccgccattccactgcctaacccggggagggcaggcacggcggggagcagtctcgaaggaggctggcgccaggccaagcgccgggccttgacggctggaaccgtggagtaaagtctttgggctgcgcatgcgcgatgcttcgccctgccccacctctcggtcgcggattggcgggcgcgggtcacgtgggcacgccacccgcttcctcgccgcagggggccmgcccgctggcccgtttccggtccggtgggtacaagatgacggagccgggcgcctctcccgaggacccttgggtcaaggcaagccccgtgggcgcgcacgccggcgaggggagggcgggtcgggctcgtgcacgtaggggggccggaagacgaggggcttccctcctgtccccaaagtcccccacgctctccgtgccccggggctgcagagaagacagctctcaccccgcgtgtgccaaggtggggagacaaacgaggcgtgtgcgcgcgagtcgggggaacggggcactggggtggagtaggggcggaagggatcatacacaggggaggcactcgcacgccctagcctgtgccagtctcgggggacycattaagctgcccgcgcaccccgggctgtgtgtgtgcaagcgcgcagggtgacagaggcgccttcccggaatggggggcgcgctgtgcgtgcctgcagtggaaggggcgcctccccctaggggcggaggtctgacgggcccttcccgtgctctgtgccgcaggtggagtatgcctacagcgacaacagcctggaccccggtgagtagctgccccatcttaagctctagagggacactcccgcccaggctctctagattcttgtggcgttgccaaccacgcctgagcacagtccactctccctgagcagagttcctggcttgagacagcaggagctgaaggacaagggcagaaaacaactgagggtgacacctagttccctctgctctggaacagggaagtggtggaactgatcactcaccactcagtggagcagctgatcactcacaccctcatcacgtccacatgcccgtttgtgagccaggggggtatcatgcaggcctatggagcagtgtagacactagggagcagagcactgcagcgtggtctggcaggaagtggggggcccagtatggttggctttgggttgaagggaagaggtcagcatttaagaaagccattgtgtggccgggcgcggtggctcacccctgtaatcccagcactttgggaggccgaggcaggcggatcacgaggtcaggagaccgagaccatcctggctaacacggtgaaaccccgtctccactaaaaaatacaaaaaaattagccgggcgtggtggcgggcgcctgtagtcccagctactcgggaggctgaggcaggagaatggcgtgaacctgggaggcggagcttgcagtgagccgagatcgcgccactgcactctagcctgggcgactgagcgagactctgtctaaaaaaaaaataaataaataaaagaaagccattgtgtcctacaggtgtctgagggtctggcaatgttccccaccccaccccttagtgattggggcctctcttttccagggctttttgtagaaagcacccgcaaggggagtgtagtgtccagagctaatagcatcggttccaccagtgcctcttctgtccccaacacaggtaggcagtaacatcccccccgacctcrgggggctcagatatgtcataattgtartacctttcctagacagggaagccccagccatccacacaggggtgctggagccaaagtatcagacasaaggtctcaccatctttcacctcatctggaacattaggtggttctgtccatctgccttctctggacaccaggttcttcccagctggggaaaggtgggctagctggaccccactgggccccaagatgacctttccctgcccccatctctgagcgtagatgatgaggacagtgattaccaccaggaggcctacaaggagtcctacaaagaccggcggcggcgcgcacacactcaggctgagcagaagaggagggacgccatcaaggtgaacagggaggcctgtgcctcagccagtgcgggagggccctgcatagtttagcttccctgtgccctgacccactcagayagtcccaggcaccctagggggtgggcaggtagtatagtcccaggcacaaacacctcccttgcagccttcccaccccattgagtttgtgagcatagaacttggtgtcatggaggaactttgtgccattttgctttaatctctcagggttaaagaacccatttcccctgctgtttccacagagaggctatgatgaccttcagaccatcgtccccacttgccagcagcaggacttctccattggctcccaaaagctcagcaaagccatcgttctacaaaagagtatggctagggaaagcactggaggggatggagccaagmggggctgtgaagaggccagtgcctcctacccacccatggctcggccttggtgtggtgattgccatgggatagttggggtctggggtaaggggaacaaagtcagccttatcttcttggttgagaatacttctgtacctgtcctttttttcttgcccccaccctagccattgactacattcagtttttgcacaaggagaagaaaaagcaggaggaggaggtgtccacgttacgcaaggatgtcaccgccctaaagatcatgaaagtgtaagaggggtgctgaatggggggaaccagaacttctgaggcamcttcattgcacaccctcccttgttcaaaggccacatcagttactgctgtacagataatactcttagttcctgagctagccagtaggactgtgtatccccaactgtccttacacatggcagacactcaggaaatgcctgttggattaatgtaaggaaggttggagagagagggccacctttcctgacctggaagcagtatctccctgatactgaaccccacccagaagctctctggggctgccattcctgggagtacacaggatagtcccgtcattcttcttgggtgggcggagctgctgcagcacctcagccctggcctgcatgcttttaggaactatgagcagattgtgaaggcacaccrggacaacccccatgaaggggaggaccaggtctctgaccaggtcaagttcaacgtgtttcaaggcatcatggattccctgttccagtccttcaatgcctccatctcagtggccagcttccaggagctgtcagcrtgtgtcttcagctggatcgaggagcactgtaagcctcaggtatggggcaacaataggcacagggtctgcggttttctctaccatcaagcaaagtggcccaagccatcagctgttgagaaaagcgtggcagctgcttttagatcttaagggcgtttctacagctttgagggccctggtattttcccttttctttgctgtctaacccacatcttcatgttacggtttcattcggcaagtgtgacgtgagctcaatgtgaagtccagctcttggcttttgtctagcccatgttatcgctgcccctgtatggaagccccaggcatctgcagcagaattggaaacgcaaattctgggaccctacctttaggccccctaaagtagttgccccaagagctttttaaaaatttatttataatggagatgtgctaatggtattgcactaagtcttctaattgaagtctggttgctttttctgaggttttaaacttgtgtctgagatttcttgtttgtttctcaacatttttttttttgagacgggagtctcgttctgtcgcccaggctggagtgcagtggcacaatctcggctcactgcaacctccgcctcccgggttcacgccattctcctgcctcagcctcccgagtagctgggactacaggcgtgtgccaccatacctggccaattttttgtattttttagtaagacggggtttcaccgtgttagccaggatggtctcgatctcctgaccttgtgatccacccgcctcggcctcccaaagtgctgggattacaggcatgagccactgtgcctggcctcgtttcccaacatttttattgtgaaacacattaaacatattgcgatgttgagaggagttcacagtgaacactcgtatacccgctccctaaattttaccgaaacattttactatatttccatctctccatcttgcttcaggagcacctcaaattaaactgcagacatcagtacttcctgggggctttttttttttttttttgagacggagtctcactctgtcaccaaggctggagtgcagtggtgtgatgtcagctcactgcaacttccacctcctgggttcaggcgattctcatacctcagcctcctgtgtagctgggattacaggcatgtgccaccacacctaatttttgtatttttagtagagacggggtttcactatgttggccaggctggtcttgaaattcaggtgatccaccygccttggcctcccgaagtgctgggattataggcgtgagccaccacacctggcccccggggggctatttttaaagcacttttctaaagtacatggctgatctaggcaggcatcttggaaactactctgcgttgacttgggcattgtctatttcttcctctgctgccctcgccagaccctgcgggagattgtgattggcgtcctgcaccaattgaaaaaccagctttactgaccggttcttggaaacctggagaacagccaacaagaggcccttgaatctctacgtggccactgaactgctgggcccgggagactggactacaacacctcacactggtcagctggtttstacttggtgtttggtttttcccagccccattttatcttcagcrgagccgcggtgtttgttttgtgaaagcttctgattaatttattatattgacgataaaactcaaacctacccagccttccccccactccatggaagtccttgggatgggcrtctgctctggacaccccaaagagctcctgccctctcagccctttattcaagcctcagatttctgctcatgatctacatagatttggaaactgttttcctctgttttggtctcttgggcaacatttttggcccaagtttgggcaacatttggcccaagtttgggcattttggcagtagctgtatgggagaaaaagagtaagaggaaatattcccacagccatgaagggtgaaagggcaccttgtgcctagactagggctgcctggtcagtcccaggtgaggccaagggctttctggccatctcagggaggggccaccaggttcctcccctcaccccatattccatcaccttcctcctctgctctgggtggtaagggaagccctccyggttcccacaggctatgatgctgcatggcagaggcaggtataacacagcactacatattggaaattttttatttttctaaataccaatgcagttttgctacggttacaattttgaaatattaactgagcctcaaaatcaccctttctgtcaagcatatcttggcctctcccatgtctcagtgttgcctgcatttctcccaggacttgggggtggggtgaaaagcgtacaaaagatacttaaaagggctcctggggtacacaagcccagcaggtcctgagtgaagccgtgggccctccaaatgctcgttttatagcaacctctctctaccctagttctccaaattcacttctgccttcctcaggtttgatatctggcaggtttgactatccagaggaaattaaatatttttatataaaattaaattataataaatattgccaaatgctttcctttagcattgttccaagtctaaatgttaacctcaagctactgcaatttagacaatgaaatgggctgggtctacccccagccaccagccctcatcctctctacccagtgctctggtttatgcttgtctcctgactgctctgcttaaaggtgaaagtagcaggaacaacaacaaaagccaaccaaaaacaaggtagccagtgcaagacatctcactcttctgacatcctgcagtccccaccagtcctgaccgtgggcccctcaggggtctgggagtgtgacgttgtaatcttcatccgtctctatcccaacttcctcctgtgagacagggagacaagtgaatgagatgtcaccaggataagaccacagggaagcaaagaaggaagagagctccacttacaaagaactgcttcttgctcttggggtatccttcaagtattgcatcagacagctctgtagcctgacaagaaataaaaccacccgttttcagatgggcagcactgggcactgcctgtcagtttatgatattgtgtagcggctgatctggtgcctgccattttcaaaggcacctccagggcctgtctcggagctcccacacacttaccatcctcttcctcttcctccactccttacagtacttctgcctctctctgtacacctagaaggaaaaagcaagttcctctaactcctcagaaccacagcagccctctggggctcagccctgatgttcactctggacctgcacagcggtcctacagccttccagctcacctgctctttctcttctggagtcacatgattggtagctgctttaatgttcttcaatctctctctgtagccagcgcattccttctttaactcctggatttctttctgcatctctggtgtggtcagggcactagataattccttgagctctgaaaccacatccccctggggtcacttgctacccctgaggaaggagttctgtctttcccagtgggtgctccctgaggtgttccaccttgctctggatctatcatctcacatggaaactaagccatacaggattatttattcttctaattttctttcttcctccatctacaagtggcgtgggtgtgaggttgaacacttacttaggcgtagccagttaaagaagcaggaataaagggaaacgtggggacagtgtactgataatcgtggcagggagaacaaatgcgtatcttgtccatttgttggtacacaaaagccgttagttatcctacatttctttttatgcctaagggagcccagcaaaggggtcttagctgcaacaagatgctgcagtcattgaaccattcatttagtaattcctgacctctagaatgaacctaagcctatgggcactttggaggggctacccagtcctaccagcctccatgtagcggcagctctgctgcaagctctgcaccttagcagtgagggccacgattttgccatctaggacttgaaggtcagcatcactcaccatgtcaaactggtcctgccagacaaagagggaaaatacaagtgaactgttgtgaggcacaaagatgggaacacacacctgggaaggcaccatttggatatgctcaggaaccagccacaccccaaagtctccagagggtctgcagaaatagtgggagagtacttttgagaaattgttttcagttaaggagcggccccactaaaaaggtaggaaagaaaagctgaaatctaatgcttgtccttaagctactaggttgacaggatactgattaggacagaaatcttcccatttagtgataaaaccactacctgggctgaagcagttaagtaacattgttcccacggtggggaaacctagatcatgggtttccataatagatagaaactggacaggtgaagaagcatgatggatgggatggatggacttcttttcttcttccttcctgtcctttcttcccatccttctttccaccttcctctctccctccttccttccttcctttttcctccctccctccctctttctccctcccttccctcttttcctctctttctttctctgtcacccaggccagagtgcagtggtgcaatcttggctgactgcaacctccgcctcctggcttcaagcgattctcatgcctcagcctcctaagtagctgggattacaggcgcgcaccaccaagcgcagctaatttttgtatttttagtagagaaggggtttcaccacgttgcccaggctggtctcaaactcctgggctcaagtgatccatccgcctcagcctcccaaagtgctgggattacatgcatgagccactatgctgggtcttgggatccatgtagataagggattccagtaagtctgaggagcttctctcatgaggggccattgctagaaaagaactgcactggggatcagtgtgggggtgggggaggtcacatcagttggtgatggggagcaggttgaaaaagtatgccagccagtgcagtctggactctacacttgggcaaggtgaacctatagggcagaggccagcaaactatggccagcaagccaaatcctgccagatgcatgtttttgaaaacaaaattttattgaaacagccccacccgttcatttacatagtctacagctgcttctgttctacagtggcagaggtgagtagttgtggcagttgtacaggcagccatgacaagagatacatatggcccacaaatcctaaaaatactgtctggccatttgcagaaaaagtttgccaaaccctcctttagagaattatctttagatgagtaacacaatgcagcctgttttaggaaagtcagccttaaaagtggtttggttcagtttaacgagtaatatctgctggatgttagatactgcggaggtgctgatcagataaaaatgaattgagaaatggggtctgccctagaggaacttcagttgaataaaggagacaagtaaaaattgtaatacagcatgcctcaaaagaggtaagggccaggctgggcacagtggctcatgcctgtaatcccagcactttgggaggccgaggcgggtggatcacgaggtcaggagatcaagaccatcctggctaacacgatgaaaccccatctctactaaaaataccaaaaaaaaaaaaaaaaaaaaattaggcttcgtggcgggtgcctgtagtcccagctactctgggaggctgaggcgggggaatggcgtgaacccaggaggtggagcttatagtgagccgagattgtgccactgcactccagcctgggtgacagagcgagactccgtctcaacaacaacaacaacaacaataacaaaaagagataagggcctgaaaaagaaacaattagctcggagcattcaaggaagatttctggaaaaggtgatgtctaagtgaaatcctcaaggaaagaaagagctggccaggaagagaagcaggtacagggaagacaacatgcaaaggacagagcagtaaaacacatcagaattatctagtgttcgtggatagaaaaataatgaggattggtgaggccagaggctggctggggcgtcttccggtgccttttacatgttttttgcagcactagagagccattgaagagttttaaatagggaaggtgcatgaccagatctatttagacagatcattctgactgcaatgtttaagagtttaagatatgtttgaagagccaagatctgttaggaggatactgcaacaaataaagagggcgtgaactagagcaaccatggcagatggaaaggagagtggattcaagaatggaaaaattagccaggctctgtggttcacgcctgtcctcccagcactttgggaggccaagacaggaggatcacttgagcccaggagttgggaccaacctgggcagcacagtaagacccatctctataaaaattaaaaaaataaataaaaacggaaaaatcagctggacttgatggttgactagtaaaggaagtcaagaattgctcccaatttctggtttgggtgaagagtaattccattaggggaggagaatgttagaaagaaaccagtccggggtggggggaagatgaggcattctactgtggcaattttgactctgatattaatgcctgacagattccagctggaggtctgggctggagaatataaatttgatatgtgtgtttagagaatcggatggaggcaggaggaacatcatttggcagagggtgttgctaatgtagatgataaggaataagagctttggagcggaaatggatcttggtagcaacaatacagaatcttctgtcatccatcatattgtaaatctggaaacctcgtgaagttgggatcctaacaagaggagtacacaccttgatttaaggatggtggcctaagacaggtgagttttccatggggggccttgtccccaaagagttcacaccaggagtagattcacccgttgtcgggctctcatgggtgacaatcggcgcaagttctcctcacctgatccgcaaaatagatcttctgcttgccgtacatcttctctttgatcttgccttgttgcgccagctgctccagcgtcttcaccaccacctggcagaggagagagaaggagcaatcagaggagtctgagcctgggtctggggaaatccagccagtgatgtggaaaacgcccaaggctccaaagggcacgaccccagcctgaatccagggagtccgacggagagggaatcccgggagaaggtcctcaccgccttgcccagtccgtgttcccgctgtaggttcccgaacacatcctgggagctgtagggccggttctgctcctgcaggtacctcaggaggatcccggcggctacggagagaaaggcaggggagggggccactcaaccgacctcctcacccactgccctcccgggtcttccccgcgcccacggcgccgttacctcccgccgcagcttctgcccggcctttactcatcgcctttcccgccacccaactcagaaagccggacgttgtagttgctcggggcgacggctccttccggcgacgggggcgggcctcgaacggtgattggctgaaggggaagccttccggaggagcaaagcgacccctcccggactccatagttcatttcaggtcggaacttgcgcattcgggccggacctcaagccatgggcctctgcgaaggcgccggcgtgcccacggctaagaaacttcctctttctgctcccgggaacgaaggctgtagcagagaaggccttcaagtttcgagacccagttccagccgcagctgagcactggtgaccttgaattaagtctaatgttgggattggaagacgcttcagacatccgctgccgccctgggcaagcgaccagctcaaggttaccccacagggacgtgctctggtcccacggtccagtgctcttttgtcggttagttttgtcatttgtaaaataggaacagtagatagtggtaggaaagtggttgtgaaaacttaatagaaagctaagcgccttggtcgggcgcagtggcatgtcacccctgcaattctatcactttgggaggctgaggcgggcggatcgtttgagcccaggaattcgaaaccagtctgggcaatatgaaaccccatctctgcaaataaagtacaaaaaattaagagtggtggcgcgcttctgtggtcccagctactctggaggctgaggtgggagggtcaccagagccccggacatcgaggctgcagtgagccactatgagcgcgccactgcaccccatcctggcgacagagcgagacgcagtctcgaacaaaaaaaaaaaaagtgggaaggggggacagctaagcgccttggagagcaaccacccttatttgcctaataccgagcttcgcacccagggggcactcgacacctactgtagtttggacgccaaggaacgatagggttaggagggggctactgttcaaccacaaagcttgtggaaaagtttgttagcccagacaatctcagggcaacacctggcaggtgctttccacccctgaccacagtggccaatgggacagagcctgaaataaatatttctagtttctgaggtgagctgaagaccaaagagcagctgtccctgcagctcaaaccatccagtggaggagtaaggtgctactttttaaagccttctgctacctacaacctccttagcctttaaaacgtgtgcttgtctctgcacgtttaggagacaatattaagaattagaaatgaaagggccgagcgcggtggctcacgcctgcaatcccagcactttgggaggccagggcgggcggatcacgaggtcaggagatcgagaccatcctggctaacactgtgaaaccccatctctactaaaaatacaaaaaattagccaggcgtgctggtgggcgcctgtagtccaagctactcaggaggctgaggcaggagaatggcgtgaacccgggaggcggagcttgcagtgagagatcgcaccact

SEQ ID NO: 12195 - DNA, 17738 bp, Homo sapiens
aaaagaaatatgtagggtctggtggagaggatgttggaagctgagatattttctccagtgttttcaactcaccttgcatttaggctcagcagctcagccttctgttattattatgtaggcttagagccagattcagagaggctctttgttttgtgttctgattttatgtctttaaagtccaaaggggattttacgctgggagaaggtatcaagcaagactttgtgctcttcccacagtacgccgcagagctctccacccagaacgagccatggacaaccacagtgacagcgaagaggagcttgctgccttctgtcctcaggtatcttgagtgtgggagctgcttcactgtccagttttctttagctcccttttaaccatccgacagctcacatttaggccataaccaggtttgaggccttagactccccttgttcccaagacaaggagagaagtgagactttgttcctagatctcaatttttttctttatcatatcattcctgtaatcaacctaggtctcaattagagcctgatgcccagcaccgctcttccgtatctctttttaccctaccattatggaagaacttctggagctagtatgatcatcttttaaacagcccagttcacccttgggtctgtgcagtatgtgtatcctcctaccactttgaaaaattatctctggatcaattatttgccttaaagtaagtgggtaattgactcccccaagactgcttttcttcctgtgcttaagaggttatgaatgagtgttttctttgggagagcagcctaaaaggggtcaagattttttttgttgttgttactttcacatgtattgattaaaaaaaaaataaaggggagagggagttttcaacgggaagttaccatctatccctggttacattgatttgatggccttcggataactaatgctagctgattagtaaagctgtacctggtgactacacctggttcctgatggcattatctcacatttgttggtcttttcctaagctggacgattctactgttgccagggaattggccatcacagactctgagcactcagacgctgaagtctcctgtacagacaatggcacattcaatctttcaaggggccaaacacctctaacggaaggctctgaaggtgaggggagcctttgacctcagttgataatggctctgactgttgcctcttagcttccctgaacagaggggatactggtgcttgcccctctcctgttttctgagctatggatcaggcggcagagcagcctgagtgctgtggctacagccaggatggcactgctgcccttcttgaagactttagtcccttagtagcctcaggcactagcctcacaggggacatagaagagagggggaattgtgtagagatcacagccacctataagtggaggggaaaggtataccagtcccatgggtttatttcgccctgagaaagccagggtgggaaaaatctggtcatgtggggctggggcacaggagggccaggtaggtgccatgactcagacacttctgtattccaccagacctagatggtcacagtgatccagaggaatcctttgccagagaccttccagacttcccttccattaatatggatcctgctggcctggatgatgaggacgacactagcattggcatgcccagcttgatgtaccgttctccgccaggggctgaggagccccaggccccacctgccagccgggacgaggctgcgctgccggagctcctgcttggtgctcttcctgtaggatccaacctcaccagcaaccttgccagcctggtctcccagggtatgattcagctggccttgtcaggggcctcccaaccaggcccttctggagcacctgcccagagagcaacgagaggcttcctccggtcccccagttcagacctggacactgatgctgagggggatgactttgaacttctggaccagtcggagctgagtcagctggaccctgccagttctaggagccactgaggcagagactccttttgggagtcactgtggtttaggtttttttctccccatcccacttaaggtgatggggcaagggaagaactcagctcccctcccctgaattatatttgtatgctgggtggcctggctgatgctcagaggcctccttagagaggacactcactcccctcccaccagctggatgcccatttctgagctcagtcactgaagtgagagtgtgctcccccaagggaggcttctctccatcaggatggtactttgggggaacaaaatagtcagggatattggttcccctttgaggaggtgctgctgtttgcttttaggtatgagtgctcaggggccctcactgaaagagcccatgcctgccttcctcctttcatcgcctctctagagcccccaaagtcaggcagcagctggagtagttacattgtcatcatctttttttttgagacagtttcgctctgttgcccaggctggagtgcagtggtgtgatcttggctttctgcaacgtctgccttccaggttgaagaggttctcctgcctcagcctccttagtagtgggattacaggtgcccgctactatgcccggctaatttttcttttggtatttttagtagaaatggggtttcaccatgttggccaggctggtctcaaactcctgacctcaagtgagctgactgccttggcctcccagagtgctgggattagtcgtcatcttttgttaaaccaggatttgatttttttcttttcttttcttttcttttctttttttttttttttgagacagagtctctctctgttgcccaggctggagtgcagtggcacaatctcggctcactgcagcctccgcctgccgggtcaagcgattctcctacctcagcctcctcagtagctgagattacaggcatgcaccaccatgcccggctaatttttttgtgtttttagtagagatggggtttcaccgtgctggccaggctggtctagaactcctgactgcaaatgatcagcccgcctcagccacccaaagtgttgggattacaggtgtgagccactgtgcccagcgtgatttttttttttttttaaagcaaacttgtcctttggttttgcagaacaggcctgctccctctcatctagcccatcatttcttggggcctgaaccccagtggtccaaagtattgcttgtgaaatttaaaaaatgtgaatatgatgtggggatgggcctcttctacattaccttggcccagggggatcagctggctgggaggattagtgagcacctctgtattttgaggtctgagtcttctggagctgtgtagttaatcttcggtttctgataacccctgggtccatctggccatcagcctcagcagtgagcaaagcaataccatactcatttctatgttcctgttccttcctctgctcctcctttggagaagcaataattcatgggggatgatacagtagcactttacaaatggctccatgtcattcatcccaggggccataatctcttgcaccacctattcttacttcctgttcagctcctttacagcttttattttcaactgcttcccaacttggtggggcctcctttaaggatgagccaatagtaagaatgtggctgtaatcagcagagacccctctgaggggtatctgttctgcagcccctagtgaaatcatgtgatgtgagacagaaacctaaacatggtacttgattctaaacctgtgccagtctatagcctctgcctcsccaagcagagctcaagccaaacgcttctgtcctctttccttctgcattaaccctttgctgatcctcaggggccactcccccaacacccctgtacttgggtgagggatgttggacagagcctgttttcatgtactgcaggtgggggtgtgctgacatgtttgctcttggttgatggagaaggtacagaggccagggagtgaaaatggttgacagaagagggaagagttaggtgtctcatagtcactcatagtggggtggtcaggggtaatggcatctccccactttaggcttctcaaacagacttttgacacctctcaagttcagagctctgatgtggaaagacaggaggtgtggggaaggagggggatttcgtgtgtttgcatgagtgtgcgcttcaggccttgggagttggcaaragggagggarggaaggagagcaaaatcttcggaaggtgtttcttgtacctgagggatcctgccctgaatctccwtagtctccmctgtgaactgaggaggggaggggtgtgctggggaataaatcttgtatgagaacaatctttaagagactgatgctgaatggtgtcctacccttgataggtcttctcttgtaaatctgagttctgattaatttgaagtgatagccttaaaagaggaagcccaggtatgagggacccaccagcccacccctatttttacttcgtgatggccagaacatcaccatagtatgaggctactttccttcttgtgagagccccaccatcagtataactggcactcttggctagtatttagcctgtatttccttcatttctaatttcttttttttttttttttttttcctgagacggagtcttggtctgtcgcccaggctggagtgcagtggtgcgatctctcactgcaagctccgcctcccgggttcacgccattctcctgcctcagcctcctgagtagcttggactacaggcgcccaccagcacgcctggctaattttttgtatttttagtagagatggggtttcacagtgttagccaggatggtctcgatctcctgacctcgtgatccgcccgccctggcctcccaaagtgctgggattgcaggcgtgagccaccgcgctcggccctttcatttctaattcttaatattgtctcctaaacgtgcagagacaagcacacgttttaaaggctaaggaggttgtaggtagcagaaggctttaaaaagtagcaccttactcctccactggatggtttgagctgcagggacagctgctctttggycttcagctcacctcagaaactagaaatatttatttcaggctctgtcccattggccactgtggtcaggggtggaaagcacctgccaggtgttgccctgagattgtctgggctaacaaacttttccacaagctttgtggttgaacagtagccccctcctaaccctatcgttccttggcgtccaaactacagtaggtgtcgagtgccccctgggtgcgaagctcggtattaggcaaataagggtggttgctctccaaggcgcttagctgtccccccttcccactttttttttttttgttcgagactgcgtctcgctctgtcgccaggatggggtgcagtggcgcgctcatagtggctcactgcagcctcgatgtccggggctctggtgaccctcccacctcagcctccagagtagctgggaccacagaagcgcgccaccactcttaattttttgtactttatttgcagagatggggtttcatattgcccagactggtttcgaattcctgggctcaaacgatccgcccgcctcagcctcccaaagtgatagaattgcaggggtgacatgccactgcgcccgaccaaggcgcttagctttctattaagttttcacaaccactttcctaccactatctactgttcctattttacaaatgacaaaactaaccgacaaaagagcactggaccgtgggaccagagcacgtccctgtggggtaaccttgagctggtcgcttgcccagggcggcagcggatgtctgaagcgtcttccaatcccaacattagacttaattcaaggtcaccagtgctcagctgcggctggaactgggtctcgaaacttgaaggccttctctgctacagccttcgttcccgggagcagaaagaggaagtttcttagccgtgggcacgccggcgccttcgcagaggcccatggcttgaggtccggcccgaatgcgcaagttccgacctgaaatgaactatggagtccgggaggggtcgctttgctcctccggaaggcttccccttcagccaatcaccgttcgaggcccgcccccgtcgccggaaggagccgtcgccccgagcaactacaacgtccggctttctgagttgggtggcgggaaaggcgatgagtaaaggccgggcagaagctgcggcgggaggtaacggcgccgtgggcgcggggaagacccgggagggcagtgggtgaggaggtcggttgagtggcccsctcccctgcctttctctccgtagccgccgggatcctcctgaggtacctgcaggagcagaaccggccctacagctcccaggatgtgttcgggaacctacagcgggaacacggactgggcaaggcggtgaggaccttctcccgggattccctctccgtcggactccctggattcaggctggggtcgtgccctttggagccttgggcgttttccacatcactggctggatttccccagacccaggctcagactcctctgattgctccttctctctyctctgccaggtggtggtgaagacgctggagcagctggcgcaacaaggcaagatcaaagagaagatgtayggcaagcagaagatctattttgcggatcaggtgaggagaacttgcgccgattgtcacccatgagagcccgacaacgggtgaatctactcctggtgtgaactctttgggracaaggccccccatggaaaactcacctgtcttaggccaccatccttaaatcaaggtgtgtactcctcttgttaggatcccaacttcacgaggtttccagatttacaatatgatggatgacagaagattctgtattgttgctaccaagatccatttccgctccaaagctcttattccttatcatctacattagcaacaccctctgccaaatgatgttcctcctgcctccatccgattctctaaacacacatatcaaatttatattctccagcccagacctccagctggaatctgtcaggcattaatatcagagtcaaaattgccacagtagaatgcctcatcttccccccaccccggactggtttctttctaacattctcctcccctaatggaattactcttcacccaaaccagaaattgggagcaattcttgacttcctttactagtcaaccatcaagtccagctgatttttccgtttttatttatttttttaatttttatagagatgggtcttactgtgctgcccaggttggtcccaactcctgggctcaagtgatcctcctgtcttggcctcccaaagtgctgggaggacaggcgtgaaccacagagcctggctaatttttccattcttgaatccactctcctttccatctgccatggttgctctagttcacgccctctttatttgttgcagtatcctcctaacagatcttggctcttcaaacatatcttaaactcttaaacattgcagtcagaatgatctgtctaaatagatctggtcatgcaccttccctatttaaaactcttcaatggctctctagtgctgcaaaaaacatgtaaaaggcaccggaagacgccccagccagcctctggcctcaccaatcctcattatttttctatccacgaacactagataattctgrtgtgttttactgctctgtcctttgcatgttgtcttccctgtacctgcttctcttcctggccagctctttctttccttgaggatttcacttagacatcaccttttccagaaatcttccttgaatgctccgagctaattgtttctttttcaggcccttatctctttttgttattgttgttgttgttgttgttgagacggagtctcgctctgtcacccaggctggagtgcagtggcacaatctcggctcactataagctccacctcctgggttcacgccattcccccgcctcagcctcccagagtagctgggactacaggcacccgccacgaagcctaatttttttttttttttttttttggtatttttagtagagatggggtttcatcgtgttagccaggatggtcttgatctcctgacctcgtgatccacccgcctcggcctcccaaagtgctgggattacaggcatgagccactgtgcccagcctggcccttacctcttttgaggcatgctgtattacaatttttacttgtctcctttattcaactgaagttcctctagggcagaccccatttctcaattcatttttatctgatcagcacctccgcagtatctaacatccagcagatattactcgttaaactgaaccaaaccacttttaaggctgactttcctaaaacaggctgcattgtgttactcatctaaagayaattctctaaaggagggtttggcaaactttttctgcaaatggccagacagtatttttaggatttgtgggccatatgtatctcttgtcatggctgsctgtacaactgccacaactactcacctctgccactgtagaacagaagcagctgtagactatgtaaatgaacgggtggggctgtttcaataaaattttgttttcaaaaacatgcatctggcaggatttggcttgctggccatagtttgctggcctctgccctataggttcaccttgcccaagtgtagagtccagactgcactggctggcatactttttcaacctgctccccatcaccaactgatgtgacctcccccacccccacactgatccccagtgcagttcttttctagcaatggcccctcatgagagaagctcctcagacttactggaatcccttatctacatggatcccaagacccagcatagtggctcatgcatgtaatcccagcactttgggaggctgaggcggatggatcacttgagcccaggagtttgagaccagcctgggcaacgtggtgaaaccccttctctactaaaaatacaaaaattagctgcgcttggtggtgcgcgcctgtaatcccagctacttaggaggctgaggcatgagaatcgcttgaagccaggaggcggaggttgcagtcagccaagattgcaccactgcactctggcctgggtgacagagaaagaaagagaggaaaagagggaagggagggagaaagagggagggagggaggaaaaaggaaggaaggaaggagggagagaggaaggtggaaagaaggatgggaagaaaggacaggaaggaagaagaaaagaagtccatccatcccatccatcatgcttcttcacctgtccagtttctatctattatggaaacccatgatctaggtttccccaccgtgggaacaatgttacttaactgcttcagcccaggtagtggttttatcactaaatgggaagatttctgtcctaatcagtatcctgtcaacctagtagcttaaggacaagcattagatttcagcttttctttcctacctttttagtggggccgctccttaactgaaaacaatttctcaaaagtactctcccactatttctgcagaccctctggagactttggggtgtggctggttcctgagcatatccaaatggtgccttcccaggtgtgtgttcccatctttgtgcctcacaacagttcacttgtattttccctctttgtctggcaggaccagtttgacatggtgagtgatgctgaccttcaagtcctagatggcaaaatcgtggccctcactgctaaggtgcagagcttgcagcagagctgccgctacatggaggctggtaggactgggtagcccctccaaagtgcccataggcttaggttcattctagaggtcaggaattactaaatgaatggttcaatgactgcagcatcttgttgcagctaagacccctttgctgggctcccttaggcataaaaagaaatgtaggataactaacggcttttgtgtaccaacaaatggacaagatacgcatttgttctccctgccacgattatcagtacactgtccccacgtttccctttattcctgcttctttaactggctacgcctaagtaagtgttcaacctcacacccacgccacttgtagatggaggargaaagaaaatyagaagaataaataatcctgtatggcttagtttccatgtgagatgayagatccagagcaaggtggaacacctcagggagcacccactgggaaagacagaactccttcctcaggggtagcaagtgaccccaggsggatgtggtttcagagctcaaggaattatctagtgccctgaccacaccagagatgcagaaagaaatccaggagttaaagaaggaatgcgctggctacagagagagattgaagaacattaaagcagctaccaatcatgtgactccagaagagaaagagcaggtgagctggaaggctgtaggaccgctgtgcaggtccagagtgaacatcagggctgagccccagagggctgctgtgrttctgaggagttagaggaacttgctttttccttctaggtgwacagagagaggcagaagtactgtaaggagtggaggaagaggaagaggatggtaagtgtgtgggagctccgagacaggccctggaggtgcctttgaaaatggcaggcaccagatcagccgctacacaatatcataaactgacaggcagtgcccagtgctgcccatctgaaaacgggtggttttatttcttgtcaggctacagagctgtctgatgcaatacttgaaggataccccaagagcaagaagcagttctttgtaagtggagctctcttccttctttgcttccctgtggtcttatcctggtgacatctcattcacttgtctccctgtctcacaggaggaagttgggatagagacggatgaagattacaacgtcacactcccagacccctgaggggcccacggtcaggactggtggggactgcaggatgtcagaagagtgagatgtcttgcactggctaccttgtttttggttggcttttgttgttgttcctgctactttcacctttaagcagagcagtcaggagacaagcataaaccagagcactgggtagagaggatgagggctggtggctgggggtagacccagcccatttcattgtctaaattgcagtagcttgaggttaacatttagacttggaacaatgctaaaggaaagcatttggcaatatttattataatttaattttatataaaaatatttaatttcctctggatagtcaaacctgccagatatcaaacctgaggaaggcagaagtgaatttggagaactagggtagagagaggttgctataaaacgagcatttggagggcccacggcttcactcaggacctgctgggcttgtgtaccccaggagcccttttaagtatcttttgtacgcttttcaccccacccccaagtcctgggagaaatgcaggcaacactgagacatgggagaggccaagatatgcttgacagaaagggtgattttgaggctcagttaatatttcaaaattgtaaccgtagcaaaactgcattggtatttagaaaaataaaaaatttccaatatgtagtgctgtgttatacctgcctctgccatgcagcatcatagcctgtgggaaccrggagggcttcccttaccacccagagcagaggaggaaggtgatggaatatggggtgaggggaggaacctggtggcccctccctgagatggccagaaagcccttggcctcacctgggactgaccaggcagccctagtctaggcacaaggtgccctttcacccttcatggctgtgggaatatttcctcttactctttttctcccatacagctactgccaaaatgcccaaacttgggccaaatgttgcccaaacttgggccaaaaatgttgcccaagagaccaaaacagaggaaaacagtttccaaatctatgtagatcatgagcagaaatctgaggcttgaataaagggctgagagggcaggagctctttggggtgtccagagcagacgcccatcccaaggacttccatggagtggggggaaggctgggtaggtttgagttttatcgtcaatataataaattaatcagaagctttcacaaaacaaacaccgcggctcygctgaagataaaatggggctgggaaaaaccaaacaccaagtasaaaccagctgaccagtgtgaggtgttgtagtccagtctcccgggcccagcagttcagtggccacgtagagattcaagggcctcttgttggctgttctccaggtttccaagaaccggtcagtaaagctggtttttcaattggtgcaggacgccaatcacaatctcccgcagggtctggcgagggcagcagaggaagaaatagacaatgcccaagtcaacgcagagtagtttccaagatgcctgcctagatcagccatgtactttagaaaagtgctttaaaaatagccccccgggggccaggtgtggtggctcacgcctataatcccagcacttcgggaggccaaggcgggtggatcacctgaatttcaagaccagcctggccaacatagtgaaaccccgtctctactaaaaatacaaaaattaggtgtggtggcacatgcctgtaatcccagctacacaggaggctgaggtatgagaatcgcctgaacccaggaggtggaagttgcagtgagctgacatcacaccactgcactccagccttggtgacagagtgagactccgtctcaaaaaaaaaaaaaaaaagcccccaggaagtactgatgtctgcagtttaatttgaggtgctcctgaagcaagatggagagatggaaatatagtaaaatgtttcggtaaaatttagggagcgggtatacgagtgttcactgtgaactcctctcaacatcgcaatatgtttaatgtgtttcacaataaaaatgttgggaaacgaggccaggcacagtggctcatgcctgtaatcccagcactttgggaggccgaggcgggtggatcacaaggtcaggagatcgagaccatcctggctaacacggtgaaaccccgtcttactaaaaaatacaaaaaattggccaggtatggtggcacacgcctgtagtcccagctactcgggaggctgaggcaggagaatggcgtgaacccgggaggcggaggttgcagtgagccgagattgtgccactgcactccagcctgggcgacagaacgagactcccgtctcaaaaaaaaaaatgttgagaaacaaacaagaaatctcagacacaagtttaaaacctcagaaaaagcaaccagacttcaattagaagacttagtgcaataccattagcacatctccattataaataaatttttaaaaagctcttggggcaactactttagggggcctaaaggtagggtcccagaatttgcgtttccaattctgctgcagatgcctggggcttccatacaggggcagcgataacatgggctagacaaaagccaagagctggacttcacattgagctcacgtcacacttgccgaatgaaaccgtaacatgaagatgtgggttagacagcaaagaaaagggaaaataccagggccctcaaagctgtagaaacgcccttaagatctaaaagcagctgccacgcttttctcaacagctgatggcttgggccactttgcttgatggtagagaaaaccgcagaccctgtgcctattgttgccccatacctgaggcttacagtgctcctcgatccagctgaagacacaygctgacagctcctggaagctggccactgagatggaggcattgaaggactggaacagggaatccatgatgccttgaaacacgttgaacttgacctggtcagagacctggtcctccccttcatgggggttgtccyggtgtgccttcacaatctgctcatagttcctaaaagcatgcaggccagggctgaggtgctgcagcagctccgcccacccaagaagaatgacgggactatcctgtgtactcccaggaatggcagccccagagagcttctgggtggggttcagtatcagggagatactgcttccaggtcaggaaaggtggccctctctctccaaccttccttacattaatccaacaggcatttcctgagtgtctgccatgtgtaaggacagttggggatacacagtcctactggctagctcaggaactaagagtattatctgtacagcagtaactgatgtggcctttgaacaagggagggtgtgcaatgaagttgcctcagaagttctggttccccccattcagcacccctcttacactttcatgatctttagggcggtgacatccttgcgtaacgtggacacctcctcctcctgctttttcttctccttgtgcaaaaactgaatgtagtcaatggctagggtgggggcaagaaaaaaaggacaggtacagaagtattctcaaccaagaagataaggctgactttgttccccttaccccagaccccaactatcccatggcaatcaccacaccaaggccgagccatgggtgggtaggaggcactggcctcttcacagcccctcttggctccatcccctccagtgctttccctagccatactcttttgtagaacgatggctttgctgagcttttgggagccaatggagaagtcctgctgctggcaagtggggacgatggtctgaaggtcatcatagcctctctgtggaaacagcaggggaaatgggttctttaaccctgagagattaaagcaaaatggcacaaagttcctccatgacaccaagttctatgctcacaaactcaatggggtgggaaggctgcaagggaggtgtttgtgcctgggactatactacctgcccaccccctagggtgcctgggactgtctgagtgggtcagggcacagggaagctaaactatgcagggccctcccgcactggctgaggcacaggcctccctgttcaccttgatggcgtccctcctcttctgctcagcctgagtgtgtgcgcgccgccgccggtctttgtaggactccttgtaggcctcctggtggtaatcactgtcctcatcatctacgctcagagatgggggcagggaaaggtcatcttggggcccagtggggtccagctagcccacctttccccagctgggaagaacctggtgtccagagaaggcagatggacagaaccacctaatgttccagatgaggtgaaagatggtgagaccttgtgtctgatactttggctccagcacccctgtgtggatggctggggcttccctgtctaggaaaggtactacaattatgacatatctgagccccctgaggtcgggggggatgttactgcctacctgtgttggggacagaagaggcactggtggaaccgatgctattagctctggacactacactccccttgcgggtgctttctacaaaaagccctggaaaagagaggccccaatcactaaggggtggggtggggaacattgccagaccctcagacacctgtaggacacaatggctttcttttatttatttattttttttttagacagagtctcgctcagtcgcccaggctagagtgcagtggcgcgatctcggctcactgcaagctccgcctcccaggttcacgccattctcctgcctcagcctcccgagtagctgggactacaggcgcccgccaccacgcccggctaatttttttgtattttttagtggagacggggtttcaccgtgttagccaggatggtctcggtctcctgacctcgtgatccgcctgcctcggcctcccaaagtgctgggattacaggggtgagccaccgcgcccggccacacaatggctttcttaaatgctgacctcttcccttcaacccaaagccaaccatactgggccccccacttcctgccagaccacgctgcagtgctctgctccctagtgtctacactgctccataggcctgcatgatacccccctggctcacaaacgggcatgtggacgtgatgagggtgtgagtgatcagctgctccactgagtggtgagtgatcagttccaccacttccctgttccagagcagagggaactaggtgtcaccctcagttgttttctgcccttgtccttcagctcctgctgtctcaagccaggaactctgctcagggagagtggactgtgctcaggcgtggttggcaacgccacaagaatctagagagcctgggcgggagtgtccctctagagcttaagatggggcagctactcaccggggtccaggctgttgtcgctgtaggcatactccacctgcggcacagagcacgggaagggcccgtcagacctccgcccctagggggaggcgccccttccactgcaggcacgcacagcgcgccccccattccgggaaggcgcctctgtcaccctgcgcgcttgcacacacacagcccggggtgcgcgggcagcttaatgagtcccccgagactggcacaggctagggcgtgcgagtgcctcccctgtgtatgatcccttccgcccctactccaccccagtgccccgttcccccgactcgcgcgcacacgcctcgtttgtctccccaccttggcacacgcggggtgagagctgtcttctctgcagccccggggcacggagagcgtgggggactttggggacaggagggaagcccctcgtcttccggcccccctacgtgcacgagcccgacccgccctcccctcgccggcgtgcgcgcccacggggcttgccttgacccaagggtcctcgggagaggcgcccggctccgtcatcttgtacccaccggaccggaaacgggccagcgggckggccccctgcggcgaggaagcgggtggcgtgcccacgtgacccgcgcccgccaatccgcgaccgagaggtggggcagggcgaagcatcgcgcatgcgcagcccaaagactttactccacggttccagccgtcaaggcccggcgcttggcctggcgccagcctccttcgagactgctccccgccgtgcctgccctccccgggttaggcagtggaatggcggcgacatgaagcgcgttttgtaagatggagtcccctcaattggcttgtcagcacaccgccgcagatagtgtgtgcacgcgcactgtccggccggccggctccccacgttaccctgagggcggcctccccgcgctcaccggacctgcactgctggccggtgtgtcaggaaccgggcagagaagcccccagccacatcgtccgaccccaccaggctgcaagctctgtgagggcagaggccccgcctggcgcgcggaaggctgatcttccaacacccagcccagtgtctggcaggatgcatgtggaatgaacccttgcaaagaacctgctagctaggttatgcggcctctcatattaaaaacaaaacaaaaacaataaaacacggcagtacctagaaagtctacaccttactcagaagaacacagctggtcagtgggagggccaaagctcgcctctggctagcctcaaaggccattctcttaaccactgcattgcccaggcttccagctcaggcctgggccctgcacttgtggcttaaggatcccaaagatacttaggggcattggaacaggaagcagacaccatacaagcaacatctcagaacattcacctttaattctgttacaggttccagtatttgcgctggccctagtcagctgtgggtaagagtcacccatgggcaagagtggggaggggactgctcccccatgaaccacatcctcagtgttggccaaataccagcgtgttgggtaggcttcctgtgtccaccaggcctggccatgtcctgcacagtatagcttggacctctgg

SEQ ID NO: 12196 - DNA, 35444 bp, Homo sapiens
caggagttcgaggctgcagtcaggcatgattgcagcactgcactccagcctgggagacagagcaagcccttgtctcttaaaaaaaagagggggcaggagagaagggcagagtgatgtgatgtgagaaagactcactcgccattcacaaagccattgtgggctttgaagatggaagaaaaggccgtgagccaaggcaggcagctggagagaagctggaaagacaaggagtggattctccgctgcagcctccaggaggagccggctctgacgacaccttcattttagcccagtgacaccgtgttgcacttctgacccgaagaactataagattataaacttgcggccgggcacggtggctcttgcctgtaatcccagcactttgggaggccgaggcgggtggttcatgaggtcaggagatcgagaccatcctggctaaaacggtgaaaccccgtctctactaaaaaaatacaaaaaattagccgggcgtggtggcgggcgcctctagtcccagctactcaggaggctgaggcagaagaatggcgtgaacccgggaggtggagcttgcagtgagccgagattgggccactgcacttcagcctgggcaacagagcgagactctgtctcaaaaagaaaaaagaaaaaagaaaaaaaaagattgtaaacttgtgctgttttaagccattaagtttgtgataatttgtgacagccaccataggaagtgcattgagatttgtagtattttgcggggtgaagaggagggtgaaaaggaatggacaagcctgtcaggtccctggatggagatttaatgacgatgccaagactatggatcctagtgagaatcctgcatcccccatgccctacagctaccagggagatgaggcactgggagagttagtactcggctggtggttttgtgccctctgggcctagaaagtatgtaatgctgccatccctgtatgcgcagaaagatggttaatgcagccccactcagggcagtttgggggcttacctgaatttccccactgggagcctctctcctgacttaacctcaacagaggcatcttcttccaagtgctgcttgtaactcagcccccaatgcctgaagacacaccttcagcctctctcctgacgttcccctgcctttccaggaggccctggagggaaggaccccacactggctctctgctgagtggcccagctctggcctatgggacacgtgtgcgtttgccttgcccagcacacgctggggctgccaccattcccagagcagtgcaggctcttggcgccaccacccaagtgccctgtcaatttccagggcaggagtcagagccccatctgcaggtgactctggctttctcaagactgagttgacacctgtgctctcagcaaacatgtttctgagcactcttgaactcacttgctaagcttggcttggaaagtgtgaagggagagctggggtccgcagctggaaagactctcacctcctgcctctctcctgaacccatttgatgtctctcctctggccaaggggtaaatctgcacatgtaagtctcatacactttggctcttcatggaattggtccctgtagaagccgggccagaaagaatctagcaccctcttgcactacaatttattgagcctttactttgtgtcaggcaccgttctaagcagtttatatctaagattggatggatttccaccactcctattcccatttcgagaaagagtaccctttcccaagacaggaaaaacagccagggccataaaggagggccttttgtgacatcatcagaagtggagaagaggtacccagatcccattagcaaagtgcagccgaagagtcawgctaagttcactgtgtccsttgcggcattgccttcctcagtgctggctgccatcatacaaccccatagcttgtgtggcttaaacagcagacatttattttctcagtgttctggaggctggaagtctgagatcaggatgccaacatggtcaggtttagggagggctcccttcctggcttgcagacagctgctttctcactgtgtcctcacatgggcagagagtgagtgagagcaagctctctggtgtccctagtccctcatcgaaacttcattaccccacgaaggtcccatctccaaataccatcacgttgggggttagggctcaacatatgtatttggggggacatcatctggtccatagcaggcactgtccgggtcagaaggcctcccagggatttggtcctgaggctggctgtggaaggtgcccttgcttcatcacctctgcacctgctccactgtaagaactgggcagacagattggcagcttaggccaagcaagatagatggtacggaggctcgacaggaaggtttctggagatcaggaagataggaattaaggaaggtgaagaggaagaaaaaaggactccatgaagaggagagggtctctaaaagctggaaacataagtgaggaggtgagaaccagtctgaagcacccacctgtgacctggtgggggcaggaaggtgttagaggagctagggagctgaccagacgggaggaacccttcccattcttcatggaggcagattatcgctggtctgcaactggcattcttagagttaggaatcactgtgtccatttttctagacttctctcattggtgatgatttgaccttttcctcttgcactaatgagcaaggtggaggaaagagatctctctctctcacacatatactatctcactcaatgcccaccaatcctaagaggcaggaacaattgggttacgccatagtgaactgcccttctgtaggtcaaaatttaaatgtaggtgatgtcacagagtttaacctagtattaccatcaatgccattatacagattaggagactgaggcttcggaaggttaagtcatttgctcaagctcacacatttggtgagtcagggagcttggatgtgaactggggcctaactcccaaacctgctgtggtaggctgccatccatggaaacaggggttcctgcgggaatgtgtaagagatgaggttggtaagtatgacttttagatgccaggagttgacctgtgtggctaccaatgggaagcccctgaagacagaaaggtagggtagcaaagtagaatcaacagggaagggatgaggaggccggagggtaagtaggccactgcgagatcaggacgaaatttactgggatcgtgagatgctggaaggaaggatcagagaatctgggaccatgctctgcatctttttgctgcaataaatggtattgcatgagataccatttattgccatgtgtcctcattgtagtcatttttgtaatttatatgacaagaaaaaatgacagggtgatttttacatatgtgcatacctatttacacaccttccagatcaggagtggtgatctgagctcactagatatgctcaattaggtaataatcaattcaggtcatcaaattgatcacccaaatcaatttaggaaattgatgacctcaattaaggcaaatatatacaatgaaatatatgcagctgttagaaagggctagatcccatatactaaaatggaaagaaagccctttgaaacctaagaaaactgtgtttccattatgtgagtagaaatcttgtgtacacagaaaaatggtctttcttcttcccctcccctcccctcccgtcctctgagacggagtcttgctctgttgcccaggctggagtgcggtggcgtgatctcggctcactgcaacttccgcctcctgggttcaaactattttcctgcctcctgagtagctgggactacaggcgtgcgccaccatgcccagctaagttctttgtatttttagtagagacaggggtttcaccatgttggccaggctggtcttggactcctgacctcaggtgatctgcccacctcggcctcccaaaatgctgggattacaggcatgagccaccgtgcccagccagaaaaatggtctttcaattggaaatgtaattccagagaataaagaatagaaccacactgtaatatgacaagtaataacacacacaagcgctaaaggattttttttttttttttttttttgcctcccgatatctgaggggcaggctccgtggagcctccaggctgagaggctgagactggcagagcaggctgggttctggattctgatactcctgggcaggagtgtctcaaagattgagacattatgttcattctttggggctcctgttcttggcactatatctagcacatagtagttgcctcataaatacccattaaataagagcagaactaaacacatctggttagaaattgttcctaggcagcaaggaaccaacacgtggaaaatatggggtttctggagcagtgttaatgcaagccagttcctgtaatgtacatagtgacacctactgccaatgacacgtgctggagcccttccactgttgatttcctatattcacttacccttgtctttaagtggatgttggtggaaacttgaggatacatctttgtgcagcagacagcatttgtaagtaaatctgtgtaggcttagggccacattgataaaaatatatgagagtaaacatatacagaagctgttttaagaacttctgatgtcctagatgctctgatttctggaagctccatcccacatcgtagcaaatatattaaaacactctcatattctctaaatactcttaaataatgtgagtgttaaaacagtagtttcatttgaaattatttgatgttgcggaactcactttctaatgactatgacttcccggcaatcacggcattagggaattcataccaagtgatgtctaagttatagtttcaaaatataatgaaacatttatccatcaatacattacaattatgaaattaacatgttttggggaccttcatttaaacatttattaatctcagatttgcagtatactttttgtattgtgcagtcaataaaattttcagtctcaaacattttcataggtccctgaaaagctcaacgcaaaaaacagcccccatgtgtgattctctactgggcaataaaagccaatcgcgaccctcattttccccccattccagggcttccccaggatagaacgcggaaacgcttctttttccgtttccagggatttctttctttttccagtgtcgttctccctctcccccacttcatttttacaataaatgtcagtgcacacccaggagcgggtggtcccacaggggacatcttaacgcccaccsaggagcggctggtcccacagaggacctcttaacgctgacgctttctggagaaaaggatttgtgatgaaaatttccccaaggggaccttctagcgcctagcaccttcgatgctcctgtttcagtcgcggtctcagcgggcagtggcctcctttgaagctgggattctcctgcccctcccgggcagcgcaggccaccggtgacccgggacggtctgtaaacgaccttcgcgtccccgtccccgtggaataacgcgcggcgggcatcactgcccaatatccagcgctcgtgaaggcggagaccggcggggcagctagtttctggctgtggattctgattaatgggccgcaggcgcacggtctgcaccgtccggctcgttgctagtggctcgctcgggagccgccgcactcccggggctgtccgcccgagccggcctggaaggcagaggacgcctccaggtcgctccgcggggcctccggaattcctgggaaagcccccctgcagcgccgcccctggaccccaggtgtgaggagcggggctcggccagcggctccagaagaggcccggaccccactgccgtggctgccgggggcgggaaagtgatttctcggaaagcagagcacttcgaagaaggcgggccgcgcgagccaagctgacgctattggtcggtgtggccgtcgctctgcgcaccgcccgtcccccccacgaccctttttaaggccgcgcgaccgctggcgcatcgcctggagcgcggcagcaagcgtgggaacgcgggcggcrrgacggcggcaggacggcggcaggtaggcacagtgggcgggtagggcgcccgtgtcccgcgcggtccggtcccgcggggtccccgacgccaggcggggcgtgggggtggaactacctaccgtaatgtccccgggcgcagctcagtggccacccgtgtccctctctgctttttgcctattttycagccacctaagtccaatctgaatgcccaagtcgttgattgtcgtttgcytgtttccaaagattggtagatagatgcctttttaaaaatctcatttttctttaaatctggtttacatggaaaacgttaggagagctcatataatgaacggcaatagcaaccccctatcttgaaacgcgctctatcatcccactgaaattctaccacgtggaataatgcttggagggtcagagttgtggaactgcccaataaccartcgttactgagggttagtttgtgaaggaggggacagactgcttctaaaattctgtttaatgacagtcaattaagatttctgagtctggcttgagggcctttgcttccatcacagcccagtcgtccttggcaagagagtctgtatatgggccacagctcacaaaagcattgtttgaaaaaatttattgaaagaacattgtttgtaaaatgagtcccaatacataggacagactttcctaaggtgagatgtgttacttacccagagctgtgaaaggctttacggatggaaactagagactgaattttccagaattttaagaagtctccccaaccaatggccccccactttctttttttaaaccaaaggtaagaactggtagttaaaatgacagttcaaagcttgtccttttgggttacggcagcttcctctatgaaaagatttgggagtgattcagtcacttgaggaaggttggtgccagagagagaaatggctttggtgctttctggtctagtgatgcgggtatgctaggccagagcgagtgccctgggccctccgaggcgggggagagggtggggtctgctgctgccagctcaggtgtgacctgtaatctggattaggtgggcccagggcaacctcttatcacgtccctcctggaaagcctgactgctgtatacatttctagggctgcagatagggcttggccaatagattacctcaaaatcaagaagaggaagttataaacatgtgattagacttattaatttttcctggctgggcatttggtggaattcgtttgttaatgtttaataaatcattatggatcataactgtagtagaatctcaggcttttgatgttacttagaatcttggaggagaccacgaaggacacacagacgtggctgcacatgtgcagagatcttgtaaygtaactatggcttttctctgcaccatgtgtgaaataagctgccgctggcgttgggrcgccggcctgggttccaacacagtccgctggctgcctcggtatttgccgtgcctctctgggcctcagtttttcctctcttaaataaagaggggactggattagatgatttctaaagtattttccagctttcagatgctatgacttactcttctctttttccttttaaaatttctttttcctgtaaatcaccaagatagttgtcctgaacagtttagatgttatgaatccattaggaatcctgataagaaagtgttgaccctctttctagaaaaatgcgtgtactaacaaaatttttgcttttggttgcaggaggctcaggaactgtggattctagtttaagaaacttgtagcaaggaaatcaggggagttgaaagtctcagaagccaacccctatgttgtgttctggccacctctgtgcagctcattcctcaatctaggagaaatttttctaccttgccccaggaaagagctgctaacttgttttcggggagtgtgggggggtctttggtattggtgttccatttctcttctcaggtaccctctcccaagtctgtcccttctttatgataaacacagtggcctgctttagaattctgggtctcttgagatacagcctctcaacttacaggtgaggaagcctcagggagaggttcaagtgacgtcacaaggtctggttagagaaaagcctttgccagagttcagagttttcaaaccaaggtctaatttgggtgggcgcagtggctcacacctgtaatcacagcactttaggaggctgatgtgggaggatcacttgaggccgagagttcaagaccagactgggcaacatagcgagatcctgtctctaaaatgtatatctgggtgtggtggcatatgtctgtagttccaggtactcaaggggctgaggcaggaagatcgcttaagcccaggagttccaggctgccgcgagctatgatggcaccactgcactcctgcctgggtgacagagcwagaccctgtctctaaagaaaaaaaaattgaactcatccccttttaaatccataaacgcacaactgaggttgttggatggggaatttaagaaatcccacctcctcctccctgggacctggccctgtttcccgtctcatggccacctgcagggtggctgaagtttccagaatgcgtacttcttgtgaaggttctgattgatattttgctttctggaccagtgtggctctaccatattttgggatgttatgtcttgttactgctgattgtttcaaactcgtttgcccaaagaggtcacattttaatcagaagaacaaaaatgctatttttttttttttttgggtgggcgtctatccagctgtctyggggatttccagcactgttcttggaaatgttggctctaagtcgataggtcatgctagttctctctctctttctctgtgctgttggggaagctgtctgcttgggtgagagtgttcttccaaaggatgtctttgggtgccctgggatggttaggtccctagagtgggacatgttctggaagaggagcccagtgaactttgccctgttcggtagctgcagtttatttcctcactcttgtccctatctttcagttggtcgtaggagttgcccaggaaggaagtttggataataataatgacatctggcrtgtaaggtccaggccctgtctcagttgctttccgtgtagcatctgaattctcttacaaccagtacaggtagtgttttgttagctgcatctgggactgggtagctgatgccctgagtttaaatgctgatccagcgtctcccagctgagcggtggcgggacttgaatgagatcgcggttctgtctcattctcaaactgctgctcttatcactgtgaaggaacagctatttagatgggctggcctgagggcctcctctttcccagacggcacggacgcagtattctatcagggaatgtggggccagctgggcatctggtagcccagttggttcttcggataatgggctgctcagtgaaggaacctggtgctgtaaaagtgattccccytctccttccagtcttgggctaaaactggagctgttcactgtggttgtatctgcctgaaaggaaagggcagatgaaagctggaaggagcacagccagcacagtgggaggggcctgcagggggctgcwggtggctgcwggtggctgcaggtttcccacggagctttcagtttgcactcagggctgtgaggtcatggaggccagcattgccttckcatggcaggtgtcccggagtccctgaatctgtgggtttcccccaagccagcacctttgctgcaaacctctgagtttcctgttagcagtttttgggttgctgtgatgaatgagacaatatccgtaatatcacagcgtgtatttctgtctttccaaggatgtgtgaccggaatggtggtcggcggcttcgacagtggctgatcgagcagattgacagtagcatgtatccaggactgatttgggagaatgaggagaagagcatgttccggatcccttggaaacacgctggcaagcaagattataatcaggaagtggatgcctccatttttaaggtaaagagcccagctcccttccccactgtgggcacagtgtctcctttccctcatggactagtggagatgttgagtgacatctttctcatttacttaaaaattaatccagttttttaaaagcaaacattggttcaggagtgctgaatgtgtctcagacatgtacatgagctgatttcacatctyttgaattacggagtcacttttgtggtcgcttgtattctgatgaggagatcgaagsctcttttcttctcttttctgctgcttccttttcctgatgagccaagtgggagaaaatacttcgagaccttcacgctaagacctttccccacgggcttccattagaggcgatgcatataccagggaaggtttcagtccttgttctttcaaagctgatacttctgcctggcattgtagggccagctcaggagggtgagatgccatctgtcattcctttgggggctgggccgtgtggggggttgtgaacctgcagcagatgtctaaaaatagtctcacctcccttgagagtaatcggttcyccatgcgtggagagacgtgatggagggtttgttctgtgccaggcctggcccacggcttgttttctgctcacatgatcctgtgtggtagatgctgttcccaccctcattctatagaggcactgagaggagaagtgacttgttgaggtctcacagctcttgtatgacggagccagcattcagatgcaagatggcccaactgtgaacccttggtcctaactccagaatagctgatcaacagagatttcttgccattacacctagattcagacagaggaaccaggaattagggcagcccagctctgcagaccagctgggctatcgaatsccttgtgggtcatcagagtcctgtgtgggcatctctaaggctccagatgtccaggtttcacctctgggagattcggagcccaaggtcaaggtcaagctagacttccacgtttgccagtgtggacactacacgtagtctgagtcctagcccaggttataagccattgccatgtgtgcttattctcttgcatttgggggccagagatggggaggggagagtgagtgtgggagaggggtgaaaggggctgagttgttgggggccagaatcagacctgagaccacaaacaaggtgtggagggggtcaaggctgtaggagcccatgacagtgctggactcccagccacagatgactgtcccctgacaccagagaacaaaaatgacaaaagatcacaccttaaccccagagtggaccataaataggtcaaaggtagcttaagatgcattttggtcctgcacgtctctgcctgaccgatgtttgcagtggggctgtgcgtttcagtaattctgttaaatctgcaatttgaggttgctgatcttcttgagaatctgatgcccattactgaccacgccaaggaatatggggacaagggaacgctttgcactcactttcgaggggtcccttggtgcccccacacgttccagattctttctgatcaaggaccccaggtcagggagcctcagcaccaagaagttttgtgatgccactgcctgcctcctcacccttagtgccattgtggatttctctcttgtttgattgcagatcttttttttttttttttttttttgcctttggcatcatggtgaacttctcttgggaaggactgcaaatgtaaacagtgccagagtcccattcagtcggttgggaactctgcattatagataaccccaaaagccggaatttctctgcctcgccactgttgatgtctgggtctgggcaattckttgttgtaagggttccctatgccttgtgggatgtttagtggcatctctgacctctacccaccagatgccagtagcatcccctcccytactgtcacaatcaaaaatgtcttggacattgccaaatatctcctggtggggcagagtcttcccctccccattragaaccctgataagagctggccactgccaggatcaacagacttaaccagaggtgttgggtgctgaaggcacagttgcagrttggacatcagtaaaacatctttaagacatggcagagggtgctggactaggctgtgtagccctgacatgtggcatgctgacggagacgaagcttctcccttcaccccattccctacttcaacttgtgctcggggggtaatgaaataaagccccagatttatacatcttatgcaatgttcttcatggccgtttcaacagtgttgagaaaaatgtgcaagattcccaatgtttccgttggttacgcagtcgcctgatgtggcaatctgaaatgagtctaccatctcagcaggaatggggccaggagggagacgcgggtgcccactggagcagggaggccatcgggagggccaccagtgccggtggagacatggcgccagcaagagcccatcatgtgcttccctgagctatgcttcttcccatccatcctctgagaggcctgtctctgtgacgttggccggatagatctttggctgttggatgaagtcaacctcggtcaggtagagccatcttagggattttccggttatgtagacacttgtttctttcaactgttcaaagaaaacctttcaacaatttaggagttaagaaagaaatttatgagtttggtttcttccgtaataagtggatggtaaaaggggccacttataccagaaaatccctcattgtctgcaggcatcatcctgaggccggcctcatggtatagatcacagaagagaaattgaaaaaacattgagctcattttgtacsgaccctgagtacactgatgaggccctgatagcaactcatttaatttttaaaaagtactttaccttctwgacatgacgacaaggrgggaaaatctagttaagtgaggattatgattcatggttattccaggcatcgtaacagtcctgaatgagttaaagctcacttagtagcacagatatttctcattcagcaggccttgaagggaaaaatagcatttaattaaaaaaatgcaacatgaaacaatcatattaaattaggaagacctcctggtcttagttcagtgctgtcagcctgagttgtgcgtcaacaggagaaataagttatggtggaggctgaatgagccatagtgactgttgctggcggcaggggtgggggggccctgaaatcactctcatgtctagtttttgctctagctcaagaaggatctygagagatcatcaagctaagttgaccttttaatgctggccagagaggctgggagagggccaggtgcctgctgtgtcacagagttcagggcaggcggcaagccaggtacccgatggtggccctggatgcttcctggccgtgggccctgctgtgatggatgatgtggcctggacttgctcgtggggtgagtgtgagcttggcgtgaacgagtgagtatggcagtgccttgcaggcaccgcggttgcgtatgtgtaccagcggatcacaacgttgccatgaaatctgtgcatttcaaggcccgtttgggatgtgggttaactcagtggttctcaggtgggggaggtatcatgatttaccctccagggaatacttggccatgtttggagaccttttttggttgtcacagctaggggaggggtgctattggcatctggtgggtcaaggctagggatgccgctgaatattctacaatccacaggaccaccccgccacaaagaagggtcccagctgatatgtcaggcttgccacggtggggaaaccctgatttaaagtaataaaaatttgaaactacagttgatttagtacatggtttgctggtttatttctttaaaaataaacaacagcaacaaaacccaaattaatgcccggtcagtgatgcagtcaatgaagagagcattaaagaccgtgtgctttaagaaatagttttagaggggagttttacatcaatgtcacatgaggaaactaccacttatgctcactaatgggaatgttcttccagtctctttaccccaggtagaggtgcaacattttgcatcaacaaagtaggcagcattggccttgaacagtaagcattcttgtcttttttgagaggaaaaacagtctgggctattttaaaggagctgtgactcatgggggcatgatggagtttctggaagtgtggtctcctgggtagctaaatccaaatccctggaatactggctaaagacagctacctgggccgggcgyggtggctcacgcctgtaagcccagcactttgggaggccgaggcaggcggatcacgaggtcaagagatcaagaccatcctggccaacatggtgaaacctcgtctgtactaaaaatacaaaaattagctgggtatggtggtgcacacctgtagtcccagctacttgggaggctgaggtaggaggattcgcttgaacctggtaggtggaggttgcagtgagccagattgcgccactgcattccagactggtgacagagtgagactccgtctcaaaaaaataaaaaaactaaaataaataaaaataaaaaataaaaaaagmcagctaccgagacccaacctcccttccccagtgagaatcttgaggggcaaggcccaggaatctgcattttcacaagcttcccaggggcagggggttggtatatgcattaagcctgagaacacttgctgtggtggggaaactgttgggttggaagtgggtacagctggcatttaatcccagactgggtggccttgggaaagttacttacctcttggaattgcattttcytgaagtgggtacagctggcatttaatcccagactgggtggccttgggaaagttacttacctcttggaattgcattttcctgaagtgggtacagctggcatttaatcccagactgggtgaccttgcgaaagttacttacctcttggaattgcattttcctgaatgggatcgggatgtccctacagatctcctatcattttaggctggaggacactgyctgatttttcctgaaaccgaagataattctcatctgactgtggttacctcctagttggtgtgtctgtattccaattttgcaagcttaaaatctgtccattcacctgtcttatttttttaaaatctgtactgccccattctacattatgactttaagatttcagctttgaatttctggtcctagttcagatcctaaggtttggaaaagtcagaaaacagatctattaaaaaaaacacacacacattaaagggaaagtacttcattacattttaaacagcacctggggggaaaagtctagaataaatgcaaaaatgcaaaacaaaatttctattaaaagtaacagggcgatggatgaccattttgactttttgcaaatgttcccttttcatgctaaattttaggggttgatctgaaaaagcaacaacttgttctttgttttgaacgctctggtgaaaccatatgcaacttcctctttgtgctgtgtaaacctcaggtgtctccagctcttcagccaggcaagggcttggctaaaaggtgcactccagggttggaggagccttcagcctgggttcgacttctgactcagctgtatgaacctgggggaccccctccctggcttgggtctttccacatctggtccccagatgtgaaaagactcaagacatctgattggagtctctttgggtcctgaaattgaatgagagttgatggccaacaaagaytcatgggaagggaaggatgtgtggggtcctggtcatggtgacggatatttgtgattggagtcggccatgaatttaatgtgcttctgtttctttcttcargcctgggcagtttttaaagggaagtttaaagaaggggacaaagctgaaccagccacttggaagacgaggttacgctgtgctttgaataagagcccagattttgaggaagtgacgraccggtcccaactggacatttccgagccatacaaagtttaccgaattgttcctgaggaagagcaaaaatgtaactatcctttatgggcatgaaaccttccagaagctgccctggcctgtagccttcaccacagaacttgggtctggggtagacacagggtctggggcacatagtttcagttaaacaaagcagttctctccttcgtgtaagcagaaattgagatctctttccagtgacctcagagggaagggcggaggagattgggtgctgcccaacctgtgccccacttgctgcctgaccacagacatttgtagggcctccctggacaggaacaagcatcctccagcagtttctgatgaggaatcctttcattttccagcagcttgcagaggaggccaggggaaaatatggtgaccacagaaggcctggatcrtgagggttgggagtaaagctctcasatgaagttgtcaaagatggcaccatggccttcgttgttggagatgggatatgcctcagtgtgttactagatcctgattgttatttgggaactccgggatgtgatcattcctgaggtttcttccagctctcaaatcccaagaaagcatttgtgacagattaaagcaggacagcaaaaacatgccgcaccctggtcctacatcactaaaataaatcccaaagtactgagctgggatctggcctcagaaggcttctcaragccctgtgctgtgccgctgccatgaattgtagctgatttaygagataaaacctaattaccagcgctggtttagaacatgcttttaacacattgattttcttagccacttgatgaggcttttagaataacccactctggctttctccttctaagcttctgagtagtccacgaatgcctgtaagaaacagaaacccccaaaacttcttggggctgtgcagaagtttgaagtttgcactcttcccgctgtgggggtgttgacttagaattttttaagaagttaaaatggtgattcaaacaaatctatagtgaatctgtgtcagagagttgtgtaatcgtcatgaaggaggcagcatgatggtaaagatggtggacagagaatccgaggtgctggtgaatgtggcccatgaacgagaaagctgagccaaagccgatgcccgacccggacagtacaattgcggtttggggcgtttgtagcctaatcgtctgcaattagcacctaactctactgagcgtgaaccctagtcaatactaaatagtaaggccaacaaactgaccttcccttggagaatcgggtgccctttaggaggaaacctctatataatagtctggggtgaccctgaaaggctaagcagtcatctttttgcctcatttcccagttttggacaattttttttatcaccaaaaagtaaagtgtgatttgaaggaatagagaagtttcttttggcccctactgccacccccaagatcagtcaggcttgaaccggcaggtgaccccaacttgtttatagcatggggtgcagccagcatcacctgctagtgatgttaaagaagcagcaggaggttctcaggggtgaagcaatgtagcatttgcataattgcctacaggggcccactcgcctctaacctcagtggtttgcaggctccatggtgggcgccccacctgctccctacttccccatcagtagcttctcagtgaattctttaatctatygaaatggaatcaaaattcagccrggaggaaacagtgggtaaattctgtaggtcactgggaataatgaatttttgtaagtgttggttgtgatacgtctcacactgataaacttcataaggtaagttgtcgactgaggaagcggcatgagaagggaaagagcagaggctggcccagcgtgcccctgtggacactgtgcacctttaggcggtttgtgattacggctggtgcccactgggcatcagtgagggtgctgcggtgtgtgtgtgtgcatggctgtgtgcactgatgcacatgtgtatatttggaaaggccaaaaagagatttcctgccaactggcaatacaaaaaagaccccaacctgccaacacgttttgccaggaaatckgtgagtgttttcaaatgccctgkcttataaatgtaaccttcttaagttagcaaatgcttgctgtaaagtatatctgatacagactcattttggatctcagaaaatagaagaaagagaccaaagtgctgtctttatcctttaaaagtgttagcagaaacaaccaccaccaccaccaccaccaacttctctcttttgactttgctgatcagatgactgaagyatgggaaaaawattctgtgcctttcccaaaccaatgaagacactcactaacttaaygtttccttaaactcagcatttacagagtagattatggcttcagcaaaggctgtgatgcctccgtgccatgtgtcatggtgtttgtctggttttctgtaggcaaactaggcgtggcaactgctggctgygtgaatgaagttacagagatggagtgyggtcgctctgaaatcgaygagctgatcaaggaggtaagcagaggcagcatttcaggggtctggccctgccaggaggagtctcatgtcttctggcagggaggggcaccgttcttgctgtatgaaggcagccagaccctcgggctcgctgaggaagtggcatctccacctgtacagatctggaacggaaggactggctgggcgccccctccccaggccagcttctgccgacaggtcaacccctcacgccagatccctccttcatccctagggctgggcctgagctgccggttatgtgtcagtgaagttccttccagctccaaastgttcgaacactttggacagcagtcttttaaatggcatcgtgaattcccttgccttcctagcaggctacagagaacaaaatgtaaactttccttgctgcctgcgcttgtcatgatggcgggkgttgttgtaccagctctcatggctatttgattgcttcctttttaatgtgcagkttttattccttaacggattggaaagctggataaccaagcatgttcacattgcacataaattcctaacaggctacaagggagagcataatcggggcctccttaggcaagaayacatggcttttgtatacccatttcagctattgggatgcccttttcttctgtctttggcctcttaactatgcttttcatgggtattacaaggtggacatttgcatgactaaacctcgtgcagcctttgcaaaaggttgtgtgtgagtactgcataaattcttcttcttaataacatagmaataatggaatccttaagagtagcttggctgtcagagaatgaagataacagaatgtaacctacccgaacggccttgctcttctgcacaggcagctgccaagtgtctgggtggtctttggcagccgactgagtgaattcttggcttcgtggccctccaccaatgtcctgttttctgtagaaggcttttctgctgactcagctgagagagtgagataatcggattgccacaccggggtcacaagaaaagcaatttcaaaacatttcataattggatttatcagcctcctttaaggaatgggccagagaytgaacatctgcatgtggctcgttgagcgagattcttgaaagcatggcagcctttggccagcatcactgttcactggtgtctcagagcttgtctgcgtgtccagggcgttgagggcaattggataayctggaacactgggtctgcaacaggcaggtcstggaaagggccargaaacttattagtggcccccaaagagcctagtaatttggccacatggtttgaatgctaagcctggtagatttaaggcctagggcctttcaggttgyaaagtgaaacttgacttttgtctcctgagataaaggtgacaatatggttttacttacacatgaactgttcatttttacaaacactggagccccaggtgggagatcagtgactgagctgccctcctctccctcccctgactgtgcagccttctgtggacgattacatggggatgatcaaaaggagcccttccccgccggaggcctgtcggagtcagctccttccagactggtgggcgcagcagcccagcacaggtgagggtgggtggcctagaattgtcaccaggcatggcctgaagggtttacrgcattccaccagccagggacggagtgggggtggttgttgctatcatgatccatgtctcattaaaggtagctcagccctgagaggtgaagaacgatggccctggtttcccaacatgagggcagagcccagctgtgcctttggccctgctctccgctgcttctcaggagggcacaagctgcttgttccctaggtgatgtccatgccagctctccccacgctcctgggaaagtccagggaagagggtctagtgaacttgtgtaaggccagagggaagatgcagctcttggccacgctggcgccccctccctgggtactcccttaggtcggccagtctgttacgacattaaggaccccctcagaaccaaagagagcccagggcatttggaggagaggagaactcagaccaggaacaggaagtttgttcagagccctrgatttgaatcccacgctgggaagttacagatcttgagcctcagtttattcatccgtaaaacagagaaaccaggacttgcgccatggggtcacgagggttaagtgaggcattcatcctttgattctcttttgatgagccactcagaacycccagctgcttgaaatgcccccgcccccgccaggcccaggcttctgcagccsgtgaatgtgtttgcttcctccctcggcgtcttccccctagccctacatcccctgtgggagtctgggaggtggcagctggccccggaggccttgaaggttgccaggccttgggtgtcgagtaagaggtccctggaaaggcacctctgtctgtgctgcaggaacaccatccggaaagctagcttgcacccccaggctctcccccagagataagccctgggtggtgggtatgcagtccagtggtattctgggggyaagtgcttgaggtgggaaggaaatgtggccccacagtgtcacattgacacatggtcagaaatcccacagcatagaggaagtccccccgacttgccactctggttttctgcatttgtgaaacaatggctctctgctctggtggggaaaagcactgaattcagcggaagcctgtgctccctggagcctctggcacgccatgtgcagccttttaagggacttttggagaaggagcgattggggttactccctgtacaccacacctgggtggctctgagcttgcttttctgtttctcctgcaggcgtgccgctggtgacgggrtacaccacctacgacgcgcaccattcaggtacggggtggtccgggctgagaggggcgtgggcactgtttgaagacaaagcccagataacccaagcagggttgcggggtttcgaggatgagcaggacctggtgtggaagtctaggcctggttccaaggatgagcaggacctggtgtggaagtctaggctccgttccgaggatgagcaggacctggtgtggaagtctaggccyggttctgaggatgagcaggacctggtgtggaagtcgaggctccgttccgaggatgagcaggacctcgtgtggaagtctaggcccggttctgaggatgagcaggacctggtgtggaagtcgaggccccaatttctcctcctcaccatttggrcaggagctggcgagtggcctcttttgaggccacttttcttggactggaccagcaagtagacagagtactctttgaggctgtaactgtgcaggagagacagtgagggacaggccagcgtctgtcccagcgctgcctctcttttggggctgcaggtggagtgrtggagcctctcagagcctcatctcaggctcccctgcccaccacctctaggtggatgcagctgttcccatttcgcgggctcasvbadcttgtgtgctccagactgggggcctccccgcggtgggcagaggtggcctttgtgtgtagtctcagcggctaaggaccctggctgcacttctgccagctgcccctggaagtgacgctcaggcgtggtgacggcatcttctgaacaaggaagctggggcatcttccagcattggctggttctgtgggaggcgagcagctggtctcatcagatgggccacagaacgttagggctgggcctctgggcaggggaggaaatggggcagggatagaagcgtgctggctgaggactgcatgggacagttttgtgggtagcagaggtcggtgctcacccaggcaggaaaactrtcsagatggcaatgccctgtccatgaagctcttgtstatttcctggcagccctttgagctggggggttgttttcactccggcttcacagatgaggagactgaggctgggaggttcagkatctcatccaggtcgcgcaggcctctggctggagcctgttcttgaggcctccttgtgcccggcagccgccatgctcacaggrtctcagttctgggaggcctgggtcatgaggctaagcctccgggctcgccagccactgggctatggcctgggagtctgctgaccagtgctttccgggggctgtggagtagccaggcacagaactgagccatctcggtgagatgcagaggcacartttggggagagcatgtccttgaattagtccagcagggtcatagccactkcctcatgcacagaacatccttctagaagctgtgagctttggtacctctgtccagccccgcccccacctctatgtaaatccatgcytcagtttccttacctggaaaatgggtataataataatctaccttacagggttaaatgtgctggtaggtcccaagccctgggcacagcacctgatatgagctgtgtagaccatagtctgtggtttataacttcaggagtcttgtctgtgtagrtaagcatttgtcctgttacccagtttctttaactggtgcttacctgtgccgagcacaaatacaagctccgataatcctcacagcagcccagtgaggtggatgctgtttttatctctactttgctgatgaaaagctgaggcacagagtggggaagcggcttgccccaggtcatccagctgggcagcrgctgggctgggaccgcacgtcaggcaggtgggctgcagggtctgtgctgcgggtgtctttgttgctgcctctgtggtcaggccgttccccagcaaggctgttcttgtgggtgagtggctctataagggcagggctgggtcgcagcaggcccttactgttgcagaaggctcacctgcctcaccttggcagcccttggtgagctgcttctcacctgtcaggtacaagcctgacagctggaaccttctcttagcataagacgttctggggtgtgtggtcactaagacactcctgcttaggcgtctctgaagcacttagctgttccgggtgaagctgccagttcacatgactgagaggtgctggtaccaagataaggccccggaaatgacagggcaaagggccaaaggggtgacggagttgcctgaagcgtttcattcatttggaacaaagttcgaaagttgcttcagggtaaagggaggggagtgtgtggagtccgcaggcagtgcagaagttgcagacttggcgtggggggaagatgatgagtgaggaagagcgagaccagcggggaagatggtgagcagggaagagcgagaccagtgctgccatttccttctgggtgaccctatctaggattcagtttcctgaagtgtcaaatcaatgaggtggaccagagcttctgcagctctagcttcctaccctgcatgattctagaacctgcgtaactccagcatggctggaaatggagcccgtgaatggtgggttgtcaaataataaggcagggagcagagcccaatgggagggtccaaggagttctgagtgcccagcagtgtcagcagggaatgcagatggactcagggcctccccagatgtggtcagccttgcacaactctagggggcgccgtggagttaggcacctcacaacttgtgtggctccacaaggcagcctcgaaccggtctggggtacttagaaggagctgcaaactcactaagctcattgctagcgtatgtaattcttttggtttaaggcrattaaaatgcagatacctccctgcatttacatgttatctgcattcctaccttagwttagtgttttccaaactttggtcacttgaggtccagtgtcacaattggttttcacagcctggactgttactaacatcatgtttttcctcaaatcttaatcttaaaataaaacttaagtttattttaaatgagaacccactatcattggctgtaaaggaagacctgtggcacctggtataagtaggtaatactgtctggctagaattgattaagattgtatttgtctttcattgaatttgtcttgacctctgacaatgccctgaatttggagccctaagttcagtgccattattcaaaagggaggttgacaggtgttaggtgttagagagctatcagcaccaaactgaggcttgctttttgaggtaatcagaggttggragaatattgaagatggaataatcttgtgattacatgtatcacccctcccccattattctgtgtgtgccacttttggggaacccctgctttagtttgagtgtttttcagactctttcctgagaacagatttggatgaagggttttgcagagattcttaatctgaaatccaggaaataccaagggcgctgtgaatttgttgagaaaaagattatgtctttattttctttaacttcaggtttaaattgagcatttccttttgttatgaatgtaggcagcagacygcagtgcccttggcagtgcctatgagacggagtattgtcataagaartgagttgtcgaaacatcgtttgccctcagcttgacgtgtaaattacaacagttaccagaccttctctagaccttgtatttaaagagtcagtgaagaagtacagagaacactgtkgtagttaatatgttcagtcattggtttccttagtcattctgtgtatttattcatgcatataaaaacattacttctacaagcagtacatggatttccccagaatatcaaagtggttcaagacacacaaagagttacccgtgtaggtgtgagacagactgtgcacttgggcaggagggaccctgtatgtctccccgcagcaccgtcatcgtgtccctcttgtccacagcattctcccagatggtgatcagcttctactatgggggcaagctggtgggccaggccaccaccacctgcccygagggctgccgcctgtccctgagccagcctgggctgcccggcaccaagctgtatgggcccgagggcctggagctggtgcgcttcccgccggccgacgccatccccagcgagcgacagaggcaggtgacgcggaagctgttcgggcacctggagcgcggggtgctgctgcacagcagccggcagggcgtgttcgtcaagcggctgtgccagggccgcgtgttytgcagcggcaacgccgtggtgtgcaaaggcaggcccaacaagctggagcgtgatgaggtggtccaggtcttcgacaccagccagttcttccgaggtctgtaccgtcgtcaccttgctgcccccacatcttagagatcacgcctcctatctgtgtgccatttgcagctcagggtggccctgtggtctcatggagggatgtggaggaggagtgaggggcatggtgtggcaaggaggtgctcctttgaatggcactctgccctctccactgagcgatcctggggtgcttctctgtgcctcaacttccccatgtgtacagtgggggtgcagaatcagtaccctcatcaggtgattgtcgggagggtaaaggaacttaacctcatgtaccttggagtatgttccaaggatggtccctgagcgctggctagagacrcagagtctgaggccctgctccagccacaagatccgaacctgcatcttagcaaggtccctggggatctgtgtacaggttttgagacacgctgactttccgcacactaagtgctcaggatggcagctgcacacactaagtgctgcctgttagctttcgttacgctgtagggaggatgtgtaggatmccagcctgggtgtctcctggagggttaggatggcgtctcccttctccacgtccccatgctctctgctcctctccctgtagyagcacagcccgagatagtgtcaggtctcagctgccactggcctgagaactgccagaggaggggcctggaagggcgggtgcaggggtatgtgtgagctcaggggcataagccctgaggaatccccctagtgaggaggtgtgaggccgcggttatcacccctgagcaggcagagcggcacagaagtgygtcctgcaatgtacattcccgggcctacctcacatcctctgattccatgggtctgaggcggggcccaagattctacatttctaatgagctcccagggaaggcgactgctgccggtccaccggcccactttgagaccctttcagttggctgtcagagattcgggtgagggctgcagccctccctgggtgtcctcaggtcggggttgccaactcagttgcctccaagggccaggcaggtaagagcaatgcacgaattgagagataagagagagcactgggcagctgtgcccatggagakgcgttcaaacgaggcattaaaatcccggcaacaacctggaatggccaaacgaacagctccttgcttggaatttggcccaagggccaccagtttgagatcccatggtgccctggcctaaatgctacaagccctgggcctcctgatcccccagccctgctgctgcgggagttggaggtcatctcggccttscttgcaaacaccctctgcctgtgtcattccagagctgcagcagttctataacagccagggccggcttcctgacrgcagggtggtgctgtgctttggggaagagtttccggatatggcccccttgcgctccaaactcattctcgtgcaggtaagtatgggcagcttttttttttttttttttttttttgagatggagtcttgctctgttgcccaggctggtgtgcartggcgtgaccttggctcactgcaacctccgcctcccgggttcaagygattctcctgcctcagcctcccgagttgctgggactayaggcccgtgccaccacgctcagctaattttttgtatttttagtagagatggggtttcaccatgttggccaggrtggtcttgaycttgtgatcctcccagcttggcctcccaaagtactgggattacaggcgtgagccacctcgcccggcagtctgggcagctttgagccctgcatccaggtctcctggccctgtcatgtaaggatcaagttttgggctggagaagaggacacaaggacaagtttccacctgtgtaggaggcaggcctgggcaagaccttcaatatgcgggaagcggattcttgccatctccgagccatcttctggtgtctgggacgcgcacagtctgtgtgtgtgtgttttcttttttcttttttggtttttaaatctaagcctcttctccagaaagattctacctgttcagttgcccgaaggtctaagtgacagattagggcattgccagcccttatttcatgtagtcaagggaatgaatctctaatggtgggatcctgggtgctggctgtcccagctgggacagtactggggagtatggaacagttttggcaggagtactgcttgcccttccttggcattctggctcattcacttgggactcacgtggcactggggtcatcagaggacctggctagggtcaaagacagtgcccaccccctttggagcctccgcctctgcctctgactttctgcacctcccatctagattgagcagctgtatgtccggcaactggcagaagaggctgggaagagctgtggagccggctctgtgatgcaggcccccgaggagccgccrccagaccaggtcttccggatgtttccagatatttgtgcctcacaccagagatcatttttcagagaaaaccaacagatcaccgtctaagtgcgtcgcttgggcgccccaccccgtctgcgtcctgcatccatctccctgttacagtggcccgcatcatgattaaagaatgtggatccctctgtctggggtgggatgccttactttgcacttaatttaataagggcattctcggaggagtagacgtttaatacgaagtggcggcatagccctgccgagatgtcggtgatggcctggatgctgtaaccacaacctgtggctaaaaattttattttctatcctttacccgtcattatcattagttgctatgattctttctgcattttcggttaactatcatttccaaagacttgtcattcagtaatattagcagatagctgcttcgataaaggaatttggagtttaaaaatcaacttgtgaaaacaaggttgtttttgtctttatcktttgttagagttatagatttatgatttcataggcttgattctatgtgaaatatctttttacttttatgcattttaataagatttaaaaatatttagattaaagccccctttaatgagtacaagaaaaactcttggcttgttagaagaaagtatattctttctagaatttggtgcaggaatatgtgttcatatccaggcaaacgggtgtgtttttatcttcagacaatgaaaccttctcctctggggctttgttgccaggaagattagaactaaatttatttttttcatttctgtcatgaaatcattccagatacctcttttcttctttccaaatggttttcacatgtgtttgaaatatytgtacttygaattgtcggattttccatgtcctcctttctcctttgtgcccagcctgagtcagcaccatcccgcattcagaacctcccagtgaaagggcagccttcattttgagaaggtggaaggtgttagggtttgggagacagctcatccaatctcccaagtctcatggtggatttgtgactgtgagagtttccggtttaaaatctgaaaagccagatatgcctgtttccttttcccagcaccatgcctgtggaggggacagtcagacccagaggtcctttacgtgtggatggagttcacaggcgaatagaggagaggaccaggggacgtggcttgtcccttttgtccaacaaagcattatatttttaagaatggcagwcctgtttgctgaagtgttcataagataacaataggcttgaatctccaattcaaatgaatgtcaaagcacatatctttaatatgctgaatgaatatttatttttgtatccattaaaacagtatattgatctcttttattctttattaaaataaaatgctcttttttaaagctgctgtgtactgtatttttttagtcactgtcaaatatgatgtaattctcaccagattctaggttctgtaaagggggagttactgctgcaatgtgcagtgttaattcagtgcactggactgaaacaatatcgcactgggattttaaggatttttttttttttttgagacaaagtcttgctctgtcacccaggctgaagggcagtagtacgatctcggctccctgcaacttccacctcccaggttcaagcgattctcgtgcttcagcctcccaagtagctgggattacaggcatacgctaccacatctgcctaattttttttttaaaattagagttgtgatttcaccatgttgcccaggctggtatcgaacttttggcctcatgtgctctgccccaacctctcccccagcctcccaaagtgctgggtttacaggtgtgagccacctcacccaactcctgttttaaggatttttctttttcaacctatcccttaaacaacagcaaaaagatacggagacttagactgatcctatggaatgaaaacattggagaatgtttttattccgaatggggggctgtttgggtttctgtgagctgacagatgagtgtgcggaagggtgtggaggaagtggggtcttgtgctgatttcatcctcctggatgcagctggggtgatttgtacgaggcgtccctggttgggtcagccacacgtggctggagtgtgtgtcctatttacgcacatctcgctgtgctaggccctcaggatacagcaaggacatgagggacccaggttggcagtcacagagatgacttccagcctagtaggacattcccatccatcaacacaacaaaacccatcaattctgggaggtgcagggctggccaacccaggtggagagaagttccccagcaagcttcatccgcaaggccatgtctgttctctcctctgccctcatacgagcccagtgagactgggcctgttcttcatttctagcttacagatgaggaaactgaggcacaggctcatgcgtggctgactgagagccatctatgtcccaggaggacagcttcgcctgagaggcttcatgagcagatctcgctgccatccttgagctggtgggcttcctaacaccccacgcaagaggtcagcagctgggtgcgtcgctcactgtcttaggcatctttgccatgagtcacactaatgtccgcacgctgcaagtaggaattttgtttacaagcaagctcttctccatcctgtggattcaaggccaaatgtggaaagttgatatcgtctgttgtctccccagagttcaacgctctcgtgcagacggtcgacaaatccttcctactcaacttcttgcagcaagctcggggagaggcgggagaggggagtgttttcatttgcagaggaggaaatttgggaacaggatgcttctttaagaagtcgggtttctagagaatgctgtgagggccctggatgtgaactgacttttgagatgctgaccccacactggccagttagctctgggccctggagggaagctggtggggatgggctgacgggacatcctgaaaaacaagycatctccactcttggtagtttaaaaatgttttaagaagttaaggtatttcaacaattcctttctgagtgattgccacttagttcattaacttttgcaaaatcccactttgggaggccaagacaggtgggtcacttgaggtctggagttcgaaaccagcctggccaacatgatgaagctctgtctctactaaaaacaaaaacaaaaacaaaacacaaaaattagccaggtgtggtggcaggcacctgtaatcccagctacttgggaggttgagacaagaatcacttgaacccagtggggtggaggttgcagtgagccgagatcacaccactgcactccagcctgggtgacagagtgagactctgtctcagaaaaaatgtgcaaaatccatctgggacacaacatttttgcttgccctcgtaatgtccagaaggctggagatgatgacccctgggtccaagcatcctcaggatccggtgggtcctagaaatcctgggaaaatcttcctgaaagggcttcaccgggcagccacscatgcctgccacagggacactttctctccataaagaagcagctgtgggaatcaggaagaaatgactcctgtgcatgattcagactctccataatagaaagttttgcaacccaatgactcggaaatgtttagaaattctaaagaataatctataattaatgactgtaattttaacaacccagtgggctgagagtggggtgtggcagtttctcagtggaaaatctggctgcttttactacaagtaggaggagaatgacaaatatcctggccccagggcacacctgatctcaggctttctcttcaagcacaccgttcattaatctgttaaaaggcctagctcatggtaagaagcccatttaaaccagcatttcccaaacttatttgacttgacgttttgccttgcagcgtgtctgtggatgagaggtgcccacaagcgttcagtcttttatcacaatccgactggaacatcttaggagttgagaagagtgtgtacattatttctttcctattttctttgggctacctttcagtctggatggagtctgccagggatggggatggcttcagtctcctctttatatgtaactaactattcctaaacttagtggtataaaaaacgctttattttgtgggtcaaaatttagacagggtacagtggtgttggcttttctctgctctgcaatgtctggaatgttagctgggaacagctgagagtgacttgaagtcctgcagatagaaccacctggaagctttttcattcacatgtctggtgcttgggctggaaggaggtgaggctgggcacagttgggataccgatgagaatattgactttggcctctctatggagtttgggcttcctcacaatatggcagcgtcagggcagtcccgtggacacaggggaagctgaatggctgtttgtgacccagccatcactcaactggacaaacaagccctcctaggttcaagaggaatggacagaaacaccacctcttgaggaagaagtgtccaggaatttgcagccatgctttcaacctgccacgggagccccgaagcctctcctttgctgcaatcccacctgccttttatccccctgacctctccttgggcatcctgattcctttctgaccctattccttgagtcccaggcagatgggccttttcctcactttgtcttgggagtatggcagtggactctgcctacttcataatggagcctttttcttgtccattttgatgacctctcagagcagggctctgacacgttactgggttacaaagacccctccctgccagggccagcgtgcagcacagggtgcttttgagttccggtgaacggggtgctctggctggagcctagtgcgaagtttccccttctccgcccattcctcatccctcagggcacacaggtcacctttcctcgccttctcgtccccacctctaaggcttggccaaagtttcttcataaaagcaagaaagataacgaaagagccccccatgggttatggtttttgtggggccaggaatgcccagtttgaacctccagttccgccacctgtagccgagtgaaagaggctgggttattcagacaccccaagcctcagtttccccacttgttgtgaggcttgagtgtgctaacacatcaaggcaacccagaacagcgcttggcagagactcgcagtttatcactgtgaactgtcgttattggaaagtgggtggagtcgggtttggattcccccaggagcagagacagaaacaaaaggattcaaggtaagcggcctgtatgggaggtgatctcagaagtgctgggaggggaaggggacctgtggctttaatggtgaccctgtgctactggaggcctgggatctctgaggaatgctgaggcccaagccctgcagagccagccccgggttgttaattacttggcactttcctcttgccttatgtgcaggggtgggctcaggcgactgaagtctcagacactgctgcaggtgctggcagggggagtcacagctgcataaactggaatggggcaggtggggtggggcgggtaaggggttgtgtttgcttcggagagggtttgtcagcactttgaaggaaaatttgtgtagtggccggaaccacagatgacccagggtttgtgttccagcccagggatcattagctgtgtgcgtcacttaaactttctgttcctcagtttcttcatctgtaaaaaaggggcaataatgttacctattgggaggattaaatgacttaataagtatgaggggcttagaacagtgcctggcacgcagtacatactaagaaagtggatttgcacatatcattaatgcctccctccctttctttctttcttgtttatttattattaaatagttataagtataaataattacaataatttatgtcaacgaactatagtgtcaacaataactataggtaattatttaataattagtaattataaaataattgatactaaattaactatagaattatatagtgccagagttgtttggctatctttaattatacatgtagttatttaatttcacaaatagttatatgaattatggaagtgaaggtacgatggtataactatacaattattagataacttatcatagtggtatacatatttatcatgcagttattaaataattacaatggaatgacttattcgctctctgcgtttgtgcaagggcaaggatggccacgtcccagctctatccagcccctggcccagtgcctggggttcggtggcgctcakttcacgcttgcagagcgagcggcggtgagtggatgcggtggggtcgggctgtggtggtaaaggtggccgtgaacaggaggggccactagagcacacagacgtgaatgacatggggctccaggaggggcaggaagagctacagaaacagcatccccaaagctgcctggcacggaagaggtgctgcagaaatgggacttcccttcccatcctcttctcctgataaacaactgaaaacataagagcgagatcttggggcttctgtgaggttaaatgaacgaacaaaagtcttacagcggaaatcactgagaatctcccctcccctgtcttccaaggagaacatgattgtgagcctgctcctcccttcctgggggggttgcttcctgctggggagaggctaagttgaactctaggatcaagaaagggaaggaggcagagaaaggtgagaaaggtgagaaagatgagaaggtgctcgcatggagcgtccgggcagtaccaggctggcccgaaggaggtgcggatgagggggaaaggctgtttacagatgtggtggcttctccgtgtgcattcacctcctgggtctcaactcgtgcagatggagggtctgagttaatctgaggttacatttgtttgctcagctatgctttttcaagaggccattcctctgagactgagccccatggctcctggctttacatgagttacacgcatcttcttctccttttttctaaatagtaaggggcagagagagttagaaataaaaaggaaagctgaaaacaaaaacctctcagaagagactctggctgttttttgtttttttttaatttttaagtttttattaatgctcatcttccctgaagagccctggctgttttcttgaccagcttctggagagaaaaatcacagtgcatttgagtagctccagatgtgatctccccattcagcatttcccttcctgtagcatctgccgagccttccttctggcttctctgctctccgtgcctgaaaggagacattgagcaatccaggccagttcgaaatcctgagcccagaaataaagtgactgttgcttttgcgtccttgcacgtttgccccggctctcagcagaggcagaaggtgat

SEQ ID NO: 12197 - DNA, 91614 bp, Homo sapiens
gtattttagtagagacaggatttcaccatgttgcccagggtggtcttgaactcctgagcccaggcgatctgcctgcctcagcctcccaaagtgctgggattataggcgtgagtcaccacgcctggccaacaaatgaccatttttaagacagtgttgataaagtcctgcctgcatcagtcaatatgctgcagtttttttaaagcctcctaaatttcaggctaaaaacaacaagtttaggtctctctcatgctacatgtctagaaaaatgtattggctaaggtaaagtgtactggcttcaggtatagctggatcaagatactccaaagtgttcttcaaggacccaccctctggttccctcagatcttctttcctttgtgttggctccagtctcaagcagcctccaccagttccaggctgacattcacataactcccaagtccagagggaaaaagaggtgttttttgttttttggttgtttgttttttcccaggaattccaacaaaaatcccagagtcaycttatctagaatatatgagtttcatatccatccctgaaccactcactagaaagaggaagatggaaatgcactgaatagcctggagttcatgggggaattagccctattcaaatcaagtaagctgaaaatgggagaggactagtccctcaaggaaaatccagccaatgttaccagatgaagggaggatgaatgttaacgcaagcccaaactactgtttgcattatatggttcgaggcttaaaatgttgtgactccctgcctggtttcaggccctgatggttttcctattacagagggtagcaataacgtcccctgtgtgttcccttaacaattataaagaaggttactcaattttattcatccaacaagcagatattgtgtgtctataatatactagaaactgccacctgacgggaatccaaagtctaatgaaagacagtctctgcttctgggaagaaggaaactaaaacaaaactacaaattactgttgtacgtattataaaagacatatatatatataaagtatagcatgacatttgacctgaatcttactggtcattgaatttacttttctagatcaattctgaatctcacaaaatgcacttaaatctaatttttaaaacagaaaaatctagtatttttcatgagaacaatgttatataaatagccacatttcaggacccaaagattgaagtctagaatgtagcatccttgttgttctactgtcaatcaggatttcaaaggagacacacacatggtgttctaagactgtgtgaaagtgaaggtgaccttgaaaacagttcttgttttgttttcaaacgaaaataataaatgctgcagggagataactgtcacacattctttgagacagaacagccaacaatttgcaatcccatctgccatttaaactgctgcagaattctttggtaaagactgctttatgctaaagcaggtagtgccagcttagtacaaatgatagacgagagagggttgtgttgacagccagagcaaagccctggacaggcttactaacagaagagattcattcctcctcaacttgtcacatcttcacaaatcagaggaaattgtatgaaatataatagacgagaagaatttgtgagtgaaacttggaattattcccaaaattaagtcaagtggtggtatttctttttctctttggctagaaattcatattaaggtagaaaaaagtggacatttaagatttaaggaagtttttaaaacatggagactagtcttcatttactttcattcgagacacacttattgagcacatgtaatgtgcctcattttatgcaaggcaacattaatgcaaaaacgaatgttacacaatacttgtccttgtctcactgtctattgggggagataagggcataaacaaatagttacagcattatgttatatatgctgtaacaggcttttacaaggaggaggagagagaggctcatggagaaagtcatgtttaagaggagtcttcaaaggtgtgcagttcactaagttgacaaggtcaaggaggacccacgtagtgaaaggaaagccatgaaggaataaagtatgtcatacacagggaaggagcagagggcagccattgaaggcttttgaataagggaatgacatgatcaaagttttgactctgaaaaaatccttctgcgggtattaggaaggattagactgaagagaggaagagtctggaagtaggaacacttgtcgggggctctggcaggcattcagactgaaatctaagggagggcaatgaggttggagcaaggggacatgctggctagttgctaggaaagtagaaatgacaggacctagtgatggggaggggagggaatgaaggaacgagaggtgcccaagattcccaggctaggctggcttcatgggcatgtgatttgtgcaattgcacagcaccccctaccccactcaggagagtcccatgctaggtttaatgctctttcactgtctttacattaataataatagaggggctccacatttgtgccctgctaatcatgcagccagtcctgttcccagatctccgtcttgagctaaggggtggattatggtgccaataattgaaatgggaaacagaagacagaacacattttgttgtaggagaggtgggtggagagatttcagttttgccacagatgaatttcatttacctatgggtcatcaaagtagagatattcaatggcctgttggaaatggtatgtaaattccaagtgaggtacaagctagagatatgggaattagaggttgaggagagtccaagtgatgcacccctggatatggatgagtaaagggagcagaaaagagagacagaacctttggtagcaccaatgtttaagggatcagagaagggcaagataaatgggagaggaggggtcaaagtcttgtgggaaaattctggaattatgtcctggaagctaaggagaaaggagtctcaagaaggagggtgtgatcatctgaagcataagccacaaagagatcaaataagatcacaatgggaaaacgtccattgcattcagattagaaagtcaagggcacttaccaagaataaatgtgtgcgcaaagaattgcagggtgcacagagcttcccctccttcctaggaagacattgtagatgccacgcccattccaagctcttggatacgaggggcggagaggacgtgtcactttctaaagaacaaacacaacaggtggaccctgtttctaaagggttaacccgccttccccgagtgcagggcatgagagttttagccgtgggcaccgtttggtgattctccaaaggaaggagagggagtatagagtctttatccttcattccagccacattgcctagagcaggagtatggaacaaagctcaagctttgattgagcaaaccctagaatttgctcaatccttcctttggcttcatagctcaggttcttgaaagtatagtttgctcttatgctctgctttccccaagttcctcctccattccatggcagtgtggcttccatctccaccacggttcttggtaactgaccttgactttttttttttttttttttttttttttgagacgaagtcttgctctttttggccaggctggagtgcaatggctcaatcttggctcactgcaatctccacctcccggtttcaagcaattctcctgcctcagcctcccaagtagctgagattacaggcgcctgccaccacacctaatttttgtatttttagtagagacgggtttcaccatattggacagactggtctcgagctcctgacctcgtgatccacccgcctcacaccccttacaggcatgagccaccatgcctggccacccttggctttctaattgctgaatgcaatggacattttcccactgtgatcttatttgatctctgtggcttatgcttcagatctccctcttgaaactcttttctccttagctcaatctttgattccatgagcaaatctccagagctcaagctttgattccatacaatgcagagtttgtgttgtttttacttaaaacaggaggaggctgagcaagtatatgagagcactgaacttagtagatgagaggagggcacacttctaggagagaagcacaaaagatacaggtgggaagggaggtaggcaaattcatagatgaagtggtcagaaggtgagtgttacacacactcctccccctgcacatatacaggcaaatttttaaaaacctaattttctcagtagtgttcaatttactactgcaagtgaggtgatcaggagagcaggtaggcttctaaacagtgctgaaagtaaatgaccttttgcaaggggagaggacgctgagcagggacaggtagcaaggagggctcagctgctgtgagagcagaggttaggctcaagaaagaaaaggagctgaaagatgcttgcagtgtgtgcacatgaaaatacgaaactctggcccagggtattaaaagctcaacaggaagaaaagacatttgccttttaatatttttcttttaattaagccctgaagaccctccattgcaattctacagcctcccaacagcaaggactttctcagcgctttcaggctacccagccggcgcagaggatcctaagcctcagcagaggcaaaacctccccaggctgtagcagggcaagtgctgatttggtgaataatkaatgcctcactcacctagaccccaaggctcccgcctgcctcagactcgtgcaggcttacgaactcgtaaagcagctgactctayggtctaatgattaaacttctctgggccttatttcgttacagctaagttaaaaactgaccagctagcygcttaaactcttctcccggaaatgactggaaaacaagccaagtctcctgactggactgacaactaactatactccctgaattccagccacatttgcccagagcaggactccaagctttgactctgtccattgctaagggtagcagaatgggtggtggggtcccgtcaccaacctcttttccctctccaacccctagaaggtggtgagtttctatgtacccctaatttcaccaggcaggttacactgtgttgttagagacccttcattagaggccctctccccacctcagcatttgcacaccatggagaatcgtcgagatgagcgttgtggggaagtgcctctcatgagagatttccacttcctkgctgtgtcaactcttccacggcgagatgggaaacggagtcagtaacaataatagtgtcatttgaggaattacctgagctaaagccatcatctggatataggtaggaagatttttttttttttttgagacgtagttttgctcttgttgcccaggctggagtgcaatggcacgatcccggttcacggcaacctccttctcccaggttcaagcgattttcgtgcctcggcctcccgagtagctgggattacaggcgcccgccaccacgcccagctaatttttgtatttttagtagagatggagttgcaccatgttggaagtagattttttaaaaacagaactggacgttcaattcaatgccgtgaccacctgggtaacagggattacagataggtcctgaataaatgtgtgcgcaaagaattgcagggcgcacagagcttctcctccttcctaggaagacactgtagatgtcgcgcccatcccaagctcttggatactaggggcggagaggaagtgtcactttctaaagaacaaacacgacaggtcgaccctgtttctaaagggttaacccgccttccccgagcgcaccgcacgagagttttagccgtgggcacgtttrgtgattcacttcttgcgaacgtaaatgcgcgagtccgcggtaggtcccgccggccccctggctgggcaacctgaaaacccacctcggagacgcccccacgcatccgcccccctcgctggacggccccgccgcgcgccgttctgggacgcgcaccccggggcggacccgccctgggacctggaagcgccccagccccgcagcgatcgcagaytcggctttcaaacaaaagaggcgccccggggggtgggaccgggacctcacccggtcctcgcagagttgcggccgcccgccccttcagccccggctctccgtatgcgcatgagcagaggcgcctccctctgttcctcccaaggctaaactttctaattcccttctttgggctcgggggctcccggagcagggcgagagctcgcgtcgccgggtgaggagaacaaagtggctgcacgattttccccmctttccagcccaccccccgcttccgtgggagcgacaggaaatggaagggcgcctcttctctctttgaacatttgccttttttcccctcckttccacctctccagaaaggaagacgggaagaaagggcaggcggctcggcgggcgtcttctccactcctctgccgcgtccccgtggctgcagggagccggcatggggcttctccagttgctagctttcagtttcttaggtaattccgtggaaacggtgcggggaggcggacggacttgggcatggggaaggaaaacccaaaagctgcttgctcaccttcgtgggatcctgggggcttgggagagggactggatggaaatgacgcccctgggattaaacgccaccgcccttgcttcggtggtggctggagacagcgcacgcggagcgccgcggaccctcatcccccgggctctgcgcccaagccccggcccctgcggcctcccgcggcccccgctcagggttttgcaccctcggccggttcaccctgggtttccccaccgcagagggcaggttccctggggttggcggtgctgaccgaggagggctctccaaaaatccattgcccaggagagtgcctgagctgagcggaggcttcattctgggaacagatgggggccatgtggctttaattaaccatctctgtttgtctccggatggcaccagaaacagcaggacctggcgcttccctggaatggagaagccttgaaaccactccagagccccagggactgtccatgggctcccctagctccggaaagcggcgtccaccgcgagccccggcgcctcgtccccagcgaagcgccggtgaccctcgcgcgtgcacgcacacgcactctcgcttcccaagctcacagatctccacgcgcacactcacacygaggatgcgcgggctgccgcgtgcacgcgggttcacgtgcgtgggtgtgtggccctttgggggtcagcctccctgcgccgggctccggacacgtcgaagtggagggtctacacatccaccctttgttgggggagctgctccccggggctgatcagggtgggcgcgagcgtcggtgggtttcccgggagggaggctctcgctgctggacagacctgatgacgtgtgtgggtttctttccgtgtccttctcctttcggagtccctgccttcccagcctctcctgcgctyatctctccattgtcttttctgtgcattttgctttcttccgaatggactgtcctctctccgcacccactcscccgcccccgcttgttcgtttttttcgggctccactccctgyttgtgtccccccaactctgttgcctgtccttcccgcagccctgtgcagagcccgagtgcgcgctcaggaacccgagttcagctacggctgcgcagaaggcagctgctatcccgccacgggcgaccttctcatcggccgagcacagaagctttcggtgacctcgacgtgcgggctgcacaagcccgaaccctactgtatcgtcagccacttgcaggtgagggctgagagcggggttcgaggctctgctagcgcctcctcccgtccagacctaaggggcaggccctggggactccgcatccttccagcaatccagataggaagcgcagccagccggggagtcccgggattaggcttgtagctcaacctttcgccccatctcagtttgcacagttgcatccgccacacatttcctgccggcgcggtgagtatggaaaggcaggactgccgacagccctggctgccctgacccagagcctccaaaaggcctgattgtgtgtgtgttttttaaaactttagttttggaagtgtgcattaaaggtgatttatcctctttttaaaacccttgggtttccccaccccyctctaccgcatcttcacttgrgtaaagaggattccagcaatgacaggcgtcttgcaaggtgattccaatcactgaacgaacccgttttcctctcctcatttggtgctgttcccaactagatatcaggatcagatgcttgcttttacgaaatgccctggttgccatggtaccctgatacaggaagaccacagtgaaatttcagggtgttacctgtttctaaaagagggcccaaattttagatttcaggggtcatatttatacaaagtcaaaagtaattttaaaagaagacacaaagtgtaaaatattcagaatcagaatacttttccttcatttttaaaaaggaggctggccgggagcaaaatggctccatgcctgtaatcccagcacttagggaggctgaggtgggaggatcactggagcccaagtgttcaagaccagcctggacaacatagactcagtctctacaaaaaatttttaaaacttagctgggcrtggtggtccacacctgtggtcccagctgtctgggaggctgaggtgggaggatcacttgagcccagtaggtcgaggctgcagtaagcgataatcagtccactgcattccagcttgatcaacaaagggagaccctgtctcaaaaaatttttttaaataaaggctgatatttctggcctctaacaaaagcagaaagtatcagtttcacattcggggcaagttccaagctaattgctcagaacatggtcagcccacccacctgtacaattgcccttcagaaggaggacagagtattgtgtgtggtttgcacagcagatcccttaaaatggagtcacttttacaaagcagaaagcccattctggagacctgatcaattagaccaaaggaatgtggtaaagtggattccgttcatttgcttccaggtttatacagagatgtctagactgcttcctcctgattagaagggaggctgtaattaaacttttttaaacttttttttttttttgagttctggtgattgttctccagtactagtttccttgactacaagttattgaaggcagttgatgttacttttctaatattagcatttaaattttacctacaatattatgctaacacttacttgagaggccaggacatcctgtaaatgaatcaccagattctgaaatcagctttgaccaaaatgagaatcasactgtttgtattaaaagcaactggaaagactatcctctcagtgatgatttctatagttcgttactagagaagtttctctaaacatgtagagagcatcagaaaccacaaaaaagaggtgcagcggtctctcctgagtgtgaagctggctcttggtattgcttcttggttcttctcttcctttgggagagtaagaggaagaggatgcagtcttagtagtttcccttaaaaaaaaaaaaaaaaaaaagcaactggagccaggctctctggtatatatgattagccatgcatttgtgaagtgcttttcacagatagcagggcctaaagaaagggactggacatatgcttttctcaaacatctagtgggcatcaagattgagacaggaagcttgttttatccaggctcctaatgcatccctggctttgggtctctgttttttagacagtacatcttgccagtctccaaatccttttgagaagaaggtaataactaaataaatacgatgtgaaatacaacgtaaaagtacggtcagttaattgtgtccttataagaatattacccttaaatgctgtttgtaacatacatgtgggtctctatgtatttcagtcttagcctcattttcagacttaagaatagtctgcatttcagaaaatgtaggtacagagcaaagctccttgtggaaagagaactattaagctctgttgtttatgatttgccttgatggaatgcacaggaagtagataactctcctaacccaactgcccaggtggctctggctcccattttaggagaaagaaagtaagagaaattcaaagctaacctaaaacttacagtctatcttcatcctagttcatgcccatgttggggttctttgaactggccccagattatagtgggcccaacatggcgtggtcctcccaacagcctggtcctcccttccccagatattctgagcaatttgcaggttagcctgcatgccaccaccattgattcactgctcgggcagggtggaaacgaagaaatcttgttctgtggttcccaaagcttctctaaatacttctgcctaatacttggtttctgcttcatttaggttttagaaaatcaggccaagtgaactgtatttttttctttcatttttagtttgctttatgtcagcaaaaattctctaatatctcctctgcattttactgtagagtaagcttctctagctgtttattgagattaaggtttaagcctagaaatttgattttggttaaattaatagcttgtggaaacaatgccctcttttactttagatcttgaatttgcaaggaaggaggaaattattttcaagactattttagactcagcaagttaaaagtgaaagatgtgatacaaatcwcctragcaattttcacacaattatttttcttgaagctaataggttgatttttgtattaggagcttcatggggtttttttaattaaaaatgtttttaatgagattgctttctagactgatgaactcaactttgtttgtaggaggacaaaaaatgcttcatatgcaattcccaagatccttatcatgagaccctgaatcctgacagccatctcattgaaaatgtggtcactacatttgctccaaaccgccttaagatttggtggcaatctgaaaatggtatgtggttggtgtggggacaagttccgttgagtgtgattgataacttgggtggagcttacaggttcctgggtgtttgtaattatgattcacttctctgtcctgtaattatggcctctgacagattgactgcctggagcactaacttctcttggtaaaatcttatccttcttcctgaagcatgtatttcctataagaaagcagtctgtcatgctagaccaaaggagcatttcatagtccttattctgaggggcttttggagagaatacttgtgtgccgggggctgtctggggagggtatgggtactatctcaggcccttattcttccacaaaatgtaacatctttcattttgatcaatcccaaaggaaggggcagaatcatagcccccactcctccccccactgccttccttcatctacagaaartgtcttgatagtaatagtaacactatgaataagcagcaagatgtaattttttcaaagactctgtcaacatggatatgaccccaagtcaaatggttcctccagtgattgcatgaattacaccctttttcctgtctttgctatttgggatttggtgtaatacattcatcaaatatgattttactattgctgtgacatgaagcccagatgagtttcacatttgtttcaaactcgaatgctgaaatttggggaataaaggtagagttattgtgttcgttaattaacaatgtactgttagatctttaaaataaataaataaataagtatcctcaaagaagtgaacctaaccctggccgttaaaaagcctggagactactagatttctttattctatgcagtacacctgggcaggctttggatgccgctgcagccatctatcattctgtaaagacaaacgcccttaatagatttctttgtcattgactgtttgtttgtttgtttgtttatttttgaggcagagtctccctctttcacctaggctggaatgcaatggcgcaatctcagcttactgcaacctccacstcctgggttcaagtgattctcctgcctcagcctcctgagtagctgggattacaggcacatgtcaccacgcccagctaattttttgtatttttagtagaggtggggtttcacggtgttagccagggtggtctcaatctcctgacctcgtgatccacccgccttggcctcccaaagtgctgggattacaggtgtgaaccaccacgcccagccatcgactgttaaattgcaatattttctagactattggtttctaaggagagttggtttgttcattggttggccttggcaattcattggttacaaacttcattgggtcatcagaaagcatttatcatttagagccatgttcattcttacgggggcatattttggttgatacttcagtgtgaaagagaagtttctgtaaatctgcagtgtaccccgaggacttctgaaacagcagcaagcttattatgaacaaagactaggaacatttcctgatctcccacattcttctagtgaaagaccgtttgaagaagatgcctcaacattaggatggagactgtccccattttagtcagcagacagtgaaacagtttatcatgtgctgtagttctagaggaaggtttttcttagttatgtcgagttaatcaacttctacaactttgaatctctgggacaaaagagaccagatgccagaaagaagagattttccagtagaggggcttgagttctctgtcactctgtcacaagagattagatgagattagactgatggaacttagtctttagaaagtcagactgattgttactataccctatcatctctctgttgtctgatcacagtttaagagtttatgaatgtgattttatctattttctgtgtgttgtgcacaagttgtgcttatacgtggcggggctaaattatcagtgtccaggcacagaaacgagcttggaatgtacgactatttttacccatcgtgatgatctcttcctaggtctgacagaaatcaaatacactatagaagaatgaccttgtttcttttctctgtggatttttcttcccatataaaaaaaagcctgtagtgctttatcaggttataaatctaaatggaatgtgcttttggtgcacacattgcagcatatgttcttaggttacagaaatggcactagtcttgctttgcactttacattattttgttatctcttaattttgaacaaatattgtaggtttttaaaagcctggaagaggagagatgtacagttgcctaacatttcactcaaaaataaatgcccagtgtagttctgtaatatggttctttttgataagttaggtaagattagttagtgtgaatataatgtttttcttttaacattccagctaactcatatccgttccaatgaccactttcctcaccccccgccccctcaattgacttggcaattttccagcaagagtttatttcaaaaggtcctcctgatttcctgaaaatacaccagtctgtgacatgattcattctgacacattcctgtctttccscatttaagacttcttttgctctcaagatggaccccaaaagctctctcaaacacaagaagcgtggcaagcctcccttgctgaacaggcaggcttgagagctctagggactggggaggaggtgctttccatctctggaattccagtggcctttttaacgtgtttaagtgagactgactgaccctcagggcaagggtgcaaaggctcatttgtttgttcaggctttcccctgaaagagaagatgttagtatttgttctgagccagtttatttgacagattcttttttyctctggcgttgtttttcattgtggaaatgcatccaaargtttccccatcagggataggtttttctaagttgtggtataactaacatatgtggtagactcttatttattttctttgctgctgcatagagaaaaaggaatatttgtgtttctactggaggaggattgtgtccttgtgcatcagactgcaagctgaccccctactgtgcacaggaagtgcccctcccttttttcctttgagagcagcttggcttagagggttgggaagatgtttcacttctggctaggcaaaggatgtctttcttgacagcagctagaggcactctgccagatgtcttgttccagtgagcagattcaatctgttgaactccagaatgatttgtggaaaactaaagaatcattcaacttgtgctttaccacctaaataagcccatgggattattatttagtttcagcttcagcttaaggtagaatgcgaggataatttctatggggaacataaaagtaatttaaaaaatagtctsaactattcacagatgtttctatttacagtttcatttattgttttattttttttaaatctcctgtaggtgtggaaaatgtaactatccaactggatttggaagcagaattccattttactcatctcataatgactttcaaggtaagaaatccatgactttctcacaaatgacacatgagagcactgtgtaatgtcccctttcaaaatggatgtcagatgtgagttgacctaaatgggaacttaaatattattgttgccataaattggggtaattgagcagtttttaaaacgagcatgaataactgcatttaacaaatactctatcttcatgacaataagtagaaagagcctctattctaaggtaattsaactgtaaacttttaattaggtatctttttatttccccatagagtaaggcagtgttgacccttttccaaaccgcaataaaacatctggagagtaaatccctggtcccttgtgtttmtgttttaatactgactttggtaactggaaaggaagtgtgttctctttggttttcagagttttgcacaatttgtgagcagattcaatctgttgaactccagaatgatttgtggaaaactaaagaatcattcgacttgtgctttaccacctaaataagcccatgggattattatttagtttcagctaaataatagcttaaggaacagttttacagttccttaagaaatgtgtaatgccttcttaaatgtggattttctcatcatttttctttgagagatgtaaaatgactccagaactagggaatgtctctgtacaaagtccctttgtttcttcttaagcagctgcctggaaatgacaggcttcacatggcttaaagtacacattggctcacagaaaacccataatttagttattgcttctcagattaaaaatcacttttgaatagctttcagttggagttgggaaccttatctacaccctctcaggataggaaaaggtgccaaggatagatttaccatgtgggcgggtagccatgaaagtctcactgtctctgccaccaaagtgggaggccaaggagctagggtgggtgtgggagtcagaatgcaactaggagggatgctgggctgtgcctctgagcctttatccccttgcccactccccagcagcctgctgttcctgctggagcaggaaggtgggcactgtgactgtgacacctggtattgagagtggtggggaaggtttcactaaataaattgtcaactactccttgtcaccaaccgcttgtcccttcattgaccacacaatctggtgattaaactgatgctcatcggcctacaaggatgttacctttatgttatgtgacacctgagaatactcaaaatcatctttattaatgtttatgatcctattttttcctttgcagagggcatctgttcatatacatggatagttctgagttcatctagatccaaaatcctttaggcacatgttttgtagttgaatactcattcaggtgaatacagtgggagaaagaygaacttacttgtgtaggcgcagaaggtaaaacgggggtgatgattgaactgagacatgcagaatggctacaagttggggccaggcgtggtggctcacacctgtaatcccagcactttgggaggccaaggcgggcagatcacttgaggtcaggagttcaagaccagcctggccaatacggtgaaaccccggctctactgaaaatacaaaaattagccaggcgtggtggcacgcgcctgtagtcccagctacttgggaggccgaggcaggagaatcgtttgaaccctgcaggcgaaggttgcagtgagccgagatcatgccactgcactccagcctgggtgacagggtgagaccctgtctcgagaaaaagaataggtacaagttatcacactggtttatgagaaaacaactcatccttcgggtcctagctccagtgagaagagcaacatctatggggttgggtacattgggtgtgaatccctgcctgctccttcttggcatgtgtggccagagctgtgacttcctcattggtaaatgggaagaggaataatacctacatcataggacataggacagaatggtgatgttctcctgttcccctctgttttttgttttttaaatactgagtcttgctctattgcccaggctggagtgcagtggtgcaatcttggctcactacaccctccgcctcctgggtttaagcaattctcctgcctcagcctcctgagtagctggaactataggcacatgccaccacacctggctaatttttgtatttttggtagargcaggtttcaccatgttggccaggctggtctcgaactcctaaccgcaagtgatcctcccaccttggcctcccaargtgctgggattacaggcgtgcctaccgcgcctggcctgttcccttctgttctgggaactgggataatcttgttgccctggcggatagtgggaacctgaaagtctttataaatgcagatgcttggcatatagtaattgctctacaaatgtttactgaatgaaagaataagtggataaatgaattcaaccatcttctgtttgtaagaaactaccctactttaagccttatgggaaattgtaaagatagcacagtgactgccctccaggagcttccagtcttccagaggagaaagatatacttgcaaataacttacagtatgtgacagaatgtgctaatgactacaacagaagttcagacaatctttgttagcctggaggagggtgagattaattttagcctggaataaagaagaaacctaggactgggactgcacttgacctgggccaggaagggagagcagggatgtcagtgggaggagatggaagaaaggccattcatggccggagggaaacagtctgagagcaaggcactggtggtgggacagtgggtcaggatttgctcagcaagtgctatgtagatttgcctcgagtttggggtagtgagagaaggaaaggaaaggaaagtagaaaagcagattagatgcaaaggacattgactccttgctagggagtgtgaactttataagaaatagggagccattacaactgatgaatcttagaaattctttttttttttttttttttttgagacgaagtctcgctctctcccaggctggagtgcagtggcgcgatctcagctcactgcaagctccacctcccgggttcaagcgattcttctgccttagcctcccgagtagctaggattacgggcatgtgccaccatgcccagctaattttgtatttttagtagagacagggtttcaccatattggccaggctggtcttgaactcctgacctcatgatctgcccgcctcggcgtcacaaagtgctgggattacagacgtgagctaccgcgcccagcctaatcttagaaattcttttagtaattttttttttttttttgaggatggagtttcactcttgttgcccaggatggagtgcagtggcacgatcttggctcactgcagcctctgcctcctgggttcaagcagttctcctgcctcagccccccaagtagctgggattacacgcatgtaccaccacacccggctacttttgtatttttagtagagacggggcttcaccatgttagtcaggctggtctcaaactcctgacctcaagtgatccacctgcctctgcctcccaaagtgcagrgatacaaaagaggcatgagccactgtgctcagcctcttttttgtatttttaataagaaatgaatgatcatttcttgccaaaatttgccactatgaggtgattgcaataattctgttgcaaaaacattaacatttagtatgagtcttttttactgtattcttgcagttaataactgctgctatcatgttattttgtgctttatttttgtttatgccagtcttaaagatccagatttctgaatcttttaaaaaaaattaataccaaaaaaaaattgggaaccattgacaagaaaatgagacctgtgtttcaggaaggtagcccaagaggaaatacaaagcaaggactgggatggcgagaataaagggcatgttgggaggctctgttgatgtcagcattgatgaagcattaatggagggttactgctaatgcaaaaactggctgtgattcttaagtaggagggagccttttcctgcaacccaggagtcctgtaagaatatcttagaaagctttttcaaatcccatgtgtccactcactgccatactctgatactctctgctgttaactgcctttgaggatcattgccaagatgaggtgcccctgttttctaagggcagtcatttggatactttaaaatcaaaagctgaaccatgaaatggagaaagattagaagcagaacagtggaaggaaagggctgaatcaaaaattacttagggctgctctgcttatggagtagccattcttttcttcctttactttcttaataaacttgctttcacttaaaaaaaaattagttagtcaagtgaaataactaggaagatggtgaagccactgacagtagtgaaatcaggaagagaactgaggttgttgatttttttcccccaagttcgccatagagatggctaattgctaagtggatttagactagcaaaagctcatttagcatgtacacagtatgtttttctatattactagatgtttcaaaactcataactcttggccaggcatagtggctcatgcctgtaatcccaacacttgggggtgctgaggtggggggatcgcttgagcttcaggagttcaagaccagcctggacagcatagcaagaccctgtctctacaaaaaattaaaaaattagccaggcatggtggcacacgcctgtagtcccagctactcaggaggctgaggttggaggattgcttgagcccgggaggtcaaggctgcagtgaactatgattgtactagtgcactccagcctgggcaacagagcaagactctatctcaaaaaacaaaacaaacaaamaaaaaaaagccacaaaaaactcataggtcttttgtttattataaatttggaggcaactgtgcagcaatggcaggcctgggaaggttgatgactaagcagagagtatggaaaggattctattcgttaggtaaaatgtgttgttctggtttccagcagcttcttaactccacgggaaattggatgactcgtcaatggtcctttgggacttaaaagtttccaaaagagagggagaaggaagcacagccagaaatggctttcacagagccattggcacagagaagtccgattagaccttcccctctcttcctctccccaagcctcccagccaggctctcacggggagtttgccatggtacgtggcacacatggttcagttagtccttagggatttttctctcttactttaaaattcttaggctgatattctcttgagttgaatacggtatcattttcttatattcctgggtaggtgaaaaataaacctaagcagctagtgagtgaataagtcaaagaatctgtcaaaatgtaattgtccatgttcttatccttgacatcttttatcagagaaaaagctcagcaggattattaaggagggctaaaggaagcctaagcatgtttctagttttcaccattaaccctcacccaaatttctgtcaagcgttggttttaattcggaagtaagtgtctttatttaggttctgttttctaggtcagctgaaatttcctttgatctttttcccttgtaatctgacttccaattccccaaaatgcatcactgtgttggttagtgtcaaaacctttgcctgtttgcctatttttcagcrctctttctgcttcatcttttacttccagttgaccctgttcactacaccctcctaaatctccctcctgccttggtttcagaagactgcctttttttctcttttccctctgacactcatttttcagtcttctgtgccttcagccagtgagggagaaagataggaatggatttgaatctaagctctgcctgtaactagcaagtcagtgtctccgagcctcaattttctcatttgtcagacaaatgtgttgtgagggtgccttggtttcctagggatgccataacaaagtgtcacggactgggtggcttaaacaacagaaatgtgtcttctcacagttccataggctaggaatctcagggtawggtgttggcagggttggtttctgctgaggcctctctccttggttcgggatggctgtcttctccctgtgtcttcacatggtcttccctctgtgcatgtgtgtgtcctcatctgttcttataaggacaccagacatatgattacagcccaccctcatgacctcatttaaccttaatcacctctttaaagagcccatctccacatctagtgacctgaagtatggagttaggtcttcagcatatgaaacttgcagacacacaaatcagcccaaattatagagagttaaagtaaagaatgtaatgaggggtactggcaccactctgttttccttgtctagcccctggttgatacgtttttctagagcacagacttaggctctctttatcttacccattccttttttctttttttttgtttgagacatcatatacttggaggtttcaaatatgtgtgtgcagtgactcccaaattcatgtttcaagctccattcttgcagctgagtgccagaccactttttccaagtgtctgatgggtgtctccaagtggacatcacacatgtgactaattagcctacaaccaaatgctttcacgcctcttccacgttgtcgtcattggcaacacakctacctggctacccaagttcaggtgcctgtatttctttcctcaccctgccttttccactacaatctaattgatcaccaagtgtaattcaatagagtcttctgtcactaaattttcagagtggtcagttccatccctttctatctacattgtaatttctcaggttaaaaccgtcatcttttttctttcacttggttttcctgtgttttgtatcatccatgtccagtaactaccacaagagttatttttctaaagtgcaatctgatcatttcatttgtccacttaaattttttagtgttctcttttccttgcaaaaacgtaagtcccttagcatggcaacttcttacctgccccgaccaacctcttctgccacgtgcagccgcctccacccactgcctggaaaacaccttgttgcccttttaagatccagtttggcccaggcgcgggggctcacacttgtaatcccctcrctttgggaggccaaggcaggtggatcacctgaggtcaggagttctaaaccagcctggccaacatggtgaaaccccatctctactaaaaaatagaaaaattagccaggcgtggtggtgcgtgtttgtaatcccagctactcgggaggctgagacagaagaattgtttgaacccaggaggcggaggatgcattgaactgagatcgtgccactgcactccagcctgggccacagcgagactctgcctcaaaaaaagatccaatttgatgccttcttctctgtgaagtattcctagctttttttttcttggcagtaaaatatccataacagaaagtttaccattttaaccatttttaagtgtataawtcaatggtgttaggtatagtcacaatgttgagcaaccactaagactgtctatttccagaactttttcatcaccccaaacagaaattctgtggccactgtccctctgcccagcccctggtaactgctaatcaactttgtgtctctgtctacttaaccaattctaggtatttcatacaagtggaatcacacaatatttgtccttttgtgtggcttatttctcttagcataatgctttcaaggttcatccatgttgtagcatgtattggcatttcattcctctttatggctgagtaatatttcacagcatgtatatatcatattttgtttatcttcatcagttgatgggtacatgggttgttcccgccttctggctattgtgaataatactgctgtggtgaacattcatgtacaagtgtctgtttgagttcctgttttcaattcttccgggtgtatacctaataatgtggaattgctcgattttccagcttcttgagttattaatttcttcctcttgcttttccaaagcacattgcrtgcaaccctactatggtgtttgacatagcatattgcaaattattgacacccatatctgcacctcattggactgtgtataacatatacaacatatagtccactggctgatactaaggaggtagtcatacctttattgaatgattaaatgaacgaatgaaggaacgagcactcaaacttgccactcatattacagtggacatggtgactaaatatacgaaagtgtgtttgctatttaggcctgtttataatcagcttctaaagagaaacagtttacttatccagtagggtggggaaaagtatacattttagaggttagacaytttccttgcaagaagagtctctgtggaacagcttgaattatttgaaatccagccacagtctgaaatacaaaccatatgcagttcaagtttgtggcatgcagttgagtgacatttttacctgagattaaaaaaagtagagactaccaataaaaaacatcaaatgagatttttgctcctgcctttagacattccgtccagctgctatgctgatagaacgatcgtcygactttgggaaaacctggggtgtgtatagatacttcgcctatgactgtgaggcctcgtttccaggcatttcaactggccccatgaaaaaagtcgatgacataatttgtgattctcgatattctgacattgaaccctcaactgaaggagaggtttgtttgcttctgtgttttacattctacttgcaaatctactttttgattattgcagaagtaccaattactcttgtttccatttttaggtgatatttcgtgctttagatcctgctttcaaaatagaagatccttatagcccaaggatacagagtaagttcattttcaaacaaaagtgttttttgttagtttgtttgtttgttttgttttgttttttgagacagagttccgctcttgttgcccaggctggagtgcaatggtgcgatctctgctcattgcaacctccgcctcccgggttcaagtgattctcctgcctcagcctcctaagtagctggaattacaggcatgtgccaccacgcccagctaattttgtatttttagtagagacggggtttctccatgttggtcaggctagtcttgaactcccaacctcaggtgatctgctcacctcagcctcccaaagtgctgggattacaggcatgagccaccacgcctgacccaaataaaattttttgtttgtttgttttgttttgttttgtttttttgagatggagtttcactcttattgcccaggctggagtgcagtggcgcgatctaggctcactgcaacctctgcctcccaggttcaagtgattctcctgcctcagcctcccgagtagctgggattacaggtgcccgccaccatgcccagctagtttatttttgtatttttagtagagacgggttttcaccatgttggccaggctgggtctcgaactcctgacctcaggtgatccacccgcctcagcctcccaaagtgctgggattacaggygtgaaccagcgcgcctggcccaaataaaagttttgatggtaaacagcagccatggaataagtcttactcagaatctaaatattcagtgctaaatctacctttttcattttccttctttctctgtgttacctgaccagagggtcttgaaattagcaataattactctccactgatagggaatacatttacatctgatataagatgtaaatacaatacatccgatataagattgataggttatcaagtaattgtgttgatcataataccttattttattgctcagtatattagggtatatattgggcttttgtatcaaagagtctccccaaatctagttgttcaaataaggtgaaagtttctttctctcttacaaaacccaccaaagagttttctagagaagaagtgtagctcaattgccataattaagcttaccagataaaatacaggatgatgcccagttacatttgcaaataaataattcttttttttagcataactatatcccatatatcccatataatatttgtgactagtacaagtgtgtctcatgcaatatttgtggttggtataaccatgtcctatgtgatatttgagacatactttatcctaaaaaatagttgtttatctgcaattcaaatttaactgagtgtcatttatatttacttgttaaatctggcaaccctagttataaggccatccatgtttccaggtttattcacatggttagagttagaccaccaccactatgtcctcacctcaactcgggagaagagggaagacgaggcaagcaaattccatttaaagatgakacatgggccaggcgtggaggctcactccgtaatccccagcactttgggaggccaaggcaggyggatcacttgaggtcaggaattcgagactagcctggccaacatggtaaaaccktgtctctactaaaaatataaaaattagctgacatggtggcatatgcctgtaatcccagctactcaggaggctgaggcaggagaatcgcttgaacccaggaggtggaggttgcagggagccaagatcgtgccactgcactccagcctgggtgacagagcaagactctgtctcaaaaaaacaaaaaaatgagatgtggaagttgcacacgtcacttctgctcacatctcattggccagaattagtcacgtggctatactgcaggagacactgggaaacatctctaggtgtttcatgtgctctactaacactcttggcgagggctcttactgtcaaaggaacaagggaagaaagaatactgaagagaaatcagaagtctctgccattctcaatatactcaataaaatgagggttgcatttccgtttaatagaaaaataagctgaagcttatagagttggatgttattacgtaaagtgatatggctattaaatggcagtcagatcttgaatccatatgttacggtgctcagttcagagctctttaccacattcaacaactgctcttattacacaattacattttaatcttcttgggaggcatgtatggtaattaaaagaatgggctcactgggcgcggtggctcacacctgtaatcccagcactttgagaggcctaggcgggtggatcacgaggtcaggagtttgagaccatcctgaccaacatggtgaaaccccgtctctactaaaaatagaaaagttagccaggtatggtggtgcgtgcctgtcgcttgaaccygggaggcagaggttgcagtgagctgagatcacaccattgcactccagtctgggtgacagagcaagactctgtctcaaaaaaaaaaaaaaaaaaaaaaagggctttggagtcacaaagtcctggatttaaatgtgttcataaatcataaatgtgttcagtacatcaaagctgttgctacatttgttgctgttgatgttgctgtgactatcagctttggtttgggttttgcacaggactagttccaaatgttggaatgaaaggtgagcctgcctctcctgctactaaggtgcaaccagttgagtagaggcggggctgattcttgctgatctttcccagctgcacaaggccctatttttaaccaaggccccaaaaaacttccaagcttgaagcaaggaagagtggagtggaagaagtccagggaatattgccagaaaaatgctgcttccccatttaaattaattttacatgtggcccagcctgtctctggtctgtaatttactcattcattctcttgtaaaacaaatatttaatagatgtgtccagctctgrgccaatttctgagtgagccatgaggcctttcctgcatgtctcaaartgcagttatgaaaaacgtccacaagggctctgggacagacaccccctaagtccctaaaaggactcaaccatctgctccctttaaggtgaaatttgtgggacttggaggatgtgttgtctttataattttgattcttttgtcttttgtggttaaatgrcatcggagaatctttttctatgttacggaagcatgcatgttagctgatcatgcatttgatttactttgtaatcaagggagcaatatctctttagttgtctattgttgagacctgagactcacttcaaaagtgatttgccacttagaatagcagtcaagatgaggctcgctttttaaatatggcaggagagagtggggggagcatatttgctctactgaggggtttccrcaaaggtcagttcaagggtttctaaatactccagctgctcttcaagtttgttgtttggcctcttktcaataggcgcttgtrctcattttgtgcaggaggatttgtgcaggagaaaatgttggcgttcataactgccattcagttggggagtaccacggtttctctgtttagtttttgattttacaaagaacctaagtttaacacatggacttttcctttctacccgcagccatttctatagcttcattgtaagctatgcatgtattaaaagcatttgaaattgtatttgggctgtgaaaatatctgatgtactgggccactaccctgttgtcttatgttgtaatttataagaatgcacagacataaatgacagtaaagaaccgtttcaggctacagagcttgagagtgcagacagatgaatcaatctctggggatccagttcagcatgaagaacttagtaactcacgaaaaccccgtggagaaggttgaatggctcttcgtttgtctagttactatagaatgaattggtagcccagcatttacaataagcagaagtctgcagacctaggaagaagagggaaagataaaattgatttagaggtaacttgtatttgagaaaaaataatttgccccacatcctaatactaagcttatttatgcttatgtcactatataatattgagaaaygtggaaacgttttgtaaaactgggacaaaaaagttgtggaccaaaatgttgcttaaaaacttgaaatgttctctccttaggttgtagttattctatagcgttaacactattttggtaacttggatgtcatttaagyggtgggaaatttcaaattttcccttccaaaaatagagacaaaaatgtttctaactatcttataataacaatgagaactggagtgctttgataaatcttttcctacctgaatggaattttctcatgttgaaactgacaytaattgctgtgggaagcagatggcattgtgctacttcaaattactgtctgcccgcaggttccagcagtcatgcagctgcgttcttataatttctccactttcacacttcttcctaaatagctgttctgcaaacagacccatcacagaatagctactcttttttgttgtcgttcaggcaactctcctgcctcaacctccagagtaactgggattacagatgcctgccaccacacctggctaattttttttttttttttttaaacagttttgctcttgtcgttcaggctggagtgcaatggcacaatctcggctcactgcaacctccacctcccaggttcaagcgattctcctgcctcagtctccctagtagctgggattacaggcggatgccatgatgcccagctactttttgtatttttagtagagatggggtttcaccatgttggtcaaggctggttttgaactcctgacctcaggtgatccgcccacctcggcctcccaaaatgctgggaatacaggtgtgagccaccgcgcccggtctaatttttgtatttttttagagatggggttttgccatgttggccaggcaggtctcgaactcctgacctcaagtgatccacctgccttggcctcccaaagtgctggaattacaggtgtgagctaccacgcccggccgacattcttatgaaactgatgagagggcagtaacctttcctctttgcagtcatgttatgttaggcttcactattggagtcatctagatcatacaagaggaggaacttaagctattttcatgtgtcatgcctttctctaaaaagaaatgatgcaaggaaaaaaaaaaaaacttcttgcttgtctgatcagacttttcatcttcttgatgaccttcctagatttattaaaaattaccaacttgagaatcaagtttgtgaaactgcatactttgggagataaccttctggattccaggatggaaatcagagaaaagtattattatgcagtttatgatatggtggttcgaggaaattgcttctgctatggtcatgccagcgaatgtgcccctgtggatggattcaatgaagaagtggaaggaatggtaagtaagccctctgtgcacctttctcctttatgtggctggtaataaaatgcaaagtgaagctagtcttaccttaagccttttacattttctgggggttttagttttacagagttacatttagccctttgcaccatacaggtagctgattgttgattttctctttgaagagtttcttggacacggagaatgtacagactactcatttcatagacgatgaatttttggaatttgttgcttcaggctattgctaaagtagatattttagtcaacaaggattaaaaagttgtctaaataacaattgagtctgcctttacatagggaagattaaaaaccgcagttatgctagaaggcataaattgatctcaacccaaagaaatggatttttttttttttttcttgagacagagtcttgctgtgttgcccagactggagtgcagtggtgcaatttcagctcactgcaccatccgcatcctgggttcaagcaattcttgtgcctcagcctcccaaatacctgggattataggcccacaccaccatgtctggctaatttttgtgtttttagtagaggtggggtttcatcatgttggctaggctgatctcaaactcctgacctcaagtgatccacacacctcagcctcccaagtagctgggattacaggcatgtgccaccgtatctggctaattttgtatttttagtagagacagggcttctccatattggtcaggctgatctcaaactcctgacctcaagtgatccgcacacctctgcctcccaaagtgctggaattacaggcrtgagccaatgcgccctgcccacggctggaaaattttaacccacacccatgggatatcattttagggatcaaatggagttggtttctttctatcttttcctcctaattccattcttttccccacttttatgccacatttgcaacttatgtacattttgaaatttgggatttgggtgatttgccaaatggatagatgagtttattctattagtatctaggagaattcttacagacctagaggattttaaggccagataggacttatgagatcacctagaccaactattggtgatagagcccaaggattaagtaatttactagagagccytaagtaaatgagcagcaggtggaagctcaagcctctcctcactcagccccagggttccttcccctaagctgtggcctcccctcatgaaggctgtgcttatgtgctgttgccttttcaaagattgttagtccttagaaggtacaggattgagtgtattcagccctttaaaaacttctgccttccctttactccagttagaacttttgttgcacaacagaagttgaatttttgacggagcctgaaggggagggaggtatttctctaatcttattggtccatctttcagaatgctaggtagattatgttccctttacggcataacaaatcagctgtgtagctaatgtcctgttactatcacgggtctcacagcatgtgctgttgattcaggcccagtagggtcttatggtatgtgctttggaactggttttcagtttatgtaaaaccacctggtaataacaggactttagtcttctgctaactgcattcccaccaaggtgggtccaggagggacctgtctgtcctgttcctgaattccattctgtagaaactcttgttaaggtgagatgcccatatacatgcatatttagtggaccaaaaggccgtaattcatttatcatttatatgcctcaagggtcgtaagtgtgccttacagtgacacaaggcaaaatcatatatcatgggcctttcatcaggcaaattaatatatttcttttacgagatcttatatttccttacataaaaggaaaacataaatgtaaatgtgataaatgattaatttttaaaattttactgtcattgaaagaaaaatttaagtgctatgcctgaagtaaaaaaaaactaaaataagctagctaacaaaaacctttttaaaaaaatggtgatttggctaagtggtaaatcgtgcagtaatataaattggtttccaggtggtatgtatgcatttagttctacattataacttttgtagatttctattacaataggttttcttaaaaaaatcttaagtaactagtttttttttttttttttaattttaagtaattttcttcatctgggttcttttcatagatactcagtaaaatatttcttgtgcatccactatgtaataggaacattctagagatgaggcatgtagccatcaacaagacagacaactcactgcaggcagggagaaaataaaaacaaccaaacaacccttttctgtggtgagctagagattagtatgaaaaagggttttaaactttcaattgattatggagaaacgtggctattcatacatctcttcctttgttctctcctgtttttataactttcaaggttcacrgacactgcatgtgcaggcataacaccaagggcttaaactgtgaactctgcatggatttctaccatgatttaccttggagacctgctgaaggccgaaacagcaacgcctgtaaaagtaagtctgtgttgaagggacattttaaatccattcaggctctagtatccatttcctaattagaggtactgyaacagtgtactgttttgcagagggtagaaaagttactgtcttttttccagcttcaccctgatactcctagacaaccaacaatctgcattcagttaattaatattcactgaacagcctctgtgtgtttgacactgagctgagtagtttggcagctacagtagaaaactaaggtgctgtccttgacattgtatctgttttgttttttggtttttttttgtcgcctaggctgtagtgcagtggcacaggcggctcactgcaacctctgcctcccaggttcaagcgattctcctggagtagctgagattacaggcacgcgccaccatgccctgctaattttttttgtaattttagtagaggagaggtttcatcrtgttagtcaggctggtcttgaactcctgacctcaagtgatctacccaccttggcctcccaaagtgctgggagtttacagatgtgagccaccgcgccagggctgtttttaaggcaagatgaccgtgagagaaaaatgaaagaactatatggcagggtagctgatgaaggtctaagagatatggagtagcatttttggccttgtttctgtgccagtccagctgcggcctctggcatacctccctccatccatctcaggggttttctccgggtggagatgtagccggcaacaccactgcccctccccactccacaaacagtgattctgatgcatgtcctccccttgaagagcagctccgcctctgcccccactgagaaggactattatagaagttcagcagccagtgagagtagggagtggtcaaggcttgctttgtaggtaaaaaccagatggcccttgatggatacttaacatggagaaggaagggagggagggaggaagggaaggggaggaaaggaaggaaggagagagaggaaaggaaggaaggagggagaggaaaggaaggaaggagggagaggaaaggaaggaaggagagagaggaaaggaaggaaggaggaagaggaaaggaaggaaggagggagaggaaaggaaggaaggagggagaggaaaggaaggaaggagagagaggaaaggaaggaaggagcaagaggaaaggaaggaaggaggaagaggaaaggaaggaaggagaggaaaggaaggaaggagagagaggaaagaaaaggaaaagagaggaaggaagatgggagggagttcaggtaagaacaacaatgtgaagcacaaggcckcaaggatgttcttgaaaccatcacagagtccatgctgggaaggattactccaaggytcacttcaaccagtgtattgagagcagtactctgttgggcaccaaggatgtgagtagataagacacagtccctcttctgcaggctgttgtgttgcagggggagacaggcaaggtgggaggctggagtgcagaggctcaggagggccaggctgagtcaagcttccctgtgcaaagacaagaatgggattgttaagcccgagagcgagatgattaaagctgggtggcaccaagatgaccgccgaatgggctcgcagaaggaagcgctgcacccaagggggtcagctagctggctgttaaacagacctaccttccttactatggcctggcctggtgtggtggtgggaatatgggaatacggagaagggaatccatccttcaggcctcacggtccttgaagcagggagcccgtggacaggctttcctagcagcacatcatctggaaggtccctcgctacagtgttcttccatccagtcccacctcgagtggaccagaaagcgccctcagtgggatggcagccatcctctgtcatacacttccaaagggactttcccttagagttttccatttttcatagcccattctcttccacagaggtcagataactgtttattttataaagttcacatttttgagatttctcatctactttagggtttaaacagtgtcatcggtggatgcgtcctttttccccaggagtcctgcttgttgactgccattttgtctgaacttagtccctggtttcctaaaggatcttcctgccacccccatcctccattggtccatagatttaaaaagcttttcttgacgttgctcttgtcacgcagaatgtaactgcaatgaacattccatctcttgtcactttgacatggctgtttacctggccacggggaaygtcagcggaggcgtgtgtgatgactgtcagcacaacaccatggggcgcaactgtgagcagtgcaagycrttttactaccagcacccagagagggacatccgagatcctaatttctgtgaacgtatgttgagaaatgtcactcactgtgtgggacctacttcagattgccttccaaaytgaatagtcrgtagtctcagagctcataktatgagcagtaaagccagcattgttattgtaattgcasttgaagacgctgggagtggaatttacttggtagttgtgctgcttttagtcgacttttgtgagatttagagggaggaagggaatatatgtatttatacaaagatacattgagtttcctcctgattttaacctggtgctttgcattcttctcaggatgtacgtgtgacccagctggctctcaaaatgagggaatttgtgacagctatactgatttttctactggtctcattgctggccagtgtcggtgtaaattaaatgtggaaggagaacattgtgatgtttgcaaagaaggcttctatgatttaagcagtgaagatccatttggttgtaaatgtaggtctgtttgctaaaaagtttgggagttttcttgtgtttgaaattcccattttactttgtaattccaaagccagattattatttgaaactcacgtggtctgtgtttctccacttyattttgttttaatacagcttgtgcttgcaatcctctgggaacaattcctggaggraatccttgtgattccgagacaggtcactgctactgcaagcgtctggtgacaggacagcattgtgaccagtgcctggtaagtaaatcctcattacgtgggatgggtggttggtgaggatgacatgttttaatagagaagccttttcgccattgtagagtctgcgatcaccctcacgtgtacgtgttaaaagacatgagtagacaatgcacacaataggaattactaatggatgatttcacaagatgttcaccatccctgttagaagtgtaaaggaaagccacaataaaataccacttttatagacacaattaacacaagtttttaaaaatgggaatgtttactattaggatatcatgaggtactgctacttcttggctgctggtgggcatccatattggtttgtacttttgtgaaaagcattttggagatacatatcagtagcttgtagaaatgggcataccctttgacccagtaaccccacytctgggaatctattctaatgaaataatcagaaaattggacaaagatttattctccagaagactcattgcatcttttattaatcatagcagaagrcttggaaacaacagtggaaaaatagttaagtgtggggacttctatacaatgtaatatttggttgccactgaaaatgacaataacatcaggaaatgctcatgctgcttgctatatttaaaaaaaaaaacacacacaggatatgaatagtatcttgattaagtaggaaataaaattcatcaaggaaaacaaaatctggaaggaaatacaccaaaaagttcactgtaataattccaagtaggataattatgagataagtttttwaaaatctgtatttttaataacattgttatactttctaatttagggaggattcactacccccaaattattaccattaaatatgtatatttatatataatcttaatayattcttaaaggagatttctggaagtctaaattgatgagcctggtcaggtgtgatgactcatacttgtaatctcagtgctttgggtggccaaggcaggaggaatgcttgagatcatgagtttgagaccagcaagaccccatctctaaaattttttaaaatcataaataaaataggctgggcacaatggctcacmcctgtaatcccaccactttgggaggctgaggcaggtggatcacttgtcaggagttcaagactagcctggccaacatgatgaaacgccatctctactaaaaataatagaaaaattagctgggtgtggtggcacatgcctgtaatcccagctactcgggaggctaaggcaggaaaattgcttgaaaccaggaggcggaggttgtagtgagctgggatcacaccactgcactccagcctgggcaacagagcaagacttcatctcaaaaaaataaataaaataaattggtgaacctgtttttatatactcatttttgaagtgcacagagctcctcttccctactgttccatttctctttatttccatctctggtgctctaaagatctgatttcctcgtggctcagtggtgagaatagtcgtagctgtatgctacatttccacataaattcttggagggctttctgtatgggattgatgacagactgaactgagggcagatttaaaggcctgccaaatccttgccataattctcttacagccagagtaattataatgaggaaaattggtatctttactgcttgctcttcttagttgttggatggaggttatctatagggcagagcagctagtctttgacctggcacgatcctgtgattgtgaacggctctcttacgccagtgcctacagctcaggtttcttgatttcagaatactccttccttttgttggctttctgctttaatgatgaaaatgagcatttggtggaacagccgaaacaagctttaacttgcttgttgctgagtctgttgcataattacagaaacctaccgttacatgtttcacgttttgttctgcagccagagcactggggcttaagcaatgatttggatggatgtcgaccatgtgactgtgaccttgggggagccttaaacaacaggtaaatggagctctacgtatgctcttgtcctcagtcttccaggaaagtcatgacttayaggaatgggtgacattcagttgtttctcaaaaagacatgcaaaatattttttgtatgtcttgataaatgtgtgtaggtacctctatggactagattcccagtgatggaactgctaagtcaaagtacatatgtatttttaattttaatagagaatgttaggttgttccagacatattgaactagtttattttcctatcagttacaaaagtaccttttcccccatccccagcaacagttggtatcatcaaccattttatttttcaacaatctaagcacatggaaaatggactcctgttttgatttgtgtagagaatcttttcattttctttttttcttttttttttttgtgacttccaagtccattaatgaaaatcacatgagataatgttgagctacttaaatatgctagtattccttgaataaatgaagcataaagctccaccagaagctatcagaacacacatttggcaagatgttaaatctgtgggagtttaaccaccttcgagtcaaagagaatgttggtctctgttcctggctcagagtcagaacatctggaacagatagtgtaagtgactgctgagagaatagacagatgtttccctgtggccttgagtcttcccagagagaacactctgaattcattgagcaagcttcatgtactcaaaaatggactttctttcccaattatttcccaacaccatagtagtctgctgggaaggaatgaggtattcagcagcaagaacatgttgygtttgtcctctttatttgggtttgttctgttcgaggtcgtgccatagacccagtacagcatgtagcctctgaaatccggtgtgaatatctgttcttagaaaacctccagagaggaggaagctaggataattccataaaagcagggaagaaagacagaatgctgtctgcttgtggaatcacttttctgacttttcctttgtgactcccagaacacatgttgaatcctttagtaaatgactcctcagttcaaagctgtcatcactcctaaagtccttcttgatgakataaaagtggcatatgcaattccccaaattatgtcataaactcaggaatgtcctatgattcttaaccctaagtaagttttgttcctacactcccttcctctttttctctattccatacacacttcctgtctgtctccacccacgcacaggccctagcctgccctctaatctcttgtgcaaaaatttataaaaaccagaatgtattcaccaagagagtttgggaagcaaaattgtctagtaaagatttttaaagcaggtaatcatctgatctttctagcatgattgatgggatgccctatctttgagaatcattggtggaggggaaaaaaagaacatttaaagatgccttgtagtctggtgactctagagtgttttatggtgagccttttcaaagttgttgtccctcaagaggaatttccccaggagccccttaggcagggtcaactgaagcactgattctactgggagatgtgcacagatgccgcttgggaaatgtttactggatgattggtttgttgcaatcactcatcaaaaccttttacctgatatttctttttacgtagtaaaagaaatacgttgtaggtactgaataaatgctgattgagtagaatttaaaaataaaagatttctaagatgttaaaaactagatatgtactccttagagaggcaatctctaaatgtgatcccagacactmcttagttactttgttgagggacagaattaaccataaaaatcactggaagtggtaaaagctttaagatgttttgtatagtgagctaaatggatttttggtagtacaacaaaagtttaataatccatgtctattatattgacaactaacctgaactttggaataattaaagaagtggccaggcgcgttggctcatgcctgtaatcctagcactttgggaggccrgcgcgccagatcacctgaggtcaggagttcaagaccaaccaggccaacatggtgaaaccctgtctctactaaaaatacaaaaattagccaggcgtggtggcacctacctgtaatctcagctacttgggaggctgaggcagggagaatcgcttgaacctagaaaacagaggttgcagtgaaccaagatcacgccattgcactccagcctaggcaacagagcaagactctgtctcaaagaaaaaaaaaaaataataagacctaattaatttaaataatctaactgaagccaagttaatgaagttttgcctagtagattacctgttttaatgaaaaagaattggcattggttgctaggtaaatgctacttgtaaatgtttaataacattgaaaaatataaacatttttacagcatccttcaagattattttaacaatgaaatgtagagttttcatatctggcttgaagcccacccccccctttttttttttttttttgagacagagtttcgctttgtcacctagactggagtgcagtggcattgatcttggctcactgcaacctccgcctcctgggttcaagcgattctcccacctcagcctcccgagtagttgggactacaggcaccagctaccacactcagctaatttttgtatttttagtagagacggggtttcaccatgttggtcaggctggtcttgaacttctgaccctcaagtgatctgtctgcctcaggctcccaatgtgctgggattataggcatgagccaccatgcctggccccacctcttttttgaactcaccgtggtgaagccccgaaccctcccttgatgcattgcttctgcatctcttttagcatttattttgctcttatagttgtgttaaaaaggtcyctttggacagagattatgtcatctttgtttttgcatctcacttggcacccagcacggtggacctggcaggtactcaataaatgagggactaaaatttattgtacttcgaatccagaacggaagttagtagatatttttatcattgtattgaatgactatggtgtagctaaccctttgttaattataatcatgtactgcataataacatttcagtcaaggatggaccacacatacaacggtggtcccataagatactgtatttttactgtagcttttctacattttgatatggttgaatacacaagttcttgtcattgtgttacaattgcctatggtattcaatacagtaatatgctgtacaggtttgtagcttaggaacaataggstatactctacagcctgggtgtgtagtaagctataccatctaggtttgtgtaagtacactatgatggtcacacaacaacaaaattggcgaacaacacatttctcagaacatatcccagtcattaagtgacacatgactatactgtgatagaacaggattataggacgtaggtcttaccaaaaagaaagtgtcctagttgggggtggggaggaatgccaccctgagaaaatgaatggtgctgacggaacactgtggttggttattatgaatgatgttttttatgctttaatatttttctgcctaattccttagtaatagggaaatgttaaaattccattttctttattcaccaccatttaaatgaaatggaatttttaaatgttgccaatttctatatttatgattttttttttttttttttgagacggagtctcgctctgtcgcccaggctggagtgcagtggcgcgatcttggctcactgcaagctccgcatcccaggttcatgccattctcccgcctcagcctcccaagtagctgggactacaggcacctgccaccatgcccggctaattttttgtatttttagtggagatggggtttcaccgtgttagccaggatggtctcaatctcctgacctcttgatccgctcgcctcggactcccaaagtgctgggattacaggcgtgagccaccacacccagccataaatgtatttttttaagaaataatcttggccttcacccactgagaaaacatagagcctgtatcagttttctattgctgccataacaaattaccacaatttggttgtttaaaacaatataagtttattattttccagttctatgtgtcaaatacagtctcagtggaccaaaatcacgatgttggtagggctgcattgttttctaaggctctaaaggagaatctgtttccagctaatttgggttgttggcaggattctgctccttgcagtcgtaggctgaggttccccttcttttgctggctgtcatctaagggctattcttgtcctctagagctgcccacattccttgactcatggtcccctctctccatcttcaaaggtaccactgggtcaaatccttcttatgtcacagctctctgacctacttacttccctgcctgcctctcccacttttaagaatttatgtgattagattggacccacccagatcatccaataatcgctccatcttgatgtccttacccttaatcacatctgcaaagttccttttgccatatgaggtaacatccyacagataacagggatgaggatgtggacatctttgggggccattattctgcctcacacaggccttatttattttatgtccttattctcccttactgatttaatgaaattgaatctctagtttacagagaaatttgtagagaatacataagaatctaagatgtgccatttctatcagatttgatttttacttgaacacaggagagagtaattacatgtaataaatcattggtatcactgtgaagaagccaggatttgtgcttgagttttgaaagctgagatttgaaaggtgcgattagtgagcaggggagggcctccgagctgggagggaaaagatgggtaaaggcacagagatgggaatgactgtagcaaggtcgagatctggtctgatcttgaccatctctgcccacattcccccatcaccctctttgctcctgttattcctgtcctctctctgcctgtcaagtcctctccaggctttaaggacacctctttcatgacgcctccctcagtcttctcartcagatgaatcatatcttcttctcccttagtgctttgcttgtaactctatcaatgcataggttcttactgcattttgatttgttgcattggttaatttctttattgtttatccccaattagactgtaagttcttgaagacagggactatttttttttctatttctctttctgtatatcatttagccagaaataatagacttagtgaggaagtaaggattcattcagaacaaagttcacaatggactaaaatgtgagaatacctgcactgrgaagcaaggctgctagggccaatatttgatcagtaaatatttgctgaagagtatgaggagtgtggctcattggaaagcaaagagtcggcaccagaaagagaagccgttttcagaggatgggttatggaggctgcagaaagccaggcagaggcatcatggcttgatatcataagaaacaattgtgggttttcrtgaaacaatgaaagcagcactgtaggaagatcggttggcccgtggtagacaggatggactaggcagaagaggaagaagaatttgagaggtcagtttaggagattgttagagtaacaggtatggggtgatgccatcctggactgacgcagtggcagtggcagtgacaatgagaggaagctgctaagttgagaaacattttgaagtaaaagctgagtattgggataaaggaaagagaaggtgatgtctcacctataccatgagaagaattttaaatctactggcagaaacagcagagctgaggataagaagtcagtgtgggtggtgatgatctgtttgggacaagatgaattagagatgacagctggccagtccatggaaatgtcccattgatggctggaaatagagaagcagagcccagccacctgctgggtgctgagagctgtagggtgagggccatctgcataggaaagccacaagaatgagttcactgaaggagccagtgttgaatcagagccatgcctatctgtgatgacaattcaagcctgtggacacagacttgtgattggcagggccgctgttaagggaattcctttcacatgatcagctctcatggagccattccttgtttagaattgtgctgcagatagaggcagcaccgggagcctgctggcgcctttgtcctcaccttcatttgctcgttctctaatggttgcatgtgaaggtctagttgttttcttctttggtggttcatgttttggatatttgttgtctcagtaaacatctggggaggaaagaattttcttttgtccatatgatgtaatgtctgatgcctgaatttctgaaaatagcttttgttcatggactgtgccaaaagaaggctaggtcctaattggaacaagctttcctttcttgggaattggctatgggacgttaagaattcctattcctggctgggcgtggtggcttacacctgtaatcccagcactttgggagaccgaagcagatggatcacgaggtcaggagattgagaccagcctggccaatatggtgaaaccctgtctctactaaaaatacaaaaattagccaggcatggtggcagtcgcctatagtcccagctactcaggaggctgaggtgggagaatcgcttgaacccaagaggcggaggttgcagtgaaccgagatcgttccactgtactccagcgtgggcgacagtgcgagactccatctcaaaaataaaaaaataataataataaaaagagttcctattcctgtaggataacaacatgatacacaaaaagaggacttcagctatgctgcggcagggtcgtttaggattttatttatttatttatttattttgagatgaagtctcactctgtcacccaggctggagtgcaatggcatgatctcggctcactgcaacttccacctcctggtttcaagtgattctcctgtctcagcctcccgagtagctgagattacaggtgtgtgcccctacacctggctaattttttgtattttcagtagagacggggtttcaccatgttggccaggctggtctcaaactcctgcaagtgatccacctgccttggcctcccaaagtgtgggattatagacgtgagccactgcgcacccggccttgggacatttttaataagcctgtgagtgcaaagtgttcctgtgagttgcaacttgccttaggtaccttgtttaaaactttgggatgagaaaaaaagaaagaacaaaccttgagaatgagttgaaagtaacaattccaaaccacagctcttctttaagtgaagtaaaaatggatacatgtaatttgagttttgtattgtatacaaaattatgatactaataaaagggacataagctgagaacagaagtttcactcttgttgcccaggctggagtgcaatggcgtgatctcagctcacctcaacctctgcctcccgggttcaagcgattctcstgcctcagcctcccaagtatctgggattacaggcctgcgccaccacgcccagctaattttgtatttttagtagagatggggtttctccatgttggtgaggctggtctcgaactcccaacctcaggtgatccgcctgtctcggcctcccaaagtgctgagattacaggcgtgagccaccgtgcccagccgcatttcttatatttagcatagcatagccaatggaaagggggaagagagacacaagatgcagaagtaaaaatcacagaatttggttcctgatggagtgtgaagaaagaatctggagaagaacggggactaaatttctgacttggttgactcagcaggtggtagtgccttcaccctgatagagaccatccgagggattgagggcttctgtcttagatccgttggtttgggatgctctgggacagccaagctggagatgttcttcagggagctggatatttgagcctaaatctcaggaaataagcaaaagatgtaacatgccaaagcaagaargtttgggatgtggaaaaccttcatgtgatgcggacggcgtgttagtcaagagagggcaagggaggtaaaaccgagaagaccaggttctcagccacgcttytggagttwgggattaatccataggcactayttttttccacatatgtattttctgaagaaaacaagaacatgctatgtatttggtcctgtgtactgagtaatggcagctgtagagctgcttctggcgggttgactcgcgtgaccatgaactcagctgatgtggctcctcctcccttccagttgctttgcrgagtcaggccagtgctcatgccggcctcacatgattggacgtcagtgcaacgaagtggaacctggttactactttgccaccctggatcactacctctatgaagcggaggaagccaacttggggcctgtgagtaggggagtgtgtggcaggtcggtaaagcagtgttttggggtgtagtggaacatacatgctttgtaaagaccccatttcagaagcatttttatagctttgtcagtgagcacaaaataaggatcaggaccatgccttcctgagaagagtcatatttaaagctaagtaattctatmactcacaaattggctttggagcattcactgataaggcttttggttggtttaagaaatgtgtctttacaagaaacttttcttctctctacttatgctccaaagttatcaacctagcatggtaaatactgaggcaaggatattttttcatctattcatccccaaatttagtgactttaaatgtatgcctggctcttgagctggggtggctgaaacagctggaggctggctgggcatttctctccacacgaacacgacctttcttttttctttttttcgagactgagtttcgctcttattgcccaggctggagtgcagtggcactatctcagctcaccacaacctccgcctgctgggttgaagcgattctcctgcttcagcttcccgagtagctcgattataggcatgtgccaccacgcctggctaattttgtatttttagtagggatggggtttcatcatgttggtcaggctggtctcgaactcccgacctcaggtgatccgccygccttggcctcccaaagtgttgggattacaggcgtgagccactgtgcctggcgatagtgagatttcttagatggcttccagcttccaaaaagaggaaacaagctgccagctctctgaaagcttggactcagaagtcctagaaagttcckcaggttctgttggtcacaagtcacaaggattcatggaaaggataacatagtttgcacctcttgatgggtaaggccacacacgggtacatacagatacatacagggaatgaaagagttgatcccagccatttttggatatgaccaaccacaggtattaaaaaataaccctgtaaacaattaatcagaattaactcatcagttgtgaacattcattatatcaagtttcttcacttgaaaatggagcctgaaactaatgccagtatgagagacagaaatccactagatactggactaaccttatggagaatctgggaagcaccttatgattcctagacttgcttataacggcatgtgggatgttctcttttttcttttatgcttactctcctggtcatatcaaataaggtatatcccaagcctttgagtgctatatccagtgtcccaagactgctccaaccacaaaactaaaaagaaaccagtttcctgtttggatatcagaaactttttacaatctattaggggagatttgactataaaaaatagacataaggtagccaccctttttgaatctttgggtgacttcggattactttgactattgaaaattattgaattccatttcaaatacagaataaccattgtttgccatgccctcagggggttagcatagtggagcggcaatatatccaggaccggattccctcctggactggagccggcttygtccgagtgcckgaaggggcttatttggagtttttcattgacaacataccatattccatggagtacgacatcctaattcgctacgagccacaggtaaagaaaccacttagtggactggtggaggagggaggggagaatcagtagaaaaatagtacttctamtgggtattatatatagttatgaaatatggaggttgcattagaacagatcagattcctatagtctcacctcctccatggaagttaaaataaatgtaccattttctttctttcttttttttttttttttttgagtctcgctctgttgtccaggctggagtgcagtggtgccatctcggctcactgcaatctccgcctcccgggttcaagcgattctcctgcctcagcctcctgagtagctgggattacaggcatgcgccaccatgcccagctaatttttgtatttttaatagagacggggtttcgccatgttggccaggctgatcttgaactcctgacctcaggtgattcgcccgcctcagcctcccaaagtgctgggattacaggcgtgagccaccacacccagtcaaaacgtaccattttcttgaatccagtttctcaaacgtagtgatcttttgtgaggcactcaaccttgctgacractgaggtggtgatgaggatgtatgagatcctctccttccctcacaacctggctgtgcagtgacagactgaagccccgaactgtaacgaaagactgaaggtgacggtgtaacagcagagagatgcatgatcctagaagatgggcatgcaccagccagcccgagccagggctaccaaaacrttttcctagagaatcagagctaggccttaaagtgtgaatggaattgtggaaagttggcacaaaagtaagaaatagtgtgagtggaagagagaagagagggttttgtttttattgagaatcattccacatagcttgatgagagatatggttggagatgctgttggcaaaaatactaggattagtaaaggaatttggactataatattcacaggaagctattgaagcatttcaagcaggggattgtcattatctgagctgctttaaagtggactgaaagggacattgggaagaggcagaaaacagttgagaggtgtttcagcatccagggcagaagggatttgggctggaaccaggggagtagcagaggtagtagtaaagagaaaagtgaagagcaactgtttgttttccatttcaacttggcaattgattgattcagagaggtctttttataaacaggcagtggtgggctaactatcttttcattgtttgtttcttattctagctacccgaccactgggaaaaagctgtcatcacagtgcagcgacctggaaggattccaaccagcagccgatgtggtaataccatccccgatgatgacaaccaggtggtgtcattatcaccaggctcaaggtcagtgtgacggtggtttggcagctcaacgggcttcatatgcaaattagtatttttctaatattttgcgagttttcaagtcaccatttcagagccagacgttgactgctgacttttttcctttggaattatcgatgcagagctttstttttaatttttattttttggatgcaygaaggttgactttcgttgttgtctttcttttttgtttgggggcagatatgtcgtccttcctcggccggygtgctttgagaagggaacaaactacacggtgaggttggagctgcctcagtacacctcctctgatagcgacgtggagagcccctacacgctgatcgattctgtaagtgcgagattgcttctggcatatgcaggaaagcctgggcggaaagtgcccagctgctctcagggtgttttgttgaggggtaatgctgaggccagcgtaagcagaatcattctttcttgcctccrcggttactttgcttatactccaccccatggaaaggatttattccttctaaaaatataaaatgtcttttaaaaaaaacagcatttcactaggcgtagtgactcacacctgtaatcccaacactttgggatgctgaggcaggaggatcatttgaggccaggagttcaagaccagcctgggcgacaaagcaagaccccatctctaaaataaaaataaatagcatttaaaagccatcaagctgtgtaaaacatatctaaaatttcctgccaagagtatttaggaatagggaggtttatactttatttaatgagtctaatgatttctgttcaagggtcaaagaagcatttgggttttctacacgtttgcttgcttaaacccatgccatggggcaccactgtaaggatgtttggccgttctcatttcttcacagcttsttctcatgccatactgtaaatcactggacatcttcaccgtgggaggttcaggagatggggtggtcaccaacagtgcctgggaaacctttcagagataccgatgtctagagaacagcagaagcgttgtgaaaacaccgatgacagatgtttgcagaaacatcatctttagcatttctgccctgttacaccagacaggcctgggtaggtattgctgggcagctgcagcagctgctgtttctggctctgagtatatctggcacatgaagtacagtggagtgcccaccccctagccctgtgttaggcagcacaagggaaatagtgtctcagttacagtttgtctttatctttttaagtaatatttcagtgaaagagcaccactgaagatggaattgatattcaagaaatatgcaaataacaggtgaccaggggaaaagtccatgaggataaagcatttccataagcagggtagggagaggggaatggaatcagagaagcatcaaatacctgaaatgtatgtttttctctttgaaacrtcagaccatcctctgaaggtcactgggctttggtctaatgtcctgtgatatttgagctttgaaggcaaggggagaaaacattaatgacctcctgcctagaaaaactgttttgatctgccaactctgcctcccctttcttcccttccgctcatcatagggatgatactgttttaaaccagaactctgaataatccaaagtagttaaaggagaaaggatcagggagagcccgatgatgtgctgctccgtgtcatgggttctggcctctctttacccacagcttgtgaatgcgaccctcagggttcgttaagttccgtgtgtgatcccaacggaggccagtgccagtgccggcccaacgtggttggaagaacctgcaacagatgtgcacctggaacttttggctttggccccagtggatgcaaacgtaggttcctcaaaagcattgttatgcattcattcagattaactcagccattgtggcagggttccattgctgcagagccgatgcttccctcctgaagttgatcacaccaacccatgagcattctgaattggggacagggtgcttataaaaggagcatgtttccattgaatgagtttctcaaggcagttccttgtttgcctgtttctttagcttgtgagtgccatctgcaaggatctgtcaatgccttctgcaatcccgtcactggccagtgccactgtttccagggagtgtatgctcggcagtgtgatcggtgcttacctgggcactggrgctttccaagttgccagccctgccagtgcaatggccacgccgatgactgcgacccagtgactggggagtgcttgaactgccaggactacaccatgggtcataactgtgaaaggtatgcagatgctgaaagtaaggagaatgtagtgatctctggctgagcagacagcatcttagaccaaccacagaattcatctccaccaggcttcagctcgctcattcatttctgaccacctcactattttctaggatcttgtttgtttatccagtacatattgagttgacatcctctatgtgccaggcaccgttctggtgctggagataccgcagagaacaaaactgacatgaatccgtcctcttggcgagtcaccctagagcttaccatagggctgtatagaaattctgtctgtctcagcagattctggcggaggataagagttgtgaaatgctcctgcctaatttaggcgaaaggagaaactaatccaaatgggattagtcattttaaatagctttgtttttcagaacgttttatgcaactacagtttccaggagactctataaaacatgcctaagtagatctgttctccagttagcaaatgtcagttgaataatcattatggatgtgctagatgtagagtaagaataggagagagaatatacctccataacattaataggatagctcaatagataaaaaatactccgtatgaaaaagttacctgctgacttacactgtttattactaattaagaaatgcagacagtactgttagaactggctttttgggcgtaatagtctccaccttttcactgtgataatttttctctcttccaacatccattcgccctatcgaagatatttgtttttaaaagtcacttgtgaaacattgcagcaagtgcttcagtcagtggtgaagttactcatcaggtgaaagagaaattgttagtgaaaaactgagtatgtgattaacttttggcatgaagatgttcatggaggcaaacacgtggctctcggctcaatgctagaacggtactcaagaatttggaggtcccacggactaccctttgaataaaaattatcccttccaaccttaaaattgtgttgtagaaagatagcaaggacacagttatacaacagtgaaaggaggaaattaatattttggggtcatctttttcttttcagccgttttccattattgttttttcaaagagagatggagaataagtacgagagaaagatatgagaaaacagagaaagacatgagaaaaagattaacagggagcagagagaggagggggaacagaagcaaacagcaaagggagctgccacaatgctgattcagaatcagcactcacactgtagaatgcatttgaacgaacatcatgtcagaatggcatagttgatatctgtgaccagctttggattttatttgtaaagggttttgagaatgagaaagggtatgggagaaggaagatttttaacaataggtttgggtggcaaacacttgattttaagtatttggaattctactatctagtttgagccagtttctcatcattcttttttctcattccaagataaccagagtttcaatcctgtgaatttacaaaaaaactctacacttagattgtccccaaggggaggcaagaaatgaacactcagtttctatcatgatgtatttggattgcctccaaaagacttgagaaacaaattgaattggaaatccttggacctcagttcctggcccaattctgcttctaacttgctttctaaccttgggtgagttaggatatccagcttctagaaaatttttttgagacggagttttgctcttgttgcccaggctgaagtacagtgstgcaatctcagctcactgcaacctctgactcgcaggttcaagcaattctcctgcctcagcctcccaagtagctgggattacaggctttttgttgttgttgttgtttgtttgttttgagatggagtctcattctgttgctcaggctggagtgcaatggtgcgatcttggctcactgcaacctctgcctcctgggttcaggtgattctcctgtctcagcctcccaagtagctgggattacaggcacaggccaccatgcctggctaatcttttgtatttttaagggagatggggtttcaccatgttggccaggctggtctcaaactcccaacctcaggtgatccacccgctgcagcctcccaaaatgctgggattacaggggtgagccaccgcacctggccggaatatccagcttttcataagtagaataactaggttggatgagattgtctccaaagttccttcaagatgttatgttgtaggacataaaaaagtaacataattaccattcaccttgacaagcaggctaacatagtaaaagaatgtattgctttaaggaccccaaattcaaattctggctcattatttaactagttgtataaactttgagaatcctttgacctccctgtatttgttatctttaaagagtgggattgacatgttggatatgggaattaataagtaacatgacccatccctgcctgagtttggaaccacctgagagacaaacacaggggctacacagctggagagcacccctgtcaccccctcagctccagtactgggaaaagctgggttatagcacatggctttagacctgtggccaccgtgggcttgccaacacatcacccctctcaggcataggcagaggctgacaggtataagccccgcctaggaggacagactctgtaatacaaggagggagcagaactgaatggtcaggacaggcaggcagctgatagaacaatcaagtgcacatggggagaggtggctcttcctctggggagcagtgagtgaggggccagatgaagccatgggtgtcactcgaacgcagtggtcctgcaagtaggatccctagatcagcagcatcaatattatcggggacctactgaatcagaaactcggtgggaggagcccagtcatctgtttcaggtgattgtgattgaagctaaagtttgagaaccactgttcccatagtaaatcttccacatgaaaacataaagagaggtgggcagatcacctgaggtcaggagtttgagaccagcttgaccaacatggtgaaaccccatctctactaaaaatataaaaattaggctgggtatggtggctcacacctgtaatcccagcactttgggaggctgaggtgggtggatcacctgagatcaggagttcaagaccagcctggccaacatggtgaaaccctgtctctactaaaaatacaaaaattagccgggcatggtggtgcatgcctataatcccagctacctgggaggctgaggcaggagaattgtttgaaccaggaggtggaggttgcagcgtgctgagatcgtgccactgcactccagcctgcgcaacagagcgcgactccatctcaaaaacaaacaaaaaaacagccaggtgtggtggtgtgtgcctgtartcccagctacttgggaggctgaggcaggagaatcacttgaacccaaaaaacagaggttacagtgagctgagatagtgccactgcactccagcctgggtgacagagcaagattctgtctcaaagaaaacatgaggagtggagaagagtgtgcccaaacagaacagttttcaagactttccttggaacaggtttcttagaactgtggggtcatggcctgttctcttctgtgactgatgcaggtgcttggctggttactatggcgaccccatcattgggtcaggagatcactgccgcccttgcccttgcccagatggtcccgacagtggacgccagtttgccaggagctgctaccaagatcctgttactttacagcttgcctgtgtttgtgatcctggatacattggtaagtcgtgtgcatactttgggaggcaaagagagagaaaaagatgtctttatgagttcattgttaatgagaaaaaaagatgcaaagtgaaccaattaagtctacttttataatttttaattaaaaattagaaaagatgctcttttcctatttggcacatggagtggagtcaattcatattgagtctctgataagaacgttataacacaaagcaggaaagtaagctcgtggaaatctagaaaccctgtggaacacttttctgttattaaacattagaaagattaacttaagttttactcstgcctttctttatccaactcctagcaaaagtatctcaaagctgtgaggttaccaaatagtagtcagaagaaagaaataatatcatccagggaatcacaagatggccgaatatattcttcactgttaatgatactcacattatctatcaagattcaattaatctagctgggttgttaaaaactccctcttatttcatccttgaagccactgttacaaatactaattatgtttatatgtaactcagtaaaatttttttgcatataatttcagaatttcttagggaaattggtcatcattaaagatcccatttttcaggttgctcacagaggagtggtaacttttcagtttctgtaattctttgttttgttttgtttttgagacggggtctcactctgtcacccaggctggagtgcagtggcacaatctgggctcactgcaagctccgcctcccaggttcacgccattctccagcctcagcctcccgagtagctggggctacaggcacctgccaccatgccccaccaccacgcctggctaattttgtttttgtatttttggtagagatggggtttcaccatgttagccaggatggtctcgatctcctgacttcgtgatccacccacctcggcctcccaaagtgctgggattacaggcgtgagccactgcgcccagcccactttctgtaattcttgaattaggctgggtgtggtggctcatgcttgtagttccagcactttgggaggctgaggcaggaggattgcttgagcccaggagtaagagaccagcgtgggcaagatggcgagacaccatctctccaaaaaaaaaaaaaaaaaattttacaaaattagtcaggtgtagtgccgcaaacctgtagtcccagctgctgggaaagctgaagtgggagaattccttgagcccggaaattcagggctgcagtgagctattatcatgtcactgcattccaacctgggtgataaagcaaggccccatgtcttaaaaaaatgtaatccttggattaggatttctacatgaagctatgctttacattgttagtttgctccyaacatgctccacccccatgtgctcagaagctaaagtctcatgtgctaggacctaactgtccacagccgctgtggcctctggggcagttgcaacactgttagagactacaaaacattagattggtgcaaaaagttactatggtttttgccactgaaagtaatactgccttcctctcacaactcaaagcctattctttccccttcagatgtgatcaccctgggctctttaaacagtgcagtgaagatgaagcaccgccacgatcagctctctctaggcatgagtgtcggtgcactggtgagctttcagtcaataagctaaacatcttgtgtttggttttatcgggtgacaggttccagatgtgacractgtgcctcaggatactttggcaatccatcagaagttggggggtcgtgtsagccttgccagtgtcacaacaacattgacacgacagacccagaagcctgtgacaaggagactgggaggtgtctcaagtgcctgtaccacacggaaggggaacactgtcagttctgccggtttggatactatggtgatgccctccrgcaggactgtcgaagtaagatgcacatttattctgcccacttcttagaatgacttccacctttttttcattatcagcagattttattcttcctgtatttatttcacttgggaaaacacttgttcagagaggtaaaatttcactttcaactaaggaaagatgagaccaattttttttttttttttaatgagacagagtctcactctatcacccaggctggagtgcagtggcatgatctcagctcactataacctctgcctccagagttcaagtgattctcatgcctcagcctcccgagtaggtgggattgcaggcaccccccaccatgcccaggtaatttttgtatttttaatagagacggggtttcaccatgttggtcaggttggtctcgaactcctgacctcaggtgatccacccgcctcggccttccaaagtgctgggattacaggcgtgagccgttgcacctggtcatttttatttttttctttacatccacattttctggcaggagtgaggtctcaagatgtgactcagtgcctgggagagataacaggaaagaaaaaccatgtagctgtccccatgataaatggcatccagtagagggtactgatggtatgctctgcccatgaacttgctggttggatggacttcgaaatcctaaatacccactgtggtcccaccttttctagtggcattgatggaatagagccttccagcttaaggaagagaaagaagtagcatctctaacatctctcttttggacctctttatttctctcttaccgagatcaactagcatttcctcttgctgcagctgcacagcccccaggctcctggctttgtttatacaaacatgtgtggaatgctagggaccagcaggactggattccttaaaagccttagtagcttaaagggcttttacctgctatgtccaacacgtttattacggctgttctctgccaagagtttgaaattattagatatctcaattcccactggcattttttaaaattatttccagttaagccttcaattttaaaatgactcaccagcatcttgtcaaatctgtgtattttgaacatacttttaggtgaaatgtgtcattgtgtgtatctgggaaatgtcagaactgtgtaagaaatcacgagaacttctaaacagtaattttagctttatttttgaatcacctccatttctttccttctttgcatttcaaggtcaagatgtgaagtgggaacatcttagcatttagatgtggctaacatccgcatgcctgtgtatttgggagtgtgacaataagtaaatgtgatgttcttttgcagagtgtgtctgtaattacctgggcaccgtgcaagagcactgtaacggctctgactgccagtgygacaaagccactggtcagtgcttgtgtcttcctaatgtgatcgggcagaactgtgaccgctgtgcgcccaatacctggcagctggccagtggcactggctgtgacccatgcaactgcaatgctgctcattccttcgggccatcttgcaatgaggtgaggggctgctgctggggatgatgcctttatgagctcaggtgtcagccyatggtgactttgccccagttagagcaaggcaccagggcacacagcttgaaacacagcgtggcctggatcttagccctcatttgtaccccttggctgggtctacataactgtgcacagagtccccatcagacacatccatagcatttcagtagagggtcccagctgcagatgcagactcacttaacaatagacaagggtgtgctayttctcttcagtacctgggcgctgaagcagactcttttcttagcttctcgaaaggaaccaattagccatacccagcattgtaaaaagtgctgttgtttcctgacacatgctaaggagggcatactccctaagtcaggcgagtcaaaggtggcccaggattgtggctgatctgtgaggataaaagtgaggaaatatgtaaataaataataacatgccacagacctttccaagccctgttgcaaaagagcacttagatgctggcatggggctctcgacacctacraytgaagtgggagtcccttttcctagtcaatggagaccttctcaggtaaacagttcattcctacttctaagtggcagctagaaaaaaaagatgacaactggcttctggcctgaagcctgcttgaccaaggtctgtgttctggccgcagttcacggggcagtgccagtgcatgcctgggtttggaggccgcacctgyagcgagtgccaggaactcttctggggagaccccgacgtggagtgccgaggtgagttgtgggcgttctygcattgacttgatcagagagtggagggaactggggttctacaagagccttctgtaaattataaaacacagtacaaattaacgtgtctataagaacctgtatttaattgcaaaataaattaacactgattgtttaaaaaacaatctaacaaatctagccctgcccataagtataggtagtcaagagtggatgtgcatactctcccggcctcacaccctggggtaaagtttgtttctgtgtgtaagcacacacacacacacacacacacacacacacacacaccacaaatacacacagagctgctttttaaaatacttttaaccaaggtgggaccatgtgaaccctatgtttggcaaagtgactttttatcccctctgaacagtattttgtggccaacttccttgatggcacaagaagaggtaaatggttatcctagtaagatcactggattcagtggatcaactagactctgttgacagtttaagctcttggcgtatgtgtgtaagataacatccccaccagtgaaaactggagggcaatgtcatggagacttcgtgcacaacaaagggctccaaggtcaggggctccaagtcagtttaatgtgaataaaacccagattttcacctaagcttatgattaaacaaacaaacaaaaaaagatggaaatgacattttcttacaaacaaaaacttgttaaaattatgtgaatcatcaggattgcttgatttttatggtattgcagtttttttgacctggaaaattatttttcagatcttaaagtcaaaatatggaaaagactgaataggctgttgcaactctgtttttatattctttctttcctacttgattttcttccctgtttttaattgatcattatggataaaaattttctgtagtttcttaagtgctctttsgtatatttgttgcacatctgaaattataggtctctgttggactcttgaattttttttttttttgagacggagtctcgctctgtcacctaggccggaatgcagtggcataatctcggcttactgcaacctccacctcctgggttcaagcgattctcctgcctcagcctcccaaataactggagttacaggcaagcgccaccacgcccggctaatttttgtatttttagtagagatggggtttcaccatattggtcaggctggtctcaaactcctgwcctcatgattcacccgcctcggcctcccaaagttctagaattacaggtgtgagccactgtgcctgrccaggactcttaaatttttaaaatgaccgttttctttttttggacacaactacagcaagaaataatacagatcttcaagttggcaactcattcaatatctcctacagaaggtcaggaacctagaaactgtgttccttcagggtgcaaacccatgtgttccttaacagcagaaaaaggtcagtgggcaagaccagaacaaattagatatgatttgttttttaagttgaggcttagccagaagggtttgtatggacctcttagattaaggtttgtttcacagtggggataatgtttgctatgtcaataaacaggtacttttctttcatcattctccaaatttggttcttaatgagatctgacatcccctcttccattagaaggtattgaaatccagtggaccagtttctccaagatgtctcttgaaagtaaaactctgcttaaaatctgttttttccagggctctaatcactactctgttaaattcctcaaacttgtaatgccccaaggcttgattttttccagataatggctctatcgttgcacataccctgattctgtcagcatgtgtcattggcaaaatagctttctctgccaaagctttctgacctttggctccatcttagctttgttagcaggaaaggcctgctacccagagtcagagtcaatcagagaattgttcatgtggtccttagaactttactccttacccttttatcttttctttaaactttcgcctctaaatctgccagggaaattgtgacttatagaaaccttgtcaacttgtttgggtcaaaagttagatcctgttttagaaactctgcaaagagtgagattcatggcatcattgttcgccaacttctttgttcctttcatccagaagaaaggtcagctcattacrtaagaaacttttcatcaggaaaagcaaacaacygataaaaaacagaaactaagtattctgcaaggaaacctggtttaaggagaatgtattgaaactggatatgtctgttcctttttactcctccctttggcatttcctttttttttctgtaagataatcatagaaatttagttaatggaggaactacaaagatcacatggctttatggtttgcctattatgctggccaatcccggtggcacgagggcagcagggatgcagacagatgaagaggtcccatagccaagagtgtaggtcctggagccagactgcccacattcacttcaagcaattggtactcctgtattagaagaaaacaaagtcccttctcatctcctcacccagtatactcctctttttactcagcttgataggaatctttccagtcctctctgcatttatatgtatacatcattcgtattcgtgaccctaataatgatacccagtcagctcacaccagcaagaaaaagtatttttcaagccctctggaagcattggaagctccaagtgagcataagtgaaaataccctaagagatacttccaggttctagatccaggtgtttcattttccccttgttttcccactacattgtcatctctccaaccttatctttagttttgtttttttcatggaagaccagaaagcccctttccccaaagtgttaaaatctggggtgaaggcaactgacctcattgcatactttggcaattcaaagttataaaatgttagccgggcacggtggttcacgcctgtaatcccaacactttgggaggccaaggcgggcggatcacttgaggtcaggagtccgacaccagccggaccaacatggtgaaaccccatctctactaaaaataygaaaattaatcaggtgagatggcgcacacctataatcccagctacttgggaggctgaggcatgagaatcgcttgaacccaggaggcagaggttgcagtgagtgagcagagatcgtgccactgccctccagcctgggtgacagagcaagactgtctcaaaaaaaaaaaaaaaaaaagaagaagaagatataaaatgttggggcatctttatttggggtgttaaagtagatactgtctctcctttgtgcccacagtggctgagctggggtggggacatttggaaatttgggaggaggggagtattttgggtcatcaccataatggggtcattgctataggcacttggtatgcaggagccaataataataaatgtcccacagtgcttaaggcagtctgtcaaacagagaatgtgtcggatcctcaatgcttttagcactctttggagaaagctcataacctacaaagcacccagagagagtgagaattgatttgagtggacaatgggggattgattcatggccagctatggggtctggtgcagacagggtggcaacaggagtaggaccagtgtggcctgtgaaggcaggggccaagatgcagaggcagacaaggctcttggttatgtttgtgctggaatgcattcacgattagaaacaggagcacaggggctttctgaagggatgggcccagagatcagcagggacaagaagaggtgtcattcaaaattagatggaactatgcaaaaagaacatcagctcttttctccagttatgtaattgcttgacaaatatgttttcagttgaattggttgttagagggcataaatttagactttctgatgccaactagctaacaatatgcttatagaaagatttaagtcctagctaagtattctccttatggaaaaaaagaatgtagttatgtaaaagacaaatgagttgagcctccaacttacagattgttgaatgttcctattgtccaggcgggttggggctgttggtcgatggtgccaagcctgaacaagcccaccactgtgctgggatggagagggaatctcatccacccaccatgaacgtgctggagaaaacagcctggagcgctgcattgtcctcctcaggagtcaaagagtcacaggaggaatctttctgttgattcatagatagcaaaaaggaagggtaaagtttccatttggggcctctggctcttggaaaagggcagtgtctctaaacccaggcaaacggtaaatgtggggcataggcaagagggtccgggtagtggccacttccccatcatgctcgtttctcattttgtgttttttagtagaaaaacacagtgtgttcttttgcccagacattaatctttagaatgcctgtattttctaatgttgggatttctttcacaaccacccaccttaatatttccattgtgactcagaaaatcagacttcattcgattctttagagaactataaatactgttgtcagtagagtgaagtcttgtcttatgtaatcctaattacagaatgtgttctcagaagaggtaggctagaccagagctgggcagaccacaggcagaggccaaatccagccccctgccgatagtagctaatataagttttacacccacttgttcatgtattttccctggctacttgtgggcagcaatgccagagtcaagtcatcataacagagacagaatggcctgaaagctggatttactatttcaacttttacattaaaacttgatgacccctgtgctagacaggcagctcatttctgcaggtaaaattatattcatctcccaactttcattccaaaattgaacctatattactgaggccaaaaagggaaraggataaaagagaatgtcagaaaaaagaaaatcccatgtaagaaataaaaattatttaaattgcccttgcttttagtaaatagaaatgcctaagtaaagtatcagtaaaattcttggcattgcagcagatcctggagtcccacgttgctttgaggcaaggtccacggcagaagaaaaccccattacctgaatcttagggtgtagcagtttctctgtcccaaggcaaatttaagttkccaacaaaaaggaggataatcagcccagtactgagtgaccaatggtatagagtggggagtggacacagagagaacagctgatactgttctgccacttgcaggctatttggggacatggggtacataaaatgaagtaacaagatagcagaaagtaagtggcacaaacttttcagttgtcagaagagggcaagatcagtaggaaatggagtcattagggaagggtttgcagaaaagattagctctagtggccatctacagagaacrtgctgagtgccaagcacttttaggcatattatataagtattcttaattttatccttgcaacaaagaacctatgggggtaagtatcatctccatttcacacttgactaatctcagactcagagaggttaagggacttgcccaaagtgaggaaagaactgggatctgaagccaggcctatgtggccctgtgtcccagctgtttccacaagcctgggggctcctcattgacagctggtatttagagaggaaattatcatccaagctaaaggacaacacagacaacatgaagcagcatggctctgggaggtgccctcgggaaacagtctcagctggagagtcatggagagatttggtttcaccagattgtgtgaagccttcggtgctgggccattaagggtagactttgttcartgggcacaggaaggtctggaggaggagagggaaggatgtaaaggaagcaggcaagttaggtctatgtgataaatgggtacatagactatttcccattgtggcattgacttgctagtgttttcctctggaccttagtatctttaaaatcggtacaatagctttcatttacctacttcttaacaattatgtttgaaatgataagaaaacttagtaaaaatagaggaagcctactggccacagaacagagagtgtgtttacagatgaaagtcaaattattatggcttgttaaaatgagtatctcatttaaaaaatactrttcttcatcttcatgatttgttcatcttaaagattaggcaacaacttttgctatrtatgctctcctttccaagagaaagtttctgattctctgccaagtaatcccatttcttaaaataagactgctttatctaggtcatttggattctgattcctttctcttaagagagaaggagcccactggacctcatcagctgcagcctgaatagtcagttcacagtttttcagatcctggtgggtgtgtgagatgatgggagaatctcctccatacattagtgtccatgaagttttactaacttgtcaagtgtgaactgacctttctgcttcagccacgtgagtgtgggagtttcactgaaaatattcttgaagtggagggggtctttttacaaggttgtaaaatgtgggccttctggtgcctgcctcttaggtgactccaagagaagcaattctggaaattcaatagccagggaaggaagcacatgaccaggggcttcagcttgaaatcaaaacctggtacatttgagactagttatttggtgccctcccggagagtcaggcccaactttttcaataatgacactgcaatccggtcatctgtgagatttgatggtttacttttcaggtgggagaaaggaatgttggtcagtttggctgaactggttgttgacttctggagagagccgaagctctgctagctcattggaactcttacccaggctaatttccctcggccagataaagagggaagmcttatctgccttttaagtctttcagggttgggctgttttccccttaaagatgcctatgacagaatgggagcaagacatgtctttggcaacgaaataaatgaaaaatgatcacagaaattaaaaataaatcaacgtatgcatgcatcccttgccccaagcatgaatccagcaaaaacctaatgtttaggactgaacaaaggtatacctttgcatcatctatgggaaagaaataattgtctaagcaaactataagcatatgcaactctgcctcagttgtgtcaagtctaagggagatgggtgagtaggccccagagggctgcctcaccctgaccactggctggtagacaaggtaagttttattacaaatggcatcacttcttcctctgttacgtaagtcctgagatttgtgcatcagcctacattgctgaacttccgaagtcgtgattctgctccagctccaccttttgaagggtatctctttctccatctctcacacagacacacagatacacacacacgcacatgctctctttttttctctaatatacagaaggcgggcagaaacagctgggaaagtaacagtcagtgctccacaaaacggggtcgcgtgactgtgaacatcagtatctcctgggaacgtgatagaaataaaaatagttctgggccccacccagacctactgaatcagaatctggggatgggaggagagtagagaagcaatctgttttttatgaaccttccaggtgattctgatacctacccaagtttgagaggtgaggacccaggtgactcgggggtaacttttagctttctggaagatgactaaattttaccaaatgataatggaaatgtattcctaaaatctaaacaacataaactcttaaggtactaagttatttaagttatttgtaagttatctaagttcttcctaatctcagaaatcgattaatgtagtggttttcccaagcctttctcattatttctcttgggtgtcactggcattgacttccactaaaaaaagatcccatggtcaaatgactttggcatacatacaactggataaaaacaatataaaacagtttttcctgcagaactcttctgagtctgtaatatgctgacacttgtttttaatcttcaagataaggatacagaayttttcatcatgggatagttttttcaaggaacacatcatagaacgtatggtctacggatcaccattaaagttatccatggtttgcctaaacagcttcctgattcattacgagaatattccccaaacaagaaaaatgaaacatactttaagtacctggaaaggatctgttttttgaaaagcatacacccaagttttacttttgaaatcctaaggtcttggttttgaaaaccccaggcgctaaggaaattacatgttttaaaatcctaaaggttgaggaattaatattctaaacttcaaatttttgaataatcatgacgttattggcaaatacatataaataaacatataaccggaacacgtttttcccctttatccaatggaaataygatcaagcatcactcttagcagaagactaccagacacttgtagggacacgaaaagtgataataaaaacaatttatttattgaatgcttgctatagaccagatgctcttctaagcactttgtaattattttatcttgaaagcagtcctgtatttataatcattacctcttcttacagatgtggaagacgtgactcagtttcctgattacccagggtcacataacatgtgtggagaaggcaggatttaccacctcagtccgcagttcatgctcttaaccataatgctgtactcctcaaacctgccactcgagagcttggaatgtagggggagaacaaagacaataaaaagataaactagcaatacaaggcaggatgtggtgagggccaaatgaatgggccacaaacacacacctctgggttgaaaggatggtgatgttatagcagatctcaggaccctcagtataactggttctgggagatgttccattagaaagtttttcagaggaaggccgggcgcggtggctcacgcctgtaatcccagcacttcgggaggccaaggtgggcggatcacaaggtgaagagatggagaccatgctggccaacatggtgaaaccccgtctctactaaaaatacaaaaattagctgggcatggtggtgcatgcctgtagtcccagctatttaggaggcagaggcagaatagcttgaacccgggaagtggaggttgcagtgagccgagatcatgccactgcactccagcctgggagacagagtgagactcttccaaaaaaaaaaaaagtttttcagaggcaaatcacagctattgacccaagagtggctcacacctgtaatctcagcactttgggaggccaaggcaggcagatcacctgaggtcgggagttccagaccagcctgaccaacatggagaaacaccgtctcttaaaaaaaaaaaaaaaaaaaaaaaaaaaaaaaaaaaagccgggtgtggtggcgcatgcctgtaatcccagctactcgggaggctgaggcaggggaattgcttgaacccagccaggaggcagaggttgcagtgagccgagatcgcgccattgtactccagcctgagcaacaagagcaaaacctccgtctcaaaaaaaaaaaaaaatccgagaaagcatgaatctgttgtgctttgccacagttgacattgcacttcaggaggattattttcttttatgaaggtatgtaagtgtccttgcatgcctagactaaaatgaggttagggcttcatttggcaaagacgtttggattctgattgcaagttaaccctgagtccgatgctgaaaaacgaaaaatggtttaagatgtgcccctgcccttggagtccacaatccagttagggaaataagatagtatattctttatttattcctgtctttcctcagaatgggtggaagcccagcgataagatgttagcataaggcctttcgtaattcaaaccctgtataaatactttcaaatgtcagatgttgatataaaaatgatttggtcacctgaaatttgggaatctaagccagggttcaagggcacagccactgtgctaagtaatctcagccacagctactggccaagaacacattttgtcctgtacggcacgtgattttcctgtgccatttggctttgcatraggtgccaaccctattgggcctgtgagacgctgagactgaatggctcccaagatccctgcttgtagtactggcagtggtcatcacaatggcagacacccccaagttagattatacttagttgaaagcctttaaactggatacttagaattcctttgggttttgttttgttttgatcatgtttattgcatttcatcaagtatgttttgttgtgagatagagtcaggtacgtaargagcttctcatttgtgatgtatccgatgccaggtggcacattatcaggatgtaacctggattgtttgtacagacatggtctgtggggaaatcctaagtaagggggaggcaaaggcaggacggaggtgaagagtatagactccggagttgcaaagaactgaatcagaattctggcgtggccttttccttgcagtgagacttggggcatgttacataatctctctgatctctsagttcccacatctgtgaaatagtgattattataacacgtatcccatagggttattgtgagagttaaatgggatcattcatataaaacatttctgtttaaagtattattactgctaagaaggggttagcaaccactgaagtcacgcatgtgctagaggaagctgctacagtctctacctgagccattggtcaattgttgtcgatggttgacaccttcccattttcacagtgaagtgagtattctaaatgccacatcttgtcactgaggttcatgatyaagtagatcagctagcattgcttattcccttctagcctgtgactgtgaccccaggggcattgagacgccacagtgtgaccagtccacgggccagtgtgtctgcgttgagggtgttgagggtccacgctgtgacaagtgcacgcgagggtactcgggggtcttccctgactgcacaccctgccaccagtgctttgctctctgggatgtgatcattgccgagctgaccaacaggacacacagattcctggagaaagccaaggccttgaagatcagtggtgtgatcgggccttaccgtgagactgtggactcggtggagaggaaagtcagcgagataaaagacatcctggcgcagagccccgcagcagagccactgaaaaacattgggaatctctttgaggaagcagagtaagtagttaatgagccagaggaattactcataaagctgaaaaaatattgtgagttaacagcaaagatttcctggcatggtgcttccatcaggaggttttgttagtcctgtgggtgagaacagattctgagccatttattttccagcagtcttgactgggcatttgggtgagtgaacgttggcacatcagtggggaccagccttctggaggctgcagtacagaatatgcaagcattatattcagtgctcctccttgcaaatcatgttctaagtcagtaaaatgggaggaatgctggatttagaagacaaagatccataattgagtcttggctctgatgctaggcttgtgaacttggatgactcaattcctgagcctgtattttctctcctgtggagaaggggtaggataatatatgccattaccttatgaagtaatgaaaggatttatatataaaataacaacaggattgcagaaaattataaattaagtattgctactatgggggaaattccattacctcaaaataagactgcttacttcaagttttttctgcttctccgccattagtccaccagaccagtgcttcattcatctagttataacagctgctctatgctgaaaagtcctcatcccaccccttctctaggtaatcttccctctgattggacagtgtttgttagtggaagcctagagaattgaccttctcaaggatcatttatctaccctttctcctacctcccctctcttgcccctaaacwtcccaactccttttgccaaaaaggaacccccaaaacagcacaataagacctaagtgctaaaggacaaaaayagaaaagggtatgaggcatctgtgcttccctagatgctatggttttttcactgcagactcaccatctaggcctgaggggactgcttcacagttaaatcctgcacactgaggtgtttatatgacgaaatgacagtaacattttttgtgtgtgatgagactttaatcagcacctttaagaagccagagggacttttcatctcataccaggcatgagtagcagaggacagctgacattagctcaagcgacttgaaggaggtccttcctagacctagatttaaagtaactggaccttgatgtcaagccttgggttttatgcccaagaccatgtagctggccagagtgttaggaaacgtctgatgtagagtgacaatgcatttagtgaggcattttacctcactgaaaagactaagcctcctaatgtgcagagatcacagttttggcaggccgtggtccgaatgcaagcccatttaggaaatgatccttggcctgggtcttaggcatctctgggaggaagaaaaaaatctggtgtcctttgagagcctgccagaagagagattacattcccaaaacagctctgtttctaccgtcactattcatttaactagacagattgtaataatcacaggaaaactagttccattactcttttttttcaacatactatccaaggatacatgttttaggaaccaaagtggccttattttaaaatacgatgttagatttgcttgttttaaaaaaaattgtatcattttatgagacctgagaagaaatgaaagccttctgtgagtcatataattaataaaagcaaagcactgaaaaaagaaactatgtatattagcctcaggaaaaaaaggcactgaaatgtaatttaatctaccattttaaaccatccctttaagtactttttctttgagttgggttatagttttatctcagccttacatatcatttttctaatggctcccaacctttcagcatctttacattttcctggttttttatactattatatcgccaagaagacaattacattcaattaggtgaaccagtaatacccagargtaaaatctgctcaaatattactttctttacaatacacatacaaccctacccacacccacctggagcacactcgcatgtgcacacacacacccatatccacactatgtacacaataatatacaaatagatgtcaaaagtacggctttgtaggtttgaaagtacagaacaaaatgcagtttagattccaaattaaatactgtgaaagctaaatcttcttatttcattcttagtagatgctattttcttataaaaaataaaaaggctgttggtagaaggaggcccctctgayggaagagaggagtgtatgaaagctgatactggtggctcctgttgtctttgtggcaggctatagggcttcccctctgcatgttccatcttgaaggagatccctgaggcttagggaagaatgttttgggcttgtggctgggaggcctaattgtataactggagtcatttatgtcttcagttttcacaattgtaagggcttgaagctgcctgtgaatagagccagaactccacactctgacctgtgctcatcttacagcagaaatttggaatcccttaaatggcttgtctgccacaactcagctgagtggtacttctgtgtttctctcaaaagtcattgaacaaagaaaaattgttagatttaatactatctgttataaggaaaataaaactagcacttagggatgaaatgttacaaattactgaattggtttgaaattagtaatggatacagtactagtagaaaatatgaaacgtgaaagttctcccttgggtttattttatgtaagyaagcttaactttctctttacaggaaactgattaaagatgttacagaaatgatggctcaagtagaagtgaaattatctgacacaacttcccaaagcaacagcacagccaaagaactggattctctacagacagaagccgaaagcctagacaacactgtgaaagaacttgctgaacaactggaatttatcaaaaactcagatattcggggtgagcattttttggtgcaaatagtcccagacaatggatttaacgatatgtctaacgttttaatatagcacttttggggaaraaaaaagttttctaataaattttaaaacttttgctcatccagtttctggcacaaatgaggatcaaagtccccattttacaaatgtgggacttgggcacagagaacctaagagacatagcaaaggtcccacagagtgaatggcagtagttgtatcagaatggtatccatttcctgattttttttttttccctccagttagtagtttaatcccctggccttttcttggaagggggttcttttgaatagttaaggtattaatacttctgcaaatcctttcacattcaagaatgctgcttggtcagaaaaaaacttttgcaaatcattatttatatcatagactgtaaaggatcctcagcaaaaagtgaatgtagaaatatgttacatcatactgtccaactatccatactgttttatgcatgattgcttttggactaaagctaaaaacatgtcatgctgttatatataataccgtcatcccttggtatccatgggggattggttccaggacccactgcagaaaccaaaatccacaggtggtcaagtccgttatataaaatggcacttgcatataacctatgcatatcctcctatatacttctttctttttctctctctctctttctttctttctttaagagatgggctcttgctatgctgctcaggctggtcttgaactcctggactcaagtgatcctcccgtctcagacttctgaatagctgagattatagaggtgaaccaccacacccagctttacttttttctttttttcccttcagtatatttaaaagtaatctgtagattacttacaatacctaatacaatgtaaatgctatgtaaatagttgttatactttattgtttaggaaataatggcaagaaaaaagtctgtacacattcagtacagatacaaccattttttccaaatgctttccatccacagttggttgaatccacatatgtggaacctacaaatatggagggctactatattagtcatttgagtggatccgaataaaggattgagaaaagtcatctagtcatataatcttcaggctgcctgaaaccagctatttataaagaactggatgtttgcttgtgtatagaaacaagattgcatgattttcttaatttttcatttttcacccagatgtttgccatactcgagctggagtaggtgctaatgggacaaaacatattcattgctcatgaaaactgtacttcataaatattttttcttgaattttaaaactttacagtaaatttaggacccgaagacaccaaatatagacactgcttggggaggaarcctagtatgatgaggttaactgtgggcaatttcatttcctaccctaggtgccttggatagcattaccaagtatttccagatgtctcttgaggcagaggagagggtgaatgcctccaccacagaacccaacagcactgtggagcagtcagccctcatgagagacagagtagaagacgtgatgatggagcgagaatcccagttcaaggaaaaacaagaggagcaggctcgcctccttgatgaactggcaggcaagctacaaagcctagacctttcagccgctgccgaaatggtaaggtttggggatgtggccttactgctatggtgccaagcaaaaaaaaaaaaacaaagaaaaacaaaccatcttttgtcattattacaataatttgcaaatgaatcagcaggactgaaactcctaggctgaggtctctggatcctggaatggggtatctgtaaccaagacagattaaaagcagcagcatatgggtttccagccttcccctcttctgtttctctgtggtcctcaactaaagaatgaatcatgactattctcccatactgttttagctactcagtgacacygcactgaaacttgatcctttttacactgtggacatttctttaatattttttttcctaagtagagacagggtctcactacattgctcaggctagtcttgaactccgggtctccagcaatcctcctctcacctcagcctcctcccaaagtgctgggattacaggctaacaccccagcccacccccacccccgctttttttttttttttaaagagatggagtctcactacgttgcccaggctgacctcaaactcctaggctgaagcgatcttcccacctcaccctcctgagtagctgagatgacaggcatgtgccaccacacccagcttggacattccttttttagtttgttctgatttgaattataaaacccatctcagtgtaggaattcagartcattctagaaggggcttccattaaaaattaaagggagcaaaagaattttttcacgggtattagctattatgttcctttgttccagtaactttacctggtgaagattaaccctgaaaccagcctagaaagtagattcatttcccagaagcttttaaaaaggaactctggagccaaatgaaattgggttgtgagtttaatgaaaatcaggcagaaggccccaaaaaagcctaactgagcctgtttcttcctcttccttcctgtgttttcaaggaaggatacctatgtgaaataatttggagggtattttttatagactaaggtttgtgttctcttagcccagagacacagagaaagttaaagatggaaggtacataggygcagaagagttcaaacttcattacagctttgtcttagtgatgcttcctccctcctctcatcactttctctgaaatagacaaaattggtcacaatataagacagtgtttattgatgcctgctaggtttcatactcattatcttctgaaactttatagcaaatagggagcaaataatctgtcatttattaaatggaaaaataaaagatgaagaaaaaagaaaaatgaaggcttagagcaatgtgtaaattgcagctaacaggagacaaagttatgaagcatgaaatgccaattctctccatctttcccttcagcattgattccttccttacatattgtagttaaaaaaaaaaaatcagytatcacaaacaagttctgtgtgacctacaagaaacagctaagcatgctaaaggatttttgtcttgaaccggaggcatctccgtgggcggcagggagatgcatgggcggtgggtggggttcggggttcctctggcctttcaaatgtgtgcccttccctgtgcttgcttttccacctggtaaactacctagggattagcagctgcttcagttctcttactgtgtttttgtctttgttaatgatcctgtgagaattctttctgtaagttctttactgccatttccttgtgtagagagagttttgtccttttgtttttcaggtacttctagttctgtatctttgtggatgtttagctagagccatactgtgtttttttttttccatgtctgccccatctgttgaaacaaaacagatcttctatgtgtgctgtcagattgtttttagaaagcaaccgaggttttacacttatgttcttaagactcatgttttacagcatgcagaatacactttattttctgaagctttttgtttttgtaagccagataaatgacttatttagttgtaatttgagatataatggaattataattatyttaaaattattaggctaaatagttgattgtatttatttaaaaactacttttttgtactttttaataacaatacttgtttgggaatattctgttaactccttttcactgcagtaaatctttgtcttcttttcagtatgagaatttccacaaacagctctaaatgcaattttctccctgctcagccttttctatcatatagcacacttgtattataatttatcaatttgcatttgtatgccatgaccaagtggtgatctttgagaggttttggtaggtaagaaaggaggactctatgcatgtgtgatggcagtcgggggtggtaatttgggaacacttcatctacctttgttcctttgtttgtactgttttctttaacctgtggaatgttttcccacttcccctgctcaaatcccaccagccaacagcttcttcagctacaactgtagcattcctctgcagtctctcctttgtctactttctttcatagtgactgcatctgacctattcttggctattttatgtggaatgatccagtcctaactagatgggaagttactaaaacgctagktaatagatcttttmtgtcaccatatttactggaggagttaacatggtgctggtgctgktcccaaagatggttcacaatagsttttttttttaaactctaactggttagaaaaaaaggaaggcattccttggcccttgcactggcagaattcaacttgatatagcagatgtttgcatcctgggcagagctcatatagtattttaactcatttgggcagaagatattgatgagttgtaaacttccattgtttccttggaaataagcaggttagtttaytcctaaactctctgctcctctctccattctgtctcccaaacactgttttcaagcacccttgctgaggaccacctacacattctctggggccacccaggccctgcacagctgttttgctgcagcagattcactatccgaagtattgtgcctgatccttggcttgttgcagacctgtggaacacccccaggggcctcctgttcygagactkaatgtggcgggccaaactgcagaactgacgaaggagagaggaagtgtggggggcctggctgtggtggtctggttactgttgcacacaacgcctggcagaaagccatggacttggaccaagatgtcctgagtgccctggctgaagtggaacagctctccaagatggtaactcagtggatggcctcagtttttgttatgyatgtttgctttcagctgtggactaaaggatctgaaagggagaaatcaattctaaatgctaactgaaatgaaaagggcatatcacaatcaaatatgaaagttcatgtttctgtgaggtcagagaaagagatggggagattttcttcacagataaagaatttgctttctcctcactcaacacatgctttagagcaagatgtttaaatcttatactggataatttgagatagccatcttacttttctgactccagggttataaatacatccagctgtatgacaaaaactctatactaagcaattgagcatttattcttctaaagtgacacacactttttaagtatttatgtgggcacctgagaaaaagactcaggactattttataggccaggagttaaaaaacaacttgaaaaattttaaatgctagttctatttatatcagaatactgtttaggaatctctatactgaatacttgcagtctgtaagatacaatactttgttgaatgggagaaagttgtttcccagacatatgattccaagtacatagtttttcaacatcatttttgagccatttccaatattctggtctcctttagaaagaatgaaagtcttccctgggtaatttattcttcatatttaggtctctgaagcaaaactgagggcagatgaggcaaaacaaagtgctgaagacattctgttgaagacaaatgctaccaaagaaaaaatggacaagagcaatgaggagctgagaaatctaatcaagcaaatcagaaactttttgacccgtaagaaattttttcattttacttttagacatttgtttctgtgtgattctctgtttacattttagataaaatccatttctgtcagggtactaagtgacatttccaaataagaaaaacgtccgtatattaaatgtttccacttcttaaacttatatatgtgtatcaaataactttctccaatgttacgcagatacagacacacctgatgggatactcaggtagccaatcaaaagtcaaatatttacattgaaaattgaacgtggaatttgttagaaattacgtatagtaatttctaaccttaaagaagtggagtttgttattttggcattgcccccaaagctttgtaattctattatttacaggatattatacctatagttagttaagagtgttgctagtcacagttcaagtgttaccagtaaagatggttttggctgcaaattacagaaaactctcaagtgaaagggacttaatcaaaaaggatgtttattatctcacatcttaataagatatccagtagcaggatagcttcctgggtctgcsacccacatacttttcatctttctactctaccatcttaagcatatcagctttgtcctctagctcctcatggttacaaggtagctgccaaagttccagacatcatataaagattaataatggaagaagagaccacctattccttgcatctttttaaaaaggaggaagtcttccctagaagcctttaagcagtcatccttataaacctcactggccagcaataagtcacatgccaatgcataaatgtcactggaaaatggaaatgcgattacagtaattcacaaactaatatttaatgctgggttgataattttacctgacttagaggcaggtrcctgaaaaaaaatcagtattctgttagcaagaaaaaaggcatggctaataaggagtcaacagtatttgctaaggatatcttaggtaatattttatggaagccatcattcaagtacatattttatttgaataaatcctctggggtccatttttatgttcaatagtttaaaacataagcaaagcttgaaagtaaatgaggatctgacgtatttgaagcttaacttcataaactttttttttcaccatcttccacattttacatttgaaactccttggctttgttgacaacccattattccggttctcctgcttctataattttctccctttctataatttcctgaatctagatcatttgtaggaaatatcaaatctccatatctgcattcacaagtttctgagctattcgtccaacctcaattaaaagatttcattgcctttaagtctcagctttaagctctggccctctatggttttccacaatgttcagattcactctgctatactttcccgtaacatactctgccgttcctgtctccccatctggaattgtcctttcttctttcaaattctattatcccttaaaatctgatcagctcctcatcttccacgaaggtttccctcactacccagcctaaaacaaattctagtagtactcaattgtctgcagttacttttttgtgtgtgtaggtctcatctcccctcaaaatcccagatagattataaactcttaawcaggaagttagtgtctcttggtgtgtaaccccaccatgctagtccatagtagatgaccagtaagtggttgaatgaatgaaccatctattcttttcacctctttttggggacatctttgcttttcacagaggatagtgctgatttggacagcattgaagcagttgctaatgaagtattgaaaatggagatgcctagcaccccacagcagttacagaacttgacagaagatayacgtgaacgagttgaaagcctttctcaagtagaggttattcttcagcatagtgctgctgacattgccagagctgagatgttgttagaagaagctaaaagagcaaggtatctaaagacatggcatctaaggggcttattttgtgtatctatcatggagtaaaaagtatctctttaaccaatgaaacttctaagaaggacctatgcgagtctctctgggtcatttcaggaaggctattctttaaagaaaagaacactgagagtacwtttttcatgttcagcaacaatatactgtctcattattttttactcagcaaaagtgcaacagatgttaaagtcactgcagatatggtaaaggaagctctggaagaagcagaaaaggcccaggtcgcagcagagaaggcaattaaacaagcagatgaagacattcaaggaacccagaacctgytaacttcggtaggcatacacaatcattacatgaatgggaacacacctacatatacacttaccagaaaagtacatttgttatctatgaacagaaattcttacawctcaacattaaaggattcctttaataaatctaaactactccgttagcatggatgctaaaaataagtggagataggttttcaaggaataaaaggactctgattcagacactggaccattacgtcccatctcattttctcccccacaaagtctgagaaagataaaaacttctattcttgggcgggcatggtggctcacgcctgtaattccagcattttgggaggccgaggtgggtgggtcatttgaggtcagtagttcaagaccagcgtggccaacatggcaaaaccccttctctactaaagatacaaaagttagctgggcatagtggtgtgtgcctgtagtcccagctacctgggaggctaaggcaggagaattgcttgaaccggggaggtcgaggttgcaatgagctgagatcacaccactgtactccagtctgggcaacagagactccatctcaaaaaaaaaaaaagcactcctattcattgaggaaacagcatatactctgttcagtagtatgaagtataataattttagaaaactgtcctgatgttataaagcagcttatctggttaagaaggccaatgtctcaagattttggtcatcaaacattttactatatagtagttttggaaactatgggagaacagtcagtctgctttcaatacccaattctagagaaacctaatagagcacttatagctaaacaatctgttctgtttagaatgcatggaaaacttaatgttttttataagraatatactgtgactaccagatattaaaagtactcattacgaatttttcatagggatctagcacyttgctctaaaaatcctctttatctcttaaaagaagtaatgcaaacataattccattaaattcttttgtttctcagaaagttaatgttttcgttccaattttacgagtttttaaaaaatgaagaaaattgatgagttatctaatccctatacaggttctcagaatatactttgaaattaaatgctcccatacccagcattgtcagccttctcaggccaatcctccatgtgtttaaaacctgggaagatgaattttcaacatgcttttcttaccattagttggtaaaaacctgtgttcccctattctattgctgtcagttaaatgaaggccaataattctgtccattttcctccttaaatttcgagtatcaataagactttttcttcaggctatttgttcaagtttagaaaaattatgttttcccaccagactataaatattttgatgtttcgatctctaggtttttccattttctcagtttgctgttaatattttagtgaatattatgtcagtgactgtagaaattattgttttgaaagccaggtgcagcagtgtgtgcctgtagtcccagccacttgggaggtggaggtgagaggatcacttaaggccaagagtttgagactatagtgcactatgatcatgcctgtaaacaaacagtcactgcactccagcctgggaaatatagcaagaccctgtttcttgaaaaaaattgttctgaaaagcaaattagaaaatmattataggtgagatgtggcttgatgatgcaagttaataattggggttctgtttttcaggggccctrgggggcaggaagtgttttaggttagtaacaataagaaacaaagagaacctctaactaaactgtgttcatgaaagcttatcagaaacaattcactcaaactttatcttctaagaattataatttctaagaattttattctaattaaagggtccttaggtttgaaatatttacaaattttagcctatgtcttatactgacccttattaacttcattatagcagtactgttattcagttaattctatgtaattagacccatccttgaagatcattttaaagaaaaattgagtgctcagtgaaattgattcttttgtcatgggcycaactgcttactttggctagcttttaaaagtcaatgtttattgattctactttgaaaggagatcagatgtggatcctcaccagttgcccagatatttttttttccctaaataactttgtgtatttagagtttacagctgtaacgttcccagaccatacatcatctcacaattctatagaaattcaaagaacatccctagtctccatgtcttcagtaattagctgaaatctccactactagagtttaacatttattttcccactcacattaagttggaaatttatgtggaaatccctcttcgcacagctgcttatttgtgaatgttctttagccaaagtttgcaggtgtccttaaaatgctttctcaacacatcatgctccttggggrggtggggttttttgtttttttttactgtcagaaaaaattttacatcaatctcagcttagatcatcagaagtactgaaagaatgaagtgaatatatgaaatgtagcaaagactaaagttagatacttcatgtaacttttcctgaaatattctttttagtaattacttcttttggtctagagcaaaatggcacagcagacttttaaatcttcctccaaacttgtactcatagtaattccatttcttaaactaatgtcttgctggaaaattgacatrcttttagattgagtctgaaacagcagcttctgaggaaaccttgttcaacgcgtcccagcgcatcagcgagttagagaggaatgtggaagaacttaagcggaaagctgcccaaaactccggggaggcagaatatattgaaaaagtagtatatactgtgaagcaaagtgcagaagatgttaagaaggtacgtaaatctttgtaatttcagagctatgttgttaaaggagccaccagtctcctccttgcctgccttagagtaagggacatggacctaacagaaacagaattcatcagaaatatcaaatgacctgttttgcaacagccgtctttagaagtgtggatgggaaagaatatggaaatatctaataagtatgacctatgtcctcaaatccaaatttggacaagagtttagaagaacggaattaacttaggggtagaagtctcaaaacaggctttttttttttttttaaaccaactatattgacaaaaaccagtcatattgaacttttatttctgtgcggtagtcagttaaattcttcatggcatatagtaattatcaggccatttgagaatattttacaagcaggttggaacagagaacaggtagtaggaaaccaaatcttatctctttgagactcattttgaattaactacccctcacctctcattcgaaggcactatattttgcagagaaaaactcacacaacccaaatgtttaatcagaagccatgtaataactgaaacacatgttcagtttctcaataatgcttatttctaaagagaacattaaaaacttggtggcgccggggtggggcttaaaaccattgaatcactggtccccaacttttttggcaccaaggaccagtttcctggaagacaatttttccagactcgggggtggggatggtttcaggatgaaactgttccagctcagatcaggcattagattccataaggagtgcacaacctagatcccttgcatgcacagttcccaataggattcgtgctcctatgagaatctaatgtcaccactgatctgacagaaggtggagctcaggcaataatacttgcctgcccacccagttcctaactggtccgtaggcctgggggcacctgcatttactgacctaatttcagtatttaactccctactattcaaaaattttctggaagttactgtagcttttcgggcattacgtaagagtaactttccctacctctctctaggttgggaaagagaacaaaacaatgagaaaagttcactgccacaatatcagacagctgtcttttctgttttggtttgtgtggtttcctgcagtactgaggacacaaatttctcaagtactctgcttcagggcattttgcataatgacattttatcacaagagaaaggaacaaaatctcttgaaatgaaatttccataaatggctatttgaacagtttctaaaaagaatcatttgcattccaaccccacaccccatttctcttctcctcactcacttcttgcatatgctacaatctcacctttccttcctgtatcttttgtttaatctttttcctctgatttccttataagcaagtcttcacaaatcctaatttagtcaagatccaaagagcctccacttcttcaatatgggcttctctaatgtctaatctacttttgaaaaatctgcrcttctctatgtaatttgcaatacaattatgctacaacttttctatagaaaagtaataatcaggagaatgaggacttagccctaaggatttgctgcaactccagaattttttgaaatgttctttaaaatcakgtcaattttgcattcaattccactgtttgaagataaaattttaaattacttaccagtgaatatccttggtggcccttaatccagaatgcatgccatgattacactattgctcttaaatgtaattactgacactaacattaccacttctttctgtctaaatgtggaactatagactttagatggtgaacttgatgaaaagtataaaaaagtagaaaatttaattgccaaaaaaactgaagagtcagctgatgccagaaggaaagccgaaatgctacaaaatgaagcaaaaactcttttagctcaagcaaatagcaagctgcaactgctcaaaggtgggtcttttcacacaggcttattttttaaattactttaaggcatccatagtttatttaaaagtgaaaaatatattcactttgtcttgagatcatcatagtataaattgctcagactttatatatatatatmtcyccacagatttagaaagaaaatatgaagacaatcaaagatacttagaagataaagctcaagaattagcaagactggaaggagaagtccgttcactcctaaaggatataagccagaaagttgctgtgtatagcacatgcttgtaacagaggagaataaaaaatggctgaggtgamcaaggtaaaacaactacattttaaaaactgacttaatgctcttcaaaataaaacatcacctatttaatgtttttaatcacattttgtatggagttaaataaagtacagtgcttttgtatatattttggtgtacttgttactttcactgattgttgatgaatcccttttttcactgtaaacgtggatttataaacaagtttactgcgtccatgaagaccctaatttatgttgtctataaacaagctattatatttatttgacaggtaaacatcctccaaaactccacacccttgactcccctcctcccaatcacctcccagtgggattcccaggttgaggttaaggaggacaaatatagtctatgctaccatcactatttcaatggttgctgagttgctccagccatcaaaactcctgtaagtaagtattccttgctctaggaatgagaaaaagcaacattttagaaaatcagcaggatgtactagggtttgtagtcattaccacctagaaaaggactagggttactgaggggaaggtttcagttaaatcaggccagagtttatggatactgctcctgccaattgagcaatgctactacagagcacggaatgatgctctaatttctcagcttttgtattgtattttatactacagagcacagaatgatgctctaatttctcagcttttgtattgtattttatgtgattttgcaactaatctaacgaaagtaattgccaggcccatgtcaactttattgcctaactagctgtataaaaggctagcccctatgtgtttttttcacacattcttagagcaagactattctgtggactgcttaacaaccacccacacatccaacacagctgcatctgaagctgggcctggacaacagttatgtaaacagctgtaagttaataactttcctctggcccaaagcaataatttgtcacttttatggtactgttaccaaaacagatatatagaccaatggaacagaacagaggtctcagaaataacaccacacatctacaacaatctgatctttgacaaacctgacacaagcagtagggaaaggattccctatttaataaatggtgttgggaaaactggctagccatatgcagaaagctgaaactggatcccttccttacaccttatacaaacattaactcaagatggattgaagacttaaacgtaagacctaaaaccataaaaaccctaggcaattaccattcaggacataggcatgggcaaagacttcatgactgaaacaccaaaagcaatggcaacaaaagccaaaattgacaaacgggatctaattaaagagcttctgcacagcaaaagaaactatcatcagagtgaacaggcaacctagagaatgggagaaaatttttgcaaagaacttcaaccccatcaaaaagttggtgaaggatatgaacagacacttctcaaaagaagacatgcatgcagccaacaaacatgaaaaaaagctcatcatcactgttcaatagagaaatgcaaatcaaaaccacaatgagataccatctcatgccagttagttagaatgacaatcattaaaaagtcagcaaacaacagatgctggagaggctgtggagaaataggaacacttttacactgttagtgggagtgtaaattagttcaaccattgtggaagacagtgtggcaattcctcaaggatctagaactagaaacaccatttgacccagcaatgctattactgggtatatacccgaaggattataaatcattctactataaagacacatgcacatgtatgtttattgaggcactgttcacaatagcaaagacttggaaccaacccaaatgcccatctatgacagaatggataaagaaaatgtggcacatatacaccatggaatactatgcagccataataaaggatgagttcacatcctttgcagggacatggatgaagctggaaaccatcgttctcagcaaactaacacaaaaatagaaaaccaaacaccacatgttctcacttgtaagtgggaggtgaacaatgaaaacacatggacaaggggatgggggtgggggagggatagcattaagagaaatacctaatgtagatgatgggttgatgggtgcagcaaaccaccatggcacatgtatacctatgtaacaaacctgcatgttctgcacatgtaccccagaacttaattaaaaaaaaaaatcccaataactagcaaaaatggtcataccccatcatctactagagcaattatgtagtattttacttagaacagtagaaacactctccattccttttcagctaaacaactaaagatctcactttgaaattactttttttttttttttgagacggagtttcgctctgtcgccaggctagaatgcagtggcatgatctcagctcaccgcctcctgggttcaagtgattctgcctcagcctcctgagtagttgggattacaggggcctgccaccacacctggctaatttttatatttttagtagagatggggttttaccacattggtcaggttggtctcaaactcctgaccgcaggtgatctgcccgccccggcctcccaaagtgctgggattacaggagtgagccaccgctcccagccagttgaaattactaattttaatcagttcaatgaagtggacaattaatttcactcttcacaagccacaaaaatattgacagcttagtagataacagtaagtgaacacttaaaacttgttttattcctaggactttattccccatacagataaatttgcattctcatactgaatgtaaacacttaaagatggatttaactctacagctagaattccatattaaattatatttcactattccctaactaaaaacttttttttccctgagtaagggatatgttgagatttacataaacagcacttcacatgataccgggatttcaaatttttaaaaagatgcagagttcacttctaataatggcaaagtagcacacagatatcagaccaaccctcctgctgatagcaactgcaaactctgaacaaatatattttagaaaaaactaaaggcactggaaacaactataaacaagtggaaagtagagggaagttggcacttaaaaagtgaacagcactggctcaatgtctcatttttaacgggttctcacttgagggggaaacaaaagccaagttttattggttaaggatcagaaggcagaatatggggcaaccacaacagctggaacataaaggggaaacccccaaaaaacaggaggcacagaaggggcagacttccttctgcccaaactctggttgacccctgaactacacacttgcatgggaaagacttccagcagcatagctaaagctaaaacaactgagaagagatttcagctgctgccacctacaaacaagacagagtgtggagttggtgttcagccaagttaactgcctcctaagacaacaatcaattttctttagaagtatgtaacagaatccagggtcattatgtcactcatgagcatgagacaatctatgctatctataccaaatttcagaactacttaatctgaattattcttaaatttagttacaatatgcaaaagcctacttagcatttagtactttgttacttaagtttcctcaggacatggccattttaaacaccacacatccaattttacagcactctttaaataaacagtcattaacccagacaaggaaaacacagattaaagactcccttatgttgtacttctccaaaagtatatattaaacatttagtaggtgtatctaaaatagatgaaaggatgatgacctttaaaatgccttaatattgtcctataacatgaaaataaagatacattcaggcctagaaaagaaattagaatatacactagaagtagtcataaaaaaaactatgaccatctcaacacgtactcatgataaccagtaaatgaatatttaagacgtttatttcagtatcttcattccccactgtaatacatttgaatgcccacgtatttgagttccgtaaatagactctcttaatttgggtaactatataattacccttcagagttgcagacaacaatggaagctttaaaacctcttcaacacaaatgctacccctaaaatgaaagaatttagaggttaaataaaacaagtgagagaccatttacttacatcagttcggtttatagacatttgaatcatatctgaatgactgacttgtttccaatgtgaaaaccaaattaaaaataacttgatcactgtgcttcaaacacaactgttcacatatcaaattctagctccagccatgtaaaattcaacttttctgtatcagagaaaaaagctatttaaattcaggggcattgaatctttcatgaacagcatgaaaatatgagttgacggagatattccaggatgctacaataagtagctttttgtcttacacattagtgcactgaaacaaaatactaaatttatgtaaaatatagatataagagtattccattttgtccaaacctattaaataccttccaaaagtttcataattcagtcctagaaattcttggagctgtgagaatatcctgttcaggaatgtgacttctacaaaagctcccaggaaatttmagaaaaaaahatatataatcttctaattcaaaagttgattgatttgccaaatgacgcagcaagakttgcttctcyaaaagcttctgataaggtctgcaagggaagaaatttaaaattaaaatccaaatatttgtgggtcagaagaaaatttaggcaaccatcaattctatatgttgttaataattaccrgatgtgcatgacagactctagctatatcttcacaggatgckccatattccaaagcaagagcagcttcatttaccatttctccagcaccctttaaaataacaagccaagtaaatttgcttccaaggcaaaaactacatgctaataggatagcaattgttgaggggaagcttttagatcttaaaaacgccttaaatctgtttctttatcagttgaagaaaagtcaggaaaagcttaatagaaaaggtgacacagaagagcttgggctctggagccaaagggccttcaattcatatctaccacttactaccttaaccattcattggttctttgtgcttcattcagtttcttcacctcaaaaataacagcacctatttcaaaaagctgatgtaaaaataacaaaatgtatactaaagtgacacagcactcaaatattctattctcattattgttacatcagatacaagagatatctacaagaaagatacatactttaggctcagtggtaggaaaggcttcccttaggaggtaacatttgagctgagacctgaataataaggagccagccattcaaagatctggaggcagaacagtctaagcagagggtatcttaagcacaaaggccctaaaatgcaaatatttggtctgttgtgaaaatgagagaaggcccatgtgacatggcattaatgagtaaaagagagcagaaaaagaagaggtcagagaagtaggcacaaacagattcagtgaggccttggatgtaacaatctgaagttgaaaagcaccactggaggattttaaggggcataatctggtgtatgttttaaagagagaatcttggctgcaggacaaagtagatgatacagtgggcaagactgtgagagtgctgctggtatccttctagaaatgatgcacagagagccatattcaaagttttgctggaaatgagcaacctcagactaacaccaggtggtttataattaataaacagcaatgctttctagaaatcttaatgggatttctctggttttacaatactcactggtccaagaatatgtgctcccartactctgtctgtcgatttctgcccaaggatcttcaccatgccatctgtgtcagcatttgtcttagctctgctgttagcagcaaatgggaatttcccaactttgtactcaataccctgtgacagtcagaaaaaaagaatctacgtaactgccagaaaagttctttccaatttgtaaaatcatctaccatttgttcagaaaataaatcccaagaagggaattgttcgcaaagcacatagaaggaaaggaaagaccagaagactggttaatgaactatatctcaggcacgaatacaagcaaatacaaatgt

SEQ ID NO: 12198 - DNA, 172943 bp, Homo sapiens
  misc_feature (1)...(172943): n = A,T,C or G, or insertion/deletion polymorphism (see Tables 1-2)
tcaatcaggggtaattcctcaacagctgcctccacagttcctgtggcagcaggaagagtgtagggtcaacctctcctcacactgggaggagagttgggcctttagtctcagctgaaagctccacccatgccatccccaagccaaactgtcttttcagcctgggaaaggtggaggagaggcttttcttctcatgggtagtgatttcaccccagatagctcctgcaccagttagctcctcaacagggcacacccaagaactgttcattccagattcaacctccagaaaactccagagacacctcgattgatagacattgttacatgtggaacttcacgtctgcccaacactctcagactcagtattgtctatacttcaagcacaatataattctcatctcctgtcttgatcatggggcactttaagggtaatagattttaatacatatacacaaacactcatgcattttctgaataaatacattttacttatttcagactttgaggattacatttcattacagaatcatcttgcaaaagtcacgctcagtaaactggtgtctctaatggtcccagaagtgtgtgatttcagaattatattctttctccatttgaaagggcattattcagagtacaatgacctgctactggcttgaacagtctttgagagaaaaagacagtctctcttctatcttttcctattatgtatgaaagaattgcctgtcctcccaaggccaagggacaaatgccatagcatagcagtgtgggatgactgtgaaaatattgacatttaacaataggtgccaaccacaaactgtgacaactcagcagctgggccaacccaggacaggttacagatgcagccaaaagaagctgtgcccaactagttcccagatgaagaggtttctgctgtggggcaagtcctctgacccccaccccaggcaactagaggacagcactgacttatttgtgacttactgacaaccagagataatcgctcatatacagggagatgggctgtcctctgtaacctgcccttttctctactcatacaatttccccacaacccctagtgtggaggacatctgctttcacaggaaactgaatgatgcctaggtaagagctcatagacatcaatctactgccattgcctcccggtctcctctactttccccgagctaccttgacttcaaggtaatccaccaagtcaagtagaatttgcctgtttctcaaatgctctccttccccctgttccctattttctgatatttccatgtatcatcatcagttagggtcaaatcaggaaaacataactcataccaggtaaggggaactaattaaattggtattggaaaatcaaacggatgattagcaagagcagggagctgctaccacccctaggatgaggagggagaaagaatacttgagaaatagaagattcctaggaatggagggaaaggaaaatagagtcctaggtatagatggagagattggccttaggtggaaagagacagatcctctatgaaaacaggagggaataagagaagatatatgcagaaacaggaagtttaaggtccaataattttgctaaatccttttgatcaacgttaaacagattttacttcatatagctttcttctgctgatgctttttttttaaaagacagcatcttggctgggcgcagtggctcacgcctgtaatcccagcactttgggaggccaaggtgggtggatcacgaggtcaggagatcgagaccatcctggctaacattggtgaaaccccatctctactaaaaatacaaaaaattagccgggcgtggtggtgggcacctgtagtcccagctactcgggaggctgagggaggagaatggcatgaacccgggaagtggagcttgcagtgagccaagattgcggcactgcactccagcctgggtgacagagcgagactccatctcaaaaaaaaaaaaaaaaaaaaaaaaaaaaagacagcatctcgctctgttgcccaggctggagtgcagtaacgtgatcttggctcactgcagccttgaattttgggctcaggtgatcctcccacttcagcctcctgagtagctgggactataggtgcgcaccaccatgcccaaccaacattttaatttttgtagagaccaggtctctacaagcccaggctggccttgaacttctgggctcaggtgatcctcccacctgggcctccaaaagtgctgggattataggcatgagccactgcacctgccccttatagagttcttaactgcttccttcagaatctttagtatactaacatatattggaaatcattcagagtcttcccaatcataactgaccacagaaccccttttcatgaatcacctaggggtcttgttttctggaagacattccttgaaaaacactgacttacccaatatatgcctggactttcctagctattaaatggagacaataagatcttatctgactataattacttcattgtgatgttgtaaacataagtttgaaaaacatatacatttcattaataagttctcagtgtagagattcaagtaaggaaaagcaatttccatcaacatttatagtctaggtggtcatctagaacagactgttatctgggaaacctccaagggtggcatttaatcaccttctgaatttaccaaagcttgcagactcagaagctgtttcctcaaaacactgacagcagacatctctcagaagtaagtgcacatggaccagcatctccagatagagacataaactaaaatttattaatttacaacaatgagagctacctctgtcacattatttatggtagccttactcatgcattcaggagtatttattgattgtcaattacatgctgggccatgaaatgggtataagatgcaggcagcactaatcagtgtcctccagggatgcgatacacaaatctcttcctgctggcattcccctcccatcaccccccaggaccaaaccagtgatggaacggggcagtgaggacctgacctgagctgcccgagctgcatgatagcatgtgactcaggctgctagggaaattaaaggtggtgtaaagttctgtctgcagtaagagaagaaaaggtgaatataccaaaaaaaagttgtgacaaactggtttgggaactgaatggagagagagtctggttgaccatgagtccagagttcaagtctctgagaccctagattcttgggctcttccttccaccctctaaactagcccaggatccttcccagttatctgaatcaaaaaaatctctttctgcgtaagctggttttactcaggtttctgtcgtttgtaactgacaaagtcccaacttctatacctgacatgcaacttgtttggatcaagcaaatttgaagtcatttagagcagctggtatttcctcatgatgcgtgaacctcaacaaagaagatgaaagagacaggttaggcagggaggcttttaagtctaacgtctgcaaaatctgagaaaaaggactaaagaatggcattttcctttgtggctttataaagcacagtgttgcccctttacaaatagaagaataaggctgggcacgttggctcatgcctgtaaacccagcactttgggagactgaggcagggggatcacctgaggtcaggagttcaagaccagcctggtcaacatggtgaaaccccatctctactaaaaaatacaaaaattagctgggcatggtggcgggtgcctataatcccagctacttgggaggctgaggcagggagaattgcttgaacccaggaggcagaggttgcagtgagccaagatcgtgccactgcactccagactgggcgacagagcgagactccgtttcaaaaataaaacaaataagaaggatagaattgtgccagtcttttaaacgtttgattgcagaaccagttagtaccagcctgccagcctgtttcctcagtgtctgtccacacctgggtttaccatgttctcagctgcgccccagcctcccacccccaggcccaatcatagcctgttaagaaagcatttgactagctcttacctcacaagctatgcatcagcatggattactctattctagttgcagtgacccagttctgataattgagctctagtctcaacaggatcacatccagcatccccatgtgttccaattacttggcttctgccttctctttatttctaaattcttattctcatactctgcctagtacctcattctgcctcctcctttatggactatagatttgctccttccctcaggccaggggccagcatctagccaccctctttccaatctccctggattgtgctcatcctgaagtcctatctttctaccatgcttatttatttattattttttttttgatacggagtcttgctctgtcgcccaggctagagtgcaatggcatgttctcggctcactgcaacctccgcctcctgggttcaagcaattctcctgcctcagcctccctagtagctgggattataggcatgcgtcaccacacccagataaattttgtatttttagtagagacagggtttcaccatattggtcaagctggtcccgaactcctgacctcatgattcgcccacttcagcctcccaaagtgctgggattacggtcgtgagccaccatacccagcctaaccatgcttatttttaacagtttcaggaggctcaattaatgaccttctactttcaagttctgaaccaattgagagagaaacacagaagtcaaacagatggcgaacaaagtaacagttttagaactgacaagaattatatggaaggccaggcgcagtggttcacacctgtaatcccagcactttgggaggctgaggtgggagaatcacttgggctcagtaattcaagaccagcctgggcaacatgacaaaaccccatctctacaaaaaatacaaaaatcagccgggcatggtggcatgcacctgtaatcccagctacttgggggctgaggcaggaggatcacttgaacctgggagatcaaggctgcagtgagccgagatcataccactgcacgccagcctgggtaacaaagtgagaccctgtctcaaaaaaataaaaattaaaaaataaataaataagtaagaatgatgtgggagtaagcagcttgttgtatggtccatatatttgctagtaatcttcattccagacttaaactaaccatgcagaagatgtggaggcagagtgtgctgtcccagtatctgtgtcctgatgatggtcctcgggcttaggctaagcagcaggctgccagcactatgtccaaatcacccagcccccagtgacaactgcccttgtggtcatctaatgccttagttgggtaaccccagaagcagatgctgagagtgcaaggagttcatttgagagacaaagaaggaggggaattgagaaagtataggaaaggcagccaaataaaggaggcatgggcattacccagccaatcaccatgaggacaaatggagctcaatcatgataggaaactctgggagccagtgtagactcgtgctcaggtatcccacccaaggaatgaggagctttggtatttatacactaacttccattaatcattagctgaagtctactgggagctgtggggaggaacagtaattcctggacatctgcagcttgccacacaggtgagcaaagtgggcttcagtgaccagagaacagcccttagccaaagttgcaggtgtcagcagttggaagttgggctggtgtgccctgaggggttatgtggtttagcctctggattctatctttgacctcaaggagaagaatctgaatgagaagctcctctgcttcctgctcaagggtgactatgactcaggctcatagttacttctcctgcacccccaaccccctcctgcttaccccccaggaccaaaccagtgatggaacagggcagtgaggacctgacctgagctgaaccagcagctgttgctctggtagcagctactgggaggccatggctatgaaatctgaggacttccctccagacaagaagggactgagggaagtcctgatcaaaggactgagaaggaaggtaaagattaggcatttcccatagtaagttgtgaagcaaaaggaaatatttctaaagtagcaataatagacagggcgcagtggctcaagcctgtaatcccagcactttggaaggcaaagtgggaggatcagttgaacccaggagtttgagaccagcctgggcaacaaagcgagaccccatctctacaaaaaataaaaaaattagatggccgtgatggtgcacacttgtagtcccagctacttggaaggctgaggcaagaggatcacttgagcccaggaggtcaaggttgcacctatgattgcatcactgcactctagcctgggcaacagagcaagaccctgtctcaaaaaaataaaaataaatactattgatagcacaataaggtgactatagtcaataataacttaattgtatattttaagactataattggattgtttgtaactcaaaggataaatgcttgagggaatggataccccattccccatgatgtgcttatttcacatcgcacgcctgtatcaaaacatctcatgtaccccataaatatatacagctacgatgtacccacaaaaattttttgaagtcataaaaaaataaataaaattaaaataaagtagcaataaccaaaaacaaattgtggtcaaccatgtaagaggaaagactgaattaccttctattctctttctagaagatggcgttacaaagttggtgtcatatgaagagataaccaaagagtagacagacataaaacataggaaaacatattatagaagtgagatgggcaaggtggttggatttcaaaccgtgccagattacaggccaccccgggcacagtggttcacgcctgtaatcccagcactttgggaggccaaggcaagtagaccacttgagtccaggagtttgagaccaccctgggcaacatggtgagacgccccccctctacaaaaaatacaaaaaattagcctggtgtggtggtacgtgtctgtggttctagctactcgggaggctgaggcaggagaatcgcttgagcctgggatagggaggttgcagcgatctggattctgagactgcaccactgcactccagcctgggtgacagagtaagaccttgactcaaaaaaaaaaaaaaaaaaaagtgagatgaacgtagtgaaaaagtgaaaatataaaccctcttctttcttttttgtatgacacagtggctggatgagacagttccagtggcagcttcaagttctgtccagagtcagacctctgtccccaccagttctctttgacattcaggcacttttttctagttcttactcattgcaccaagtccctttctccctttgagcctgctctctgagcctccattgtctgcaatctgagcatcactggagtgactcacctatcagatatgtttatatagttggtatgtgtctgaactctagggattgttaagaaataaaggtgctccttaggagcaatctcaggagattctaaattcccaacgtggattagcaaaaaaggagtgttatctaacctctctgccaatagcattgcatgcagctcatgtctacttacataccatgggtagtagtcacaattggtactctctccagatacctttacctgatggtgagtttggggctgctatgactgatgtggctaacgactttacctatgagcttctgtagtcactgagcacttggcatgtgactaaagaactgagctttaaattttaactccttttaattaatttaaatttaaatagctacatgtggctaatggctgccatactgaacaatacagctccagaaccgcccatggatcagtccaaagctagactttgcatgcaaccacatccttgctcatctctttcctttttccttctctatttcacctcctgctttactaatctcctgagagcatgacctcaataaatcatgtgcactcaaatccctgtctcagactcaacttctagggaacccacctgagacactgtgttacaattatttaacagtgaattacagaaagcttaaaccttgaatcaaaagtgcacataaaaattcaatgccagtcagaatgtttttagcagaaggtataaaagagtcccaagcccaactgtcttaaacaaagaaatgtgttattctgcacctacgagtccaagaataggacagctccagggttgggtaattccatggctcaatgacactttcaagaaccaagttctttccatcttgctgctctgtcattctgctgggcaggcttcatttgggggctagctttccccttcttgttgcaaggtgactgccctagtgccagccttcatatctggatacaaccatactcagaataagaaaagaccatcttttcttgtatgtcttttattaggagcaagaaaatctttcccagaaaccccctgcagatttatcctccatttactggtcagagctgcatcgcatggccttgtctaaaccagtccctgcaaagggaaatgggaagaccatgattgcctttgaacaatcaggatctactccctgggtctgtggccagcctctcctgaagcacatggttgagcagagaagggtgggtacctaaacacaacataccatctgttgtaggggttgggaagctggataaaatgagtgtttggtaaccacagtatcggctggtcacagtttctcatgcctgtaatcccagcactttgggaggctaaggcgggcggattgcttgaacccaggagttcaagaccatcctgggcagtatggtaaaacctcacctctattttataaaaaaagaaaattaaaaaaaaattaaaagataaccacagtatcaattacacgtttctttaggccagcttgtacaatgtgttctttgaaccacctacccgaagatcatttagggggcttgttaacatgcagattctgaggcccaaagcattgtctgatacatgtcaggagcttaaaagatacttgttggtgaaatactttctgggaagccaaaaataaaaataaaaataaaaataaaagagatttttcggaaggaaggaagggaaggaaagagagagaccttttgagttagaatcacctggccaggcacattggctcatgcctgtaatcctagcacttgggaggccaaggtgagcagatcccttgaggtcaggggttcgagaccagcctggccaatatggcgaaaccctatctctactaaaagtataaaaaaattagctgggtgtgggtgcacgcctgtaatccagctactcaggaggctgatgaaagagaattgcttgaacccaggaggcagaggttgcagtgagccaagatcacgctcctgcactctagcctgagactytgtctcaaaaaaaaaaaaaaaaaaaaaaaagaatcacctgcagatggtttttctactcagtaatgctggagaaccactcacttaagctgaaaactaaaaattcaccttcagtcccttcattaccagtctcttggcagaagggatgaagaatgtgatcatgttgccacacgtatgctgctttgctctaaaactctcagtgatgtcaagatgacaagggtgcttatcagttgtacttaacatacattatttatatggctttcagctttacttgctgaatccaggattcctgttacagcacctcatgaaaaataaatgaatgtgataatggcttccactttgtggagtaatatattgaaaaaccatctaagaagtttgtgaaaagcagcatctgggatcatttttttttaatgcaataaaagatcttggaggtgattttggcatataaaaagcagctgtcaccaacaggaaagcctagctgtttatcttctggactctaaatggagtctgatagaatgctcactctccagttaactaacattaattgccaggggaaagggagcttgagaagggaggaactagctttttttgttttgttttgttttgttttgaggcagagtctcactctgtcaccgaggttggagtacaggggtgccatctcgtctcaccgcaacttctgcctcctgggttcaagtgattctcatgcctcagcctcccaagtagctgggattacagccatgtgctaacatgtccagctaattttttgtatttatagtatcatgggattctttttttttctttttttctttttttttttttttttgagacggagtctcactctgtcccccaggctggagtgcaatggcacgatcttggctcactgcaacctcctgggttcaagagattctcctgcctcagtagctgggattacaggcgcatgccaccacacctggctaatttttgtatctgcagtagagatggggtttcaccatattggtcaggctggtctcgacctcctgtcttcgtgatccacttgcctcggcctcccaatgtgctgggattacaggcgtgagtcaccacacccggcctgtatcatgggattcttggggtgtcacttcaccagctggaaacttctgaggccagtggctttttttgcctgagttttgctcaggcccactgggcttattctggctgctcagcctggcaggctgtactcatattgcactattggcctggagcccactgcctgccaatggcaagccaggcatggagcagcaaggggtgtgtgagcaactgtagggtctggccattgcgcacaatcaggcacaccagctatggcagagtgggcagctccaggtgctggcatgggtcccagctccctgggaggctgcagctgggccaggcatactgcaagcagcttccatggctggcaccagggaacacagtggtgccctgaagcttggagatgccaggaaccccagagttccaaagagggtgtcacagccctggctcagggagctcctaggtctgggctccccaatgggccacagctcttctctccctctctcttctctccttcttgtcacctgcaatgtggcaagcaagaggcatgtttcagccctgtttgtgttacagctcttttagccctgccatttggtgggtcccaagttcttgtcctgtgtccagaaagaatgaggtatgcagacaaatggagggtgagcaaggcaaaaaggagctttattgagtgacagtatagctcagaggagaccggcattgggtagctcctctccacaggcaagatgtcctgatgagcattcagctcacagcagagaggagaacctggagtgggtagctcctctctgcagctagtcgtcccattgtatcttcagctctcagccaacaggagtccctggggtcggtagctcctctccaccactggtagtcctgtcatctccccaagtctgcctgagtctggggtttttatgggcttcagagcagaggacgtgcatgctgattggtccatgggcagccatgggcaggcccagraaaagcaccacaagtttccactctggtccatgggaccaacagcctggccatcaggcttcaggctctccccagcttgaaggtggagcttcactggagacctgccctcttccgcccaggagcctctctgcctcttgctgcagctcatggcatgccaggctgtttgtgcggaagggcgcctgcagaccagcaatgagctgccctcagcccccacctcagcctccctctcgtactgatcagtgcccaaagtccagagggggccaaggcagcagggggctgctgtgtcacaacctggctgggctgtgacagcayccaggcttgaccccaaccttgctccaagatcggagtgggtgccaggagcagagagagtccaggaagtgggaacagacacctctgagtctgcaggggcaggggggcccttcctggccccagagagtgcagagatgcctgggtctgcagctgcagtttgggcagctgyggctgcgcccaggagggtggggctcttgcctgcttcctgcagagacaagaacttaacttttcactgtgactttttgtaacctgaatgctttggcctagttaaaagataattatctattttaaatgtagacagatatagtgactctaaaatcaagacaggttagttaagccatcccagtatgaaattcgccttgtgcctgcatttgggggagtaaattccaaaacaggctgttcttcagcactggaatctttccttgatatcataactgcaattcgtttaagttgctttgtaaagagaatccaatcatgtagagacttattgaacttagtgggcagggtaacaaatgagagaacacttgtcatatgtaaagctccatgcctctaactaggaaagaaaaaaatctactttgtggttcagaggtgacaaatgcaataagtttctaatgtggtttccactatgcagtcttactgctctcatgatttttaggtctttggtctgggaggatagggatgggaggacggaataattagatgattctccactccagaatagatgctgcaagttggtgtgtcccaaatgtcagtgggacatacatatctctggggktacataaggggattttaggtgctccttggcatttcctaagtatgatctgcctttcatggtgacccttttcctctactgccctttaggggaaagggcttgccagttctggacaaggccagcagagagaaacatgcttgcaggactactcagaatggtggcttcttctgctaatggaggcctggtgagaaaagactgtctcaacacctcagtcagggtcagmggaggagtgaccttccctgccccagggccagttcgatgtgtgagccttgragctgatggagggagggagaaggcatcatgctacctgcctcctctgggtctgatgctgcaagtgatggtgcagttggatatgtggaaaatgttatcctagatgatgtataattctctgcaaattataaagcttaaggtaatcatataccactctacaactcatttaaatgagttgaatattggttgaatacatttctttttctctttttttttttgagacagagttttgctctgtcacccaggctggagtgcagtggcacgatctcagctcactgtaacctccgcctcctgggttcaagcgattctcctgcctcagcctcccaagtagctgggactacaggcatgtgccaccactcctggctaatttttgtatttttagtagagacagggtttcattatgttggccaggctggtctcaaactcctgacttcaggtgatccatccgcctcagtctcccaaagtgctgcgattacaggcgtgagccaccgcgtctggccagaatacatttcttaaattattttcagataccttcccagaacctgtcaagttaygagaaggctcagggctactgagctgatagtctcaagttttctatattggtcacataacattaactacttaaccacctaggttccgggctgtctacttatttcagactcatgtttctgaaataaacatggctctctttctatggccctggcctcaggcttgctgctggccattttcaaccaaagttccctctgtagtgctgttctgcggacagcaacagaacagatatcatcaggcaggggcagtgacagccagatattaagagatgaccagccctggctgggcgctgtggctcacacctggaatcctaacattttgggaggccaaggcaggtggatcacctgaggtcaggagttcgagaccagcctggccaacatggtgaaacaccatccctactaaaaatacaaaaattagccagatgtggtggcatgcacctgtagtcccagctgctcagaaggctgaggcaggagaattgcttgaacctggaaggcggaggttgcagtgagctgagattgtgtcactgcactccagcctaggcaagagaacgaggctccatcttaaaaaacaaacaaacaaacaaacaaacaaacagagatgaccagcccaaaggtaatgaacagacaagggagttgaaagttaccaaagagacacacggatcaagtctgcagaagacagagcgtagagtcctggattagatgatagaatccagattcaatgagggctcagttagctagaatgtgagtccaaactgacaagaggaaaatttaaaggaatacaattttacctgcttttgcttttggtatcaccatgccataggcattgatggaagacacttggcctgggagcaattttatgtgaaaaatatcttggggtttcgatcagacaacccaaatgtaagcctggactgttaatacaggactaaggagaatgggatataatgaatctcttgaactcttttttgtttttttttccagacagggtctcactctgttacccaggctggagtgcagtggcccgatcttggctcactgcagccttgacttcccaggctcaagggatctgcctgcctcggcctcccaaagtgctgggattataagcatgagccactgtgctcggcctggattccttgaatactacacttcagactacacctgggatatttgggtcctggtctgactataatgactgagatgagatatgagcagaaggtatacagatcctctttcctggtcacccatttcccacatgctgttgagcgtcagctgctaaccctcctgagaactgcccttgcccaaatgggaaccacttcactcaggaaggtttcctcgaacacccctcacccccagagccaatgactgagtgtcacagtatacaagactgaaccccttgcctcaaggtgagactcactctgtagcaccactcaggatccagagctccccgtggcatcaggctgggctggtctctggctaaactgcatccttgcttagctccgccctcttgcccatcctgtttccctggcttccctacaggtttcccctgtggccactccccagtaaatcacttgcaccagcatccctgtctcagatcctggatgatgaatgaaggctctgggaatcattcagggagagataaagaagctaaaatatttaggaaaaaagatttagggaaatatgataagcagctgccttcaattttttttttttttttagaattagagggctgggtgcagtggctcacaccagtaatcccaacactttgggagaccaaggcaggaggattgcttgagcccaggagtttaagaccagtttgggcaacatagctagaccctctctctacaaaaaataattttaaaaatcagccaggcaggacaggtatggtggcttacatctgcaatcccagcactttggaagactgaggcagatggattacttaaggtcaggagttcaagaatagcctgggcaacatggcgaaacctcatctctactaaaaatacgaaaattagccagcgtgttggtgcacgcttgtaatcgcagctgcttgggaagctgagacaggagaatcacttgaacctgggagctggaggttgcagtgagccaatattgtgccactgtactctagcctgggtgacagagtgagactctgtctcaaaaataataataataataataaattagccaggcgtggtggcacacacccatggtcctaactacttgagaggctagctaggagctagcccaggagtttgaagctgcagtgaactatgatcacgccattgcactccagcctaggcaacagaccaagatcctgtccccacccccccccaaaaaaaattagaaagtagaaaaagaattgtatagaaatggaataaaagcagaatttgactcagtttcagaaagaactttctaataagcaaagctttacaccataggtatagcctgtcttgtagaataattggaaacctgtcatcggaaatatttacacagaatccagaggaccttcctacatcatctggtgagtcactggactgaccaaaggcacactgtgaatgttattactccaagtggccacaagatggcagcagcagagaacgtcccacaggtgattaagtagaaaattctagtttccagaattttttttttttttttttttttgagacagagtctcactctgttgcccaggctggagtgcagtggcacagcctcggctcactgcaacctccacctcctgggttcaagcgattctcctgcctcagcctcccgagtggctgggattacaggcgcccacgaccatgccccgctaatttttgtatttttagtagagatggggtttcactatgttggccaggctggcctcgaactcctggcctcaggtgatccacccgcctcagcttcccaaagtgctgggattacaggcatgagccactacgcccagccgtttccacaaatttgattccaaactctaaccatgatgataggtgttatgtccattattataagcccttatagatttatgatacacaaaactgagaaagtaaaaacatttcccccaaatttgtatcttactattagaaaaaaaggaaactgaaggccgggtgaggtggatcatgcctgtaatcccatcactttgggaggctgaggcaggtggatcacctgaggtcaggagttccagaccagcctgggcaacatggcaaaaccgtctctctactaaaaatacaaaaattagccaggcatggtggtgcacacctgtaatcccagctactcagggggctgaggcaggaaaatcgcttgaacccaggaggcggaggttgcagtgagccaatattataccactgcacttgggcaacagagcaagactctgtctcaaaaaaaaaaaaaaaaaaaaaaagaatctcagaggtagaaagaggtaagccctgatcagtgaggtttatcctgattcararaaaatgtgcttcttacattctgatcatgatgctacttccatctgactgcacaatttccaggcccaatcattgtgtaccttccaagaragggagtctgtatttgaaatagcctcaataatgaggccacacattaggctcagcctatgttggcttatggttctcacagaaaaaattatccacactgctagtcttcttcctgcaccaacctcaaagtctacagaaagatgtcccagcactgggagcttgaataacacctctactggggaaccgaaatataccagtgattcaatgaagcagattaatatcagagttctgtttgcaaccctgaggccagtcaatcctaccagcccttgcctccatctgtggtagccagcctccaagatggccccctatgatcttttcctcctgatatctatgcccttgtatcatccccatcacactgaatcatggctagtctgtgtgaatgacaagatatgtagaagtaatggtgcatttcttctaagactaggccattaaagacacttrcagcttcttctgccattctctcttggatcattcactgtggaggaaaccagctgccatattgtgaggacactcaagcagccctatggagaggtcctcatggggaagaactgaggcttcctgccaatggccagcagtttgccaaccacatgaggtcctctagccccattcaagccttcagatggccacagccccaagtaacatcataagagaccccaggtctaaactgcccagatctgcttctcctgaattcctgacgcactgaatctgagttaatgtttatttttgttttaagctactatgttgttttgttttgtttgtttttgagacagggtcttgctccaggctagagtgcagtggcacagtctcggctcactgcaacctccacctcctgggttcaagtgattctcatgcctcagcctcccagtgagctgggattacaggcacttgtcaccacacacagctaaattttttgtatttttaatagagatgtggttttgctatgttggccaggctggtcttgaactcctgccctcaagtcatctatctgcctcggcctcccaaagtactgggatttacaggtgtgagccactgggcccggcttaagctactaagttttaaagtaatttgatatgcagcaataggtaactaatacaacacccaaaatgccaccatccctgaccatatacactctcttctcactttcctctctatactctggccactctccttactattctggttaagtaataataacctgctaactttgaaacttaatagatattttccagaccttgcattactgcatctctctgcataatttttacgatgggaagaatcttcttgaaaattcctattctctgacttccttgacactgttctgacctggctctcctgattttctcattcaggtcttcctgtctgaatgagaaaatcattcaggttttctcctgaattgttctcctgaatgattttttcattcacgtctttctccttcaaagatgctcctyttccacatgctacctaaaatgttggccttgcatcaaattcgattcctgttctctccttttgaccctgaaccaactccttgggttatcttgctgttcccctagctccaatgaccatcacttcgaagatgaccaccaaatccatctctccagcccacattgcactcctgaacctcatacccttaaatccacctacccacaggcagtggtgtgctggagcctgctcacaccaacttgtgagagccaacagtgcacatctcttctcaactctatatttagcaatgccacattggcagcttgaataccaacggtgggagtgttgatgttgtggaattcaacaaatgctgcaaatcggaactttttccactgagagccagttgataaacatttaccagcacaccactgctcttaccagatgcttctgccttctgtgtcccataaatacctcaattcaacatgtcccaagcatgtcccaaaatgtattttctcattcattcaaaaatactggctgagcgtgttggctcacgcctgtaatcccaacactttaggaggctgaggcaggtgaatcacctgaggtcaggacttcaagaccagcctggccaacacggtgaaatcttgtctctacaaaaatacaaaaatcagccgggcatgaaggcaggtgcctgtaatccaagatatttgggaggctgaggcaggaaaattgcttgaatccgggaggcagaggttgcagtgagctgaggtggtgccattgcactccagcctgggcaacagagcaagactctgtctcaaaaaataaaaaattataactgttttttcaagttctgcgtgaaggataaatattctctgccttcaataaacttattctctgttggaggaggcagaaaggttcaacaggcaatctcaatagcatagtaaatgctgtctcatgcgtccttgcgaagagaccaccaaacaggctttgtgtgagcaacaaggctgtttatttcacctgggtacaggtgggctgagtcagaaaaaagagtcatcaaagggcgctgggattatcattagttcttataggtttgggataggcatacaaagtaccttcttaagggcgggggagaatatatcttctcagttagggtagggcagatgacaatggtggaatgtcatcagttaaggctatttttacttcttttgtggatcttcatttgcttcaggccatctggatgtataaatgcaggtcacaggggatatgatggcttagcttgggttcagaggcctgacattcctgtcttcatgtattaataagaaaaacaaaacaaaatagtggtgaagtgttggtgtggcaaaaatttttggggtggtatggagagataatgggcaatgtttctcagggctgctccaagtgggattggggtggtgtgagaacctagagtgggagagattaaactgaagaaatattttggggtaaggggtgatattgtggagttgttagaaggagcatttgtcatatagaattattggtgatggcctgaatgtggttttgtatgaattgagaaactaaatgacagacacaacttctgaataagagaaggagaaaaacaagtattaaaggactaagaattgggagaacccaggacatccaattagagagtgcccaagggggttcagcataattatattcttagttgacgagttttggggctctatccttgagtttttttatgttgtcatataccaggccagattgattaaggtaaaaacaacactcttcatttaaaaatatacagagtcctcccttttcagcagtgagtaaattgaggccttggtgattttggaggaaagagaaatgcaaagccagcaattgtttgttaaagaaggattagaaatagctaggagagagtgagtgaaattgatagtgtggtggagatagctggggagaggtagagggtggcaataagaatgggaacaagaataagagtgagtataaaagtaaagaataggacttcatcagggtgaaagtgttggaatgtgtcctgtcagcaaagatcatctatccactccaagagggagtcaagagtggaggactggggatagatattcacgatggaaaggaaatgagaggtttgaagaggcagactaacggcttgtaacctaccgtggaagaggttatgaaatgacaacagaatagaatgggcatgtgaggctggaaggagatattttccttggtccaagaacaatttgccttgtgcgggaagagattgataggtggaaacttcagtaggagagtaaataggagtgaccaattagaaggagaaaaactggccatgagggacagaagttggaacactaggtgcttctttagctaccttatcagcataagcgttgccctgagcaatgggatctgatgtcttttagtggcccttgcagtgtatgactccagctttcttgggaagtaaagcggccttgagaagagtttttattaaagaggcattaatgatggaggacccttgcatagtgaggaaacctctttcagcccatataacagcatggtggtgcaggatatggaaggcatatttacagtctgtataaatattgatgcataattcctttgcaagagtgagtgttcgagttaaggcaatgaatttggcttgctgagaggtagtggaggagggcagagtggtagcctcagtgatagatatggaagatactatagcatagcctgcctttgctggtgagtggcggttaggcctggtggaactgccatcaataaaccaagtgtgatcagggtgaggaacatgaaagaaggaaatacggggaaatggagtgaatgtcaggtggatcagagagatacagtcatgggggtgggggccagccaaaaagagtaaggtcaagttgtttggacagaaaggctacagggtgcagtcccagctcttgtgtaagaattttgactgcacagccctgtactttggctgtgtgtaatgaaaagggttgggatgagttagggagagctagtgtgggggcagcttctagggctgtttttaaggaacagaaagaggagtggtgaaaggatttaggatctatggggtcagctaggtttggttttgtgagtttatataatggttttattaggatggcaaaaccaggtatctaaaggtgaaagtatccaaccatgcctaggaaggaaaggagttgttgttttgtagaaggggttggggtttgggagattagccagacacaatcagcagggagagcacgtgtgttttcatgaagaactatgtcgagataggtaatggatgaggaagaaatttgggcttgactgaagtaatgggggctgtccgtgaagccttgtggcagtacagcccaggtaatttgctgagcctgatgggtgtcagggtcagtccaagtgaaagcaaagagaggctgrgatgaagggtgcaaggaatagtaaagaaagcatgtttgagatccagaacagaataatgggttatggaggggttgtggagggaggtactgaggataggagagtatatggctttggcaccatggggtggataggcaagacaatttggttgataaacgcagatcctgaactaacctgtgagacttgtccagtttttggacaggtaaaatgggggaattgtaaggagagtttataggctttaaaaggccatgctgtaacaggcaagtgataacaggctttaatccttttaaagcgtgctgtgggatgggatattggcactgagcagggtaagggtgattagattttaataggatggtaaggggtgcatcatccatcgccaaggagggagtagaggtgtcctacacttgtggattaaggtggggagatacaaggagaggatgtgcaggaggcattgaactggggcaaaaggcagtagtgaggtgtggctttaacccaggaatagtcagggaagcagataatttagttacaatgttttgaactaataagcgagctgggcaggtgggataactaaaaaggagttcattaaagaatgttgtccaagttggcaccagagttggggagttttaagaggtttagaagcctggctgtcaatactcacaacagttatggaggcaagggaaacaggcccttgaaaagaaggtgcttgcccccgcaggaaagtggaaatggggtgggaggtgcttgccccccaggaaagtggaaaaggggtgggaggtgcttgccccccaggaaagtggaaaaggggcagagacatggagagaaggggtggggggtacttgcccccctaggaaaatggaaaaggggcagagacacggagagaaggggtgggaggttcttgccccccaggaaagtggaaaaggggcagagacacagagagaaggggtggggggtgcttgccccccaggaaagtggagagaaaagagagggtagagacacggagagaaggggtgacatgagcagccctgggctgcaatgtgggtgagcagccaaagcaattgtccctacaattaacttgccaccaagggaatgtgggtgaatgaccaagttaggcatccccacggagatcagacaccaacggaatgtgggtgaataatcaggcaggcatccccacaatgattaaacaccaagggaaggctgtgttcctgagtctgtgacctgtgccggagttttgggtccacagataaaatgtgtctcctttgtctctaccagaaaatgaaaggaattgaaattaagagaagggagagactgaagggtggtgccaagattgaaaggaaaagaggttgagggatagtgagagaggttggagaagagagtagaaagaggccgcttacccgatttaaaataggtgagatgttccttaggctggttggtctgaggacccaaggtcgtaggtggatctcttcacagagtgagggtgaggatgggggactggtctcccaaaggagtcccgctgacccaggtcttcggcaccaaatgtctcatgcgtccctatgaagagaccaccaaacaggctttgtgtgagcaacaaggctgtttattttacctgggtgtaggcgggctgagtccaaaaaaggagtcagcaaagggtggtgggattagcattagtgcttttttttttttttttttttgggacagagtcttgctctgtcacccaggctggagtgcagtggcacaatctcggctcactgcaagctctgcctcccaggttctcctgccattctcctgcctcagcctccagagtagctgggactacaggcgcctgccaccacacctggctaattttttgtatttttttagtggagatgggtttttaccctgttagccaggatggtctcgatctcctgacctcacgatccacccgcctcggggcctcccaaagtgctgagattagaggtgtgaaccaccgcacccggccgggattatcattagttcttataggtttgggataggcatacaaagtaccttcttaagggcagggggaaaatattacaaagtaccttcttaagggtgtgggagaatattacaaagtaccttcttaaaggtgggggagaatatatcttttcagttagctccagctggagtaagcactagatgttccagctgtagatgcactagatgctccagctggagtaagcactagatgttcatggagcacagagcaggggaagacttgaaagggggtgtctcatctcagccaagacctgaaggattgacaggaagtttccaggcaaaggaagaactacagaaaggctcagtgttaagaacaagcaccccatgtttggggagctgcaaatgcttcaggtagagatgcgcttggtatgagacaagcaaggtcagctcagaaaggcttgacaagtcctgataattgcttcgggctattcctgagggtagtaggaagtttttcaaggattttaaaggacttgatatgctttgtggaacactcactgcagttgtagtcttggaagggggctaaatagacccactccctcctttgagagactttcgtcattttggcttccaggaaaacatacactacagtttttgtcctactacctgtgttcattcctttgctggcctcttgtcttctccccgattgttcatgatggtgggtcccagggcttccacttttttttcctccaatctacttccaatacggcagccagatttaaaacatgaggcaggtcagtcctttctctgctcaggactctccaatggcttgctgttctactcagagtaaaagtcaaagttcttacagtggtccccgagtccctacatgattggtctcacttttctctccaccaccagctcactctgctgcagccaccctgtcctgcttactgtcttctgtacacaccaggaatgcttccacctcagggcctttgtgctggctcatctgtctgcccagaatcctctttgcccagatatcctgtggttccatccctgatcttcaagtctctgttcaaatgtcgccttctcaatgagacttttcctgactgccccatttaaaattgcaacatttccttctagcctgacacttctgatacccatttcccattcccttttctttctttctttgtagcccttataaccttttaacatcttatataatctctgtatttgttatttttatagcttattgactcttactcccactaggttgtaaattccacagagatggagctcttggtgtcttgttcactgatacgatccaaatatctcttaggatgtttccagctacatcctgaggctttccccaaggattcccctctacctggaggggactgttcccaagtccctgagcccagaagatccctcagagaccatataacctggagatcataaagttgcctaagacatagctgattatgaaggagagaaccctggaatttaagcagataaggtggatgtggagttgactgaacatttcccagctttgtgatcttgggcaagtcaccccacctcactgagattcaatttctttgcctgtgaaatgaggttaatatttgtccctcctaccttgcagtgtgtggtggaagtgtggccttttagtttaaatccctatgctttagcagggctcgatggctcacacctgtaatcccagcgctttcagaggcccaggtgggtggatcacctgaggtcaggagtttgagaccagcctggtcaacatggtgaaaccctttttctactaaaattacaaaaattagccaggtgttgtggtgggtgcctgtaatcccagctactcgggaggctgagtcaggagaatcgcttgaacccaggaggcagaggttgcagtgagccaagatccagccactgcactccagtctgggtaacagagcaagactccatccccaataaataaataaataaataaataaataaataaatwaataaatccctatgcttcaatatcctaaggaaaagacccacctgcagtttatgataacacaatggctatgtctatatttgtgccaattggccttgaagataaaatgtcagctgtgggggaggatatatttgtgtttaaaattcagagatcctgagagcatcaggatgaggtggagaaagcgtgagattatggtattacagacagaatgggcaatattcacaaggtggaggaggaacgttcatgccatggtcaggggctactgataggggaaacccaggcattgagaggattaaccactttccagaagtcctaatagacccttggtggactctaggattttcaagtcccaggccagcactttccccatcactgtcttctcgaagagtgataaatgaagttgttttcataatacagtgacattttcaggtccatttcctcagactcactgggtacttcatggaccatcacactcctgtttgagcatctgggctgcatctgcatccagtttccaagggtcttgtcagaacaggaggtaaacccaggttattgtcccaattttgccagtcacttgggtccctgactattccacagctctgagtcatagatcaccatttctcttttaacctagtggtagaagtttatgcctgttggatcattgcttttatatcttgttagctttgtctaggatttattagtctgtaatttcagattgggccccaggggtatttctgaatataactgtgtgttttgtgtgtgggtgggtatgcatgcagggataatctatggctttaaatctgaagtttaactggaaataataataattactaattaacaatgtggatttatataaaatgttattgatgaaaataatagcagcagccatcatttattgagtgcttattatgtgccagccaccatattaatttgaggtagggaccatttaagggtaagaaaatcaaccacacaacatcagtgatggagctaggattcaaayccaggctgaccaaagagttcactctattctttgcaattactgcatcctcaaacaatcccctcctccacggctcttgtttttcttcagtaatggttcccaactctttgctgcctggacacactagacagatgatatttggccagcataacccacttctgaggcccagctccaatttttagtgcatcctgccaacttgtctgttgsctggctctacctccatctgcagctctcacgactacggcccagcagtgtatccaacaacattgtgtgaacctctgctctaggagaaaggccataccctccagtccactctggctccactccacatccccctcctaacttctcatacctccccctttggaatctccccttgagttaggccaagcagagttctggagaggccttacagatgatgttctcctggactgggataagttctgcatccttttcagctactcatgccagttcacgttcctacattttccaggaacccttgttgtaccaagcagggttctcaggttgccaatcacagaagcagacccttaaaagaccttattggaatgatatgggaaagctcacagaatttacagaatctgagccggcaggccccaggaagagcagttaggggacctgaggtgtccaagtagcaggagttaatgggaggtcccttcagagagcttccatccgggatagattttccacccttatgttcctgtactcaagattcaaatcccggccgggtggggtggctcacgcttgtaatcccagcactttgggaggccgaggcaggaggatcacgtgaggtcaggagtttgaaaccagcctggccaacatggtaaaactcagtctctactaaaaatacaaaaattagccagggtcggggcgcgcgcctgtagtcccagctactccggaggctgaggcaggagaatcacgaacccgggaggcggaggttgcagtgagccaagatcatgccgctgcactccagcccggacgatgacagagcgagacmccgtctcaaaaaaaaaaaaaaaaaaaaagattcaaatccttggaagagagagtgtgaatggcctagtttgggtctctgggccacacatacccatcgaccacagcactttaattcatagtcccggccaggcacggtggctcacgcctgtaatcccagcactttgggaggccgagacgggtggatcacaaggtcaggagatcgagaccatcctggctaacacggtgaaaccccgtctgcactaaaaatacaaaaaattagccgggcgtggtggccggcgcctgtagtcccaggtactctggaggctgaggcaggagaatggcgtgaacccgggaggcggagcttgcagtgagccgagatcgcgcactgcactccagcctggaagacagcgagactcggtctcaaaaaaaaaaaaaaaaaaaaaaaaaatgcatagttccgccaagtccacccacatgcaactagttggggacagtttcttaaaggataattacagtgctgcaacaaggctgggcgcagtggttcaaacctgtaatcccagcactttgggaggccaaggagggcagattacttgatgtcaggagtttgagaccagcctggccaatatggtaaaaccccgtctctactaaaaatacaaaaattagccaggaatggtggtgcacacctgtaatcccagctacttgggaggctgggacacgagaatcgcttgaacccaggaggtggaggttgcagtcagccaagatcgtgccaccacactccagcctgggtaacagagtgagaccttccctcaaaaaaaaaaaaaaaaaaaaaagtgctgctaccagaagaggggagaagggatgctgagcaggctggacactaaggccacagccttctctcccttctctcaagccttagattcacactgctattttccctattgatggcctctcactgacctgcctcacctagggttgttatttaaacgtgtgctgcgaaatgcctgtcatagccatcattgtgcttgcttcagagcacatatgttaccttcccccaaagttgagaaactcctgggaggcaagagctgaggctcctaagtccacaggtttgctcggagccaaactatgggccaattaacaggttttagggactggctgagtgaccagctgcatgtttgtatgttgggtggaagagcgggataccaagacagtgaggtaagtgggaagctttccctggagaactttttaacccccagaatacacctattttccagtgaaagcaactaagtcaagaggttctgggagaattagttaaaagaattgcagctcaagactggctccattaggccaggttcttctagacttccaccatggtcatatacacttctgaaaactgtcactgccattaaatctcccgttacgattcttttttccctcttagtttcttattaagagcctttatgggggctgtgtgccgtggctcacacctgtaatcccagtgctttgggaggccaaggtgggaggaatacttgaggctaggagtttgagaccagcctgggcaacatagtgagactccatttatatatattatatatatatatacatatatacacatatatatgtatatatatatataaatttttttttaatttagcagcacaaggattgcttgagcccgggagtttgaggctgcagtaagctatgatcatgccactgcactccagcctgggcaaaagagtgagaccctgtctctaaaaacaaacaacaaaaacaaacagaaaaaaaagaaggctcttataaaaaaacattggctttccctctgctaacctgcagtttgggaaagagcctggataaagattgaggacatgtggcaactgggacccactctgcccttaactgcttagctgctcattcagtcaacaaataaacactgagaacctactatgtgtcaggcattgttcaagacactgctagggatacagtggtgaaccaaagataccaaatcttcttaatttcttttctttctcggagataggaggcctttatcagctctcatggctttttcagagctatcattccagaattatatgaatgaaggaaaaacaattttctctctctcattcaaggcaaaggggtattcaaggtgcctcaggaggtaaagcaagtggtgayattttcttggaaatagttcagaatctggatggatggagagagagagattacataatgaaaagcccacaaatgttggttcattgctggcacacagtgaacacagtgaactcttactaagtatctgtttggtggatgaatcatgtgggaaaaagaaggggacttaatgggtggctgcagggagaatttcctcactgtgactcgagaccctcacatgtgcctctttgcctctatcctgtcttgggagtactgctccttccgtaactcccccatctcctcaggcatttggaccccagygttccgggcctgagagtccagaatttccactctctgtgatacaaagaagaggccctggctcattattgactataaccctagggtttttcctcttaagagggaaaccttccctctcttaatcttccgggtcttcctaagaggaaagaatgtttgcttcctaggcacctaatataaactcccttaatgggtttaagcctggggtcacagaatcaagtgcacacagaaagaggccaggcaggtaatgtcaattgtgacagacaataaggaatgctggggactgtggtgacctggagagctgagcctcatgtgaacagcatcatactttaaaaaagtactgtgtgggccaaaacagtggcactcatgtgtgggtgttcgaagatcagtgaactatcagtttatggcatctattattagaaacaagccagaaaaacttgtcaacttttcattcttctctctgcggcatgtctccctgagaccacatggctgcttgaatggagggaaagaagaggaggacatgccaatcggagaatgtaggttaatatcttcaatagtattctaccatacccacatttggcttggatagaacgttttcttgggctaaactccataaaattcctatagaggcacaattactgactcaaacaaaagctgcctttgactattgagagaggagtgtctaggtcagaaggatcaattttctgatgaatcagtgagcaattctgagtggaactaatcaggcttgtgttgtgtcaccctttatttataacccatggttcagtgatctgaaatctgaccactcctcctctgacttcccccgacctccttctactttcctaacatgtgtgcaaatgtaccacatgtatacacacacagagaaatacaaagatgaagaaaagcatttttcagaaacaagaaggctcagagagatgttagagccttcctgacagtactggaaacaacaaaagatgcaagggtgtgacggccagtggaagtaatttaactcctgtgcctccagggaatcacaaggtctcaggaaaacagccatgagtaacaaattagctccccagcaaggcaaattcctggaggattaaagacagggagtgatcccagcaacatttctagttactaatgcctagggataggaagggcaatsaattaatttttccctcaggattccaactgaggttgtcccataaagtattgggtcatatttccaaagccacgttaggtcaggccttggttacccatcacattagttaaggttatattggtttcagggaagaaaaggaaactttggctgacttaaacaaaaaggaggattattgggaagctcctgtgggctttgatgaaatcaaaaagaaagctggataaccacagctcagcaagggaagaaactgagcaccaggagttcatggttgtgttgccattgatatgattctgtttcagtgtgcccaggctctctggttctttgggataaaaggatctcatgggccctatgacttagcttgggttccccaaaggcagagggattctgttgtgatgtacggggagagtgctctcaggagaaatccattaagggagtgagggaagcagggtggtacaggagacagagctaagcaagcctagcctcagcctgatccggtggtgggacctggagagtgaatgacatgactgagttatcccactttgaagcaatggtgttcctctccctcgagggggagaacatactttctcaagcatttttgggaagatgattcaatagcaaagccacctgtgaggtgttcatagccaacattcacagcagctgggggatggtgcactgcctagtcaaggagatctgggtagagcaccaacagaatccactgctcctggcttgggtaaggtgtccactcaagagcaattagccattgagagagaggcaaaaccttgaagtctagacatggcagcagggctatttccagaggaaagtgtacaagagtgatgggaagttataccaaatggtgtccatagtacccacttgaataacttttactgaaaatgctctcctggccagtatgtacaactggccaggtgtttcttcctcagtaagaagagtatttcccaggcacttaacataatctcctttttttttgtttttctcacgtcagtcaggtaatatgtcaacatggtaacaaggttcgagggtggctcatctcacacgtgggcaggaacacccaatcatcatgctcatgaactacaaaaggatcatctctgtttttttaaaaatctctcaaacattgtttattatacaagtaaaccccaattctcatgatgggcttattggtaggatttctggtagcaagcatgggtaccagcgtctcttaattttttggattagtggtggtggaggtcagccaccagcaggatctggtcgtactgtatgaggatgtctttgatctttgtctttgatctcctccttggaaaactcatccatatacttctggtaataggacaccagggctttgaggctggactgatggatagcatatatctaggccatgtgatcaccacccttcacatggacacgtccatgccagcaaatcactccttgtctggaagcagaactggttccagcagctcatatattggtatgtatagctcgatcatctccaggggccgcctgttcaccttgattgctgcgtttgcagtgtgccacagctgtggctgtcttcttgcatctgaagacctgcacaaagtgcaatgagcccttggaaagaatggctacaggtatagataagaactcctctcttttttttctttttgagacagggtcttgctttgttgcccaggctggaatgcagtggggcaatctcagctcactacaacctctgcctcctgtgttcaacgaattctcctaccttggcccccgagtagctgggattacaggtgcctgccaggaagcccagctaatttttgtatttttggtagagatggggtttcaccatgttggccaggctgtcttttttttttttttttttttaacataatcttaatagggagctctccagtttaaccacagtccttgacactccctactgtctaccacaattgatcatatgatagaatctttctgtgtgcatttgagtttgtggccccaggcctaaacccattaaggaagagtattttaggtgcctgggtacataagtagaagtggaatttatggattctggggcatgaatgtgttcagctttagtgtatattgctgaagagttctccaacatggttgtatcatttgatactgcttttaacaatgtatgaaagtaggctgggcacagtggctcatgcctgtaatcccagcactgtaggaggctgaggcgggcagatcacctgaagtcaggagttcaagaccagcctggtcaacgtgatgaaaccccatctctactaaaaaaatacaaaaattagccaggcgtggtggtgcatgcctgtaatcccagctatttgggaggctgaggcaggagaattgctagatcctgggagacagaggttgcagttagccaagatcatgccactgcattccagcctgggcaacagagcaagagactgtcccaaaacaaacaaacaaacaatgtatgaaatttccacttgccccacatccttaccagaacttggtattgtctgtctttttcattttacctattctagtagatacgcagtattatctcatggtggttttaatttgtatctctaggccgggcatggtggttcacacctgtaatctcagcactctgggaggctgaggcagatggatcactaggagtttgagaccagcctgggcaacatggcgaaaacctatctctcctaaaaataaaaggaaattagctggctacagtggcacatgcctgtagttctagctacctgggaggctgaggtgggagaatcacttgagcatgggaggtggaggctgcaatgagccatgatcttgccactgcactccaacttgggtgacagagtgagaccctgtctcaaaaaaaaaaaaaaaaaaaaagaaagaaaagtatttggcatctgcctaataagtaatgaagtcaagcactatttgatgtcttttcttgttggttcaggtaaactgtttatgaattctgtatatcaggtgaactgtttatgaattctgtatatgaatatacaaagctcttggcctggtatggtggctcatgcctataatcccaacactttgggaggctgattcgggacaatggcttgaggccaggaattcgaggttacagtaagctatgatagtgctactgcactccagccggtgtgacagagcgagaccttgtctcttaagaaaaaaaaaaaattctttaactcaaaaaaaccaaatcctctgcactgtggccaatgaataattttatggcagatgggtcttttgcccctcgttttatactaatatataattattacatattgaacataatactgaagcccagtatattcacccgtttggtgaagttgagattatagcccatgtttcctgacaagctgtgcacacatctgttggttctcctcggcctggcatcccttaatcctacttacctctcctttcttccttctccatttcaaccatgggactccagggaggttaccaatcacattattccctccctttggctacgtggccataaactgggcccatcaatttatttctccataaaacttgaaactccaatgaaagcctcttgaagtctcatagatgtgccctgagagcaggcccagggtcacctgctggtaaggacctggagcttcccagtttcctgtccttccaaaggtcatgatctctatctcttccctcagttctggaactactcaagaatcctttttccaataaaccccttcttcccttagtcagagtcagtttctattgtgtgttagtcagagaactaatataatcccaattctctttttttctgccaccatcaatgagcaaaatgggaaatttttaaattatttaattgcattatacttattcatattttatttattacattttgtaaataagattttcgtggccgggtgccatggctcatgcctgtaatcccagcactttgggaggctgaggtgggcggatcatctgaggtcaggagttcgagatcagcctggccaacatggtgaaaccctgtctctaaaaaaatataaaaattagctgggcatggtggtgtgcacctgtagtcctagaaacctggggggctgaggcaggagaatcgcttgaaccaggagatggaggttgcagtgaactgagattgtgccactgcactccagcctgggcaataaagtgagactgtctcaaaaacaaaattggcttttaatttcttaaaattggcttagttggtcattgcatgttaaaaccatatctgcagctactcaggaggctgaggctggagtatcccttgagcccaggaaggagtggttgcagtgagccaagatcgcagcactgcactctggttaacaagagtgaggtcctgtctcaaaaaaaaaaaaaaaaaaaaaattggccgggcacggtagctcatgcctgtaatcccagcgctttgggaggctgaggcgggtggatcacctgaggtggggtgtttgagaccagcctggccaacatggtgaaaccccatctttactaaaaatacaaaaattagccaggtgtagtggtgcatgcctgtaaccccagctacttgggaggctgaggcaggaaaatcccttgaactcaggaggcggaggttgctgtgagctgagattatgccactgcactccagcttggcctgggagacagagtgagactctatctcaaaaaaaaaaaaaaaaaaaaaaaaattaaatgtaatttcatttaaaaaaccataactgagtttttgaaatatgcgtcatttgagtacctgtatcccaggtttatttatactaacagggagctagcaacttagaaaaacatttttatttctatccctttgaatcgtctagtctaaggggaggcaaacttttctataaagagccaggtagtaaatattttcgtctttgtggaccacatggtttctttcataactactcaactgctgttgtagccacagatggtacataaatgaatgggtgtggccatgtcttaataaatagacactgcaatttttgtttttgtttttgagatggagttttgctcttgttgtccaggctgcggtgcaatggtgcgatctcggcttattgcaacttccaccttgtgggttgaagcgattctcctgcctcagcctccagagtagctgggattacaggcatgtgccaccacatctggctaattttgtacttttagtagatatggggtttctccatgttggtcaggctggtctcgaactcccgacctcaggtgatccaccggcctcggcctcccaaagtgctgggattacaggtgtgagccacccgacccggcccttttttttttttttttttttttttctgagatagagtttcactcttgttgcccaggctggagtgcaatggcgggatctcagctcactgcaacctctgcctcccaggttcaagcgattctcctgcctcagcctcctgagtagctgggattacaggcacatgccactacgcctggctaatttttgtatttttagtaaagacggggttggtcaggctagtctcgaactcctgacctcaggtgatccacctgcctcggcctcctaaagtgctgggattacaggtgtgagccactgcacctggctgatactgcaatttgaattttacataattttcaggtgtcatgtcataatatagtcttctttgatttttttaaaaagaccatttaaaaaatgtcgaaatgattcttagttttcaggccacagtggccagattcattctatggggcacactttaccaacttccgctctaatcttctgattgattatacattattattattgttattatttgagacggagtcttgctctgttgcccaggctggagtgcagtgttcgatcttgcctccacctcctgggtttaagtgattctcctgcctcagcctcccaagtggctgggattacaggcacacaccaccactcccagctaatttttgtatgtttacttttgtattttatttatttatttatttatttatttatttatttttgagatggaatcttgctctgttgcccagacttgagtgtagtggcacgatctcggctcagcctcctgagtagctgggactacaggcaagtgccaccatgccagctaatttttgtatttttagtagagacggggtttcaccatgttggtcaggccggtctcaaactcctcacctcaaatgatccacccgcctcagcctcccaaagtgctaggattataggcatgagccactgtgcctggcctgattatacattattgaacataataaatattgacttcttaaattgagattataaaataattggcactatttatggaataaataagtaacttatttgtctcctaaattgatgagaatacagtcaaggatataactataaaatagcaactggataaaatttttcttattcccaggaattcctatgtaacactgcagaacgtagaaagatcatactatacactaaatttctttgtagttgttttggaactatctaattttatagcacaccaattaaacatttattgttaacatagaatcaaggaaaataaggggctttaagatgtaaatcacttagtcacttacaataataatgatgcctagatttatacagctagtttacaaaaattatagttttatatattatctcttatgatcctcacaacaaccatggaggtagacaggcaaggtcttattatcttaatttaaagaagatcaacctgcccaagatgacacaagtgacaagggagtggcagagatactctagtcacatctctgaatcatagtcaaaagttgtttccataaaatataatactaaaatcatacaattcaagaacaggtaatgagtaaatcctgcttcatcagctgaggaacataagacatctcaccataaggatgcctttcatttgtcaactcaagctgcatgtgcctagattagtggaaaatctagacctttccttctcccctcttagctcaacctccttcccctgataagcttaggagtcacagtggtcacaaccacagctgattgctctggaaggtatcaccctagctgctgcagaagctgagagcccggtgtcactgctgattctgaaatgttttaaagcaatatctttgtcaaagttatacccttgaaaagccatgccttttgtcaacttccactgctgaccacaggatttcagcacagtatccttatgtctactaaagccccagtcagaaataattgcagcccatctcaaacccaagttccagctaccaatactgtgatctcttgctaacacataggccatctgaaagaaatgacttggattgagatttgtgtcctcgctggggctgatactggtacaccttccttcaagccttccactaaaaaaggaagggagatgcctttttcctcaggattacacatttagacaagagcactcaaaaccaagtggtacagggatcccgatattacagttctttggattcattcattcagtctcttccccagggcataagccaagtgcagacataaattgcattaaagcctttatttatttacttatttaaaatttaacttcttgttacgaaaatgtccaaacatacaaaaaaaaaaaaaaaaaaaaaggccagacacagtgacttatgcctgtaatcccatgtaatcccagcactttgggaggctgaagtgggcggatcactcaggagtttgagaccagcctggccagcgtggtgaaacccgtctctactaaaaaatacaaaaaaattagccgggtgtggtggtgcgcacctgtaatctcagctactggggaggctgaggcaggagaatagcttgaacctgggaggcagaggttgcagtgaaccgagattgcgccactgcactccagcctgggcgacagagtgaaactctgtctcaaaaaaaaaaaaaaaaaaaaaaaaaaatggtattatgctcctcccctgctcccgcgtacccatcactaagccttaatatttattgactggccgggcgcggtggctcacgcctgtaatcccagcactttgggaggccgaggcgggcggatcacgaggtcaggagaccaagaccatcctggctaacacagtgaaaccctgtctctactaaaaatacaaaaaaattagctgcacgtagtggcgtgcgtctgtagtcccagctacttgggaggctgaggcaggagaatggcgtgagcccgggaggcggaacttgcagtgagccaagatcgcaccactgcactccagcctgggcgacagagcgagactcagtctcaaaaaaaaataataaaaaaaatttattgactctctcctaatcttctgtgctgccacttcctctcctctgaagtattttgaaggaaatactggagaccgtataatttcatccttaaataattcagtatatgtctctaacagaaaaagactttttttttttttttccattttcttgtttgagacagggactcactctattgctctgtgactccatctgggctactgcaacctccacctcccagcctcaagagatcctcccatctcaggcttccgtgtagctaagactacagatgtgcaccaccacgaccagctaatttttgtatttttttgtagagatggggtttcgctatgacacctaggctagtcttgaattcctcctgggctcaagcaatcagcctgctttagcctcccaaattgctgggatataggcatgagccaccacaccaggccaactgttttcaaaaacacaaccacagtatcattaagacactgacagaaatattaatctgtaattaatattaattccttaatataatttaatatccagcctatagtcaaatttgcccattgtctcagaaatttatttttaaataattggattatgaaataaagatccacatactatattcaattgttatgtttctttcttttttttttttttttgagacagagtcttgctctgtcacccaggctggagtgtagtggcacgatctcggctcactgcaatctccgcctcccgggttcaagcaagtctcttgcctcagcctcccaagtagctgggactacaggcgtgcaccaccatgcccagctaatttttgtacttttagtagagacggggtttcaccatgttggccaggatggtctcaatctcttgacctcgtgatctgcccacctcagcctcccaaagtgctgggattacaggcgtgagccaccgcgcccggcctatcatttcttttacatttattagttgaaaatattttatacaaaaggacttttcctttaaaactcattggctaccctgaaatacaatttgtacaacaaaggcagaacaaatgtttggttatttcccttttttattttattttattttattttatttttttcagactaagtctcactcttgtcccccaggctggagtgcaaatggcgcgatctcggctcactgcaacctctgcctcctgggttcaagcgattctcctgcctcagcctcccgagtagctgggattacaggcacctgccaccatgcccagctaatttttgtatttttagtagagacggggtttcaccatgttggccaggctggtcttgaactcttgacctcaggcgatccgcccgccttggcctcccaaagtgctgggattacaggcgtgagccaccgcgcctggcctatttccctttatttaccaattaccattaccatataattagcaacttgccatggcaacttctataggcaagtagtgaatttctttcctttttaaaaaatttttgtagagacagagtctcattatgttgcccaggttggtcttgaactcttgggctcaagcaatccccccactttggcctcccaaagtgctcagattacaggtgagctaccgcacctggcctgaatttattttcttagtatcattatgaacttgtcaattttaacatcattggtgtgataagtgatttaaaatacattctgtgctttgggaggccaacgtggaaagattgcttgagctcaggagtacaagaccagcctgggtaacatggcaagacccagtctctattaaaaaattaataataaaataaaaatctatcaataggccaggcatggtggctcacatctgtaatctcagcattttgggaggccgaggcacgtgaatcacctgaggtcaggagttcaagaccagcctggccaacataatgaaaccccatctctactaaaaatacaaaaattagctgggtattggctgggcacagtggctcacgcctgtaatcccaacactttgggaggccgaggtgggtggatcacgaggtcaggagatagacaccatcctggctaacacggtgaaacccagcctctactgaaaataaaaaaaaattagccgggcgtggtggtgggcgcccctagtcccagctactcaggaggctgaggcaggagaatggcgggaacccaggaggtggagcttgcagtgagccaagatcgcgccactgtgttccagcctggtcaacagagcaagactccgtcttaaaaaaaaaaaaaaaaaattagctgggtgtgatggtgcacacctgcaatcccagctacttgggaggctgaggcaggagaaaggagaatctattgaacccaggaggctgaagttgcagtaagatcgcgcctttgcactccatcctgggtgacagagcaaggctctgcctcaaaaaaaaaaaaaaaaaaaaaaaaaattgaacaataaacttcctttgctttaaagagaaatattttcctgaagaaccaaaatgtaagaccaaaatctctaaacatacttaacaatatttccaggattttctacctgttctctgattttctccttttcctttactcagtttactggcttttatttaatgaatttttggtgtctgattgaggctaaagattgactgctctggcacccctactagtgatttccatttttatgtcattcagattacatttataagacctacttttcctataactagtatttgcatctgcattttcataaaataagagcaaataaatattccaataattgaacactactcaaataactgaacactcccataccatgtggacaaccacagggatgctgcttaaactgaagcaatgactgacagtcactaccactgcgtgtgagtttcacttgcttggtagcttagctatcaaagccagcatttgatgtgtaaaagaaggtttaggtattttgatggaggatgcatgaaaccctgttattgactgtgacatactggattgtttctgttagcttacttgttatatctcctctagacagttagttctgggggaacagtaaccacatctgtatctgtatacttattttactcctagcatctgtacaatctgtacatgctgttgttttttttttaagatggagttttgctcttgttgcccaggctggagtgcaatggcgcaatctcggctcaatgcaacctctgcctcctgggttcaagcgattctcctgcctcagcctcccgagtagctggaattatgggcatgcaccacacctggctaattttgtatttgtagtagagacggggtttctactacagcctgttgatcaggctggtctcaaactcctggcctcaggtgatctgcccgcctcagcttcccaaagtgctgggattacaggggtgagccaccacacccagccctgtacatgcttttttttttttaaatggaagaataaatgatgtatgcaaaggctgggcgccgtggctcacgcctgtaatcccagcactttggaaggtcgaggggggaggatcatgaggtcaggagatagagaccatcctgcgtaacatggtgaaaccccgtctctactaaaaatacaaaataaaattagccaggtgtggtgacaagcacctgtagtcccagctactcgggaagctgaggcaggagaatggcgtgaacccgggaggcagaggttgcagcgagccgagatcgcgccactgcactccagcctgggcgacagagcgactccgtctcaaaaaaaataaaataaaataaaataaaatgtatgcaagacaagagagaaatctaccatggttttgagcagtaagaagcataattagacttttttttttgagacagggtcttgcttagtcactcaggctggagtgacacgatcatagcttactgtaatctcaaattccttagctctagtgatcctcctgcctcagcctcccaggtagctagaactacaggcacgtgccaccatacgcgcataatttttaaacatttttttgtaaaaacgaggtctccttatgttgcccaggctgatctcaaattcctgggttcaagtgatcctcccactttggcctcccaaatcattggaattacaggattacagcccagcctagatttaattttkagttttttattttgattctgtcatattggtatttgtcttagtccatttggactgctataacaaaatatagcttttgtggcttataaacaactgaaatttatttctcaaaattctgaaggctgagaaggccaagatcaaggtgccagcagattcagtgtctggtgaggatctgcttcctcatagacagctgttttctcattctactatcacattatggaccagggaggggtgtctcttaggcctgttttataagggcactaatcctgttcatgagtgctctgctgtcatggcctaatcacctcaggaaggccccaccttctaataccatcaccttgggggttaggagttcaacatatgagttttggcaggacacaacattcagaccatagcagtaacagacaattttttttttttttggagacagactttcgttcttgtcgcccaggctggagtacaatggctcgatctcggctcactgcaacctctgcctccttggttcaaatgattctcctgtctcagcctcccaagtagctgggattaccggcgtgcaccactacgcctggctaattttgtatttttagtagaaacggcgtttcaccatgttggccaggctagtctcaaactccttaacttgggtgatctgcccggctcagtctccgaaagtgctgggattacaggcgtgagccaccgtgcccggccgcagatgtggtatatttcacgtttgagtatttttgaaaataaaaataaaataaaataactgatagttccattccttaaacttaacatttgggtgtgttttctagtattttttctgtatttgtattattatttgtgagacggggtcttgctctgtcacccaggctggagtgcagtgatgtgatcaaagctcactgtaaccttgaaatcctgggctcaagcaaatcctgccgtctcagcctcctgagtagctaggactacaggcgtaggtcatcacacatgcctggctaattaaaacaaaaatgttaaatgttcatctagaacatattgtttagtaacctactgttttacgttaaaacattatccactttctcctacaatagaaattgtaatggctataatacatgattatttcattatcacatctatttttaargaaaccaggcctaaatctagtttccataatattctgatgagcaggaccacagagcagtgattttgatcaggattgtgcctgttaaaagctggctactccatggcatgcrcagctccaggatgggagattaacttcaacaaccattcatttagtttggtttgattttctgccagtctcatgaccgacttgaagcacgtcctagaacagagaatgttatgtttggtgtccaaggaagcagcaaactagaggcgccatcccaaattctagaataatagagtcaacaatcgtttcacaccaaagtcatccattttctgaagcaaattttgaactaaaatgttaaaaatgttttgtaaggtagattaaacgtcatgtggggaaaataacttgttagtgcaaaaaggaaaagaaactgaaaacagacatatctgtagataaattttcctttcaagattctacagtataaatatccatctaaaagatgaattggcttcttaagccaattcattgtcacttgcttctgaagtgtttcccaggcaccttagttatcagccaccctgcccctagggtatygaggacaaatacgtttcaggtagcttgacaacaggaaagaattttaaggacaagaaactacctgcaataccagttgggagtgtcctgaaaagtgatgtactgaaatactgacccttccagctggttaactttcataatcatgcatttacttttcaatggcaactgaatatatgactgcctgatgattcaggggaaaaaatgcagtattgtgtgtggaattggaagagattcaaagtgagtgccatggcagtgactaacttctttcaaaagcttaaggaagaaacaatgcataggcctttsagttagttggtgtagtaagcattgtgttttcaccatcagtatccatttctatattttggtgacagtactccattttgttcttccgggaaccactcctctcctatagtccatgatctttgggtggaccasaggtaaagcatatgactcaaatytggctaatcatagcacaagagttttccttgctacagtaatttgttaaaggatgggaaggtaactctctatcctttaacaaattactgtagcaaggtaattggttcagtgaatctaggagctactggaagggatctcttgctggacttggactggagtgaatatagaactaaagtttttgagaactgtcttgttgccacatgatgaagtctgagtataagccaatatggagaaaagctgattggggttttttttgttttgttttgtttttaaaagaaacaggatcttgctgtgttgcccaggctggagtgcagtggctattcacaggcacaattgtggtgccatataagccttggactcctgggctcaagcttcctgaggtagctgacattactactacaggcacaaacctgggcctttttttttttttttttttaccccccagaaggctctctctttatttgtctgacctgaaatgggcataagttgcaacagattgaaaattctaactctaccttcattttcagaagtgtctaaattaaacatttataagaaaattgatgttttataaaaacaaaagacatgaaaagctctgtattcaaatatttttattctgtgaacattgaaaatgccttctaggaatatggcattgcggggtgtatacaaaaaaatagatcttttctcaaaaagcatgtaatctgcttgggaagacaagaayattattaaaaaaaaccctttagaacacaagtgagttgtggacagtaatacatataaataatctgaatggcagtatataataactgataactatctacaaccaaaaccagcctagaacaaaagcatgagtaagaggctttagggtacacttctgagcattttcttttaattctcaagacatttgtccttgttttcctaatctttaggtggattcatacatttgtatttcctacctggtatttcctctgaattactgacttgtaattcaaacaccacatctgctcccaaccacttcctaccacttccactgctacctgaattattgttatagcctaactggtcttcctgctctcacctttgctccyctaaagtctattcacaataaccagtttaaactattattttattaggaaaaatttcaaacacacagcaaagttgaaagaattttacagcaatcacttctgcatccaccacttatattctaccattaacagaatactcctttaaataatggcagatgtgtagttcctctgctcaaaaccctcccacggcttagcttactcaaagaggaaaaaccaggctgggcgtgatagctcacgtctgtaatcccagcattttggaagactttaggaggctgaggtgggaggatcacttgcgggcgggagtttaagaccagcctgggcaacataatgaaataccatctcttaaaaaaaaaaacttagctgggcgtggtgctggatgcctgtagtcccagttactaaggaagctaaggcaggaagatcacttgagcccagaagttcaggactgcagtgagctatgagcaygccattgcactccagcctgagtgacaaagtgagaccctgtcttaagggggaaaaaaaaaaggagaaaagccaatttgttaccatggtcaccagtatgatctggcctctgttaccattcttcccacttgtcctttactcttcagccttgttactgctccttaaacatggcaggcacatttttgttttagggcctttgcacttgctgttcctttgcttcaaatgctcttctcccaggtatttacatggcttgcttctctttctttcgatcacctcattagttctgactcttccaagtattaagttgaaccatatgaccctaatgtcacacaactggattgaaccattcaaacctaaggtgtaatgtcattctcaggtcaaaaattatttttaaaaatcagtaatttcataggattcaagcttataaaatagcaactccaccctaccctttcattctcaccctgttccaatattcttacagcactattatcttatttatgatttgtatattgtatgtaagatcctcacagatagggaatttgtctgttgtccactgccgtgtgctctgtgtgcagagtaggatttggtctatagcaggccttcaggatgcatttatttaaagaatgagtagctgagactacaggtgcgcaccaccacacttggctaatgttttcatttttttatattttgtagagatggggtcccactatattgcttaggctggtctcaaactcctgggcgcaagcaatcctctcaccttggcctcccaaagtgctgggcttacagttgtgagctaccacacctggccaaaaatgaattctttttaaaaaatttttcttttttgaagcaaagtcttactctgtggcccaggctggagtgcagtgccatgatctcgactcactgcagcctacgcctccccggttcaagcgattcttgtgcctcagcctccygagtagctgggaccacaggtgcatgacactatgcatgaatgaattcttaacattgaagtcagagtggtcttttgaaaatacaaatctgatcatgttgctctcactaaaaactcgattggtttgcagatttcggaacaaagattagaatctttaccacagcctctaagaccctgaatggtggacccttaactctccagactcatctcacattctctcatttcagtccctgggactctgttgcttctatcatgaggtctatttgtgctttcttgctttcccccacctctgcatgtagtttatactctgaggcacttttaaatctcggcttgaaacatctattcccaggagaaggcatttctgatacctcaggttaggtcaagtcccaatgcttttatgccctcatggcagcacatacctaccctttgtaatacctgttarattttaaaggtacttttgtgagattgtctaacttaccagtttcataagaaaaagaaacatttttgtttttgcttcccgtcggatgtctagcatttgcaaattatctagcacatagtgagagcttaacattaaaaaaatatatatcaacagaaactctggaattctagctccttaagagcagagattgttttgtccctgtgtcaagtacctaattgggtgcttgatttatctgctgatacacagcagataaataatagtttgttaaataagctataatatgaaggatgttttttactcatttatagtaagtacataatgcagaaaaaccgtcacttgataatcagtgattaggtgctcataacataattgatacctacacaaagtcccaaattttcccctttcatcaacctttcctcaagactaagattgaacaaagtaatttagccttcattttttccctgtttattctctggtggagtaaagggtgagtgccctgggtaggagaatccatgtagaaccagaattagccataagtgagattttgcacactaaccaacaaaccacagcattctttttttttttttttttttttttttttgaggtaggatcttgctctgtcacccargctggcttgcagtggtgtagtcatggctcactgcagctttgacctccaggactcaagtgctccacccacctcagcctctggagtagctgggactacaggtgtggaccaccacaaccagctatatttttttttttttgtagagacaggatttcaccatgttgcccaggttggtctaraactcttgctcaaggtatctgcccaccttggcccctcaaagtgctggattacaaggcgttagccaccatgcccacccagtattcttgttttgacagttagatgtttaraaacttttttaaaaaatccagtcaaatgacgagtcttgtattcctctgttttcctttgataacaatctgtgaaaaaactgcagtggtcagaagwtgtgttaaaatatacacacacaagttgtataatgttgcaggtttattagggcaggatgacatggaacagtatgaccagagaaagcaaccaccttacaaataaatcactttcaattgtgttgacccagataattttaaaaataaacttgtaattcaagatgagcactaggacaagcttattaacatttgctaatttaggagaggaagggccaagtcaaatataataaaaatgaattactgcaaaatggaaactttttgatatgaaacataaaaataaattaaaaacctaaagactgtagtatgtcaatttcctggttttaataaggtattatagatatgtaagatatcaatagggtaaactgggcaaatactacacatgmccgctatactatttttgcaactttttaataattatatccaaataaaaagtaaaaaagaaaaaaataacaacatgaaaaaataaatctagataggaattcttagaaggagaacttaaaacaaatatacacagtaaaagacaattacattgccaggtttccataggcttgtaaggagttaaataaaattagaaaaatgtttctaacacacacacagacacacttttttttttggagacagggtcctgctctgtcatgcaggctggaggacagtggtacgatcacatcttactgcagccttgacctcctgggcccaagcaatcctcccacctgggtctcccaagtagctgagactaacaggcacatgccaccatgcccagctaattttctgtagagacaaggtttcaccatgttccccaggctggtcatgaactcctaagcttatgcaattcacctgtcttggcatcccaaagtagtgggattacaggtgtgagccattgtgcctggaccagacacactttaccaatacaaatattaggctttcaaaagtggtatcctacttttaatgtttgaactaatgatctttcacatcttagagatgtgcagtgtgaaacacagtattaccgtgtttgtgaaagacaacttttgtgaaaaccacaaaaataagtatttgctcttaagaaaggaaaaaatttattgcttggcctcatcaaagaaaactgaagaatttgctatgaaaggaacaaaaatgtacaaattgtaccacctcaaccccccaaactgtataaacaactgcaaaattttccttcatctattgatacaaccccagagaagccagtcctcacagacctgggggcattcccatgtcagaatattccataaagatctaggaacacatacatttggcagaaataaatcaattaaggtgcagggaaagattgcccatgaaataatttatggtgatgcatttagtagggccagagagatctgagttcaaattttggctcttccagctactagttttgctaccttaggtatgtcacaatctctctgaatctcaatgtctttgttactaaagtgggtataatgatacccatatctcaaggttagtcctaatactggaagcacaatgctgtgtaaatagaaggtgattaagtgttagctacctcccagtcccttttcccagaaacacaatgcaaaatatttctgctggtttgcatgaatcaaaacaagtggctaaggagaaaaattaaaagggcaagagaatctaatgtattatccagacaatctattaattatgtcgttaatatttaatacgtgttgggtttttggtattattcaggtactgcatctgaatagatcctctcactttgtcttcaacaaatttggcaaaagatgtcattaatcattttattcagatcacaacatgccaacgtaaaaatcatagttttaatgtttactcatgactctgagaaatatagtgacatagaaacagtgaaaaggtaaagaatttgtctctcaaagctgatgggtataattctccctgtctctcgaacctcccccattagtgccacagtgccagcccccataaactgtaagggtgatcaagccttctgaaattgcaggggaagtgggcagcacagaaacagcccttagaaggctttagagacaggtgctcaacatggaattagtgggcttattcagggggttctggaatctgcagtccctgtatgtaaagtcgtggttaggtgtatttcgtgccttttttgtcaggaggctcctcaactatcacttcctcctagaggtcttttttagccatcctatccagccagaggcttcrtctacaaaatctttttcatcactctgtgtgtttcctgcaaagccatactacacctgtcattaccttgtttgtttgcttcagccmgtctattccactaaggtaagcttttcaaatgcacgaccctggtccttccccagtgccttgaacctggtgggcctcgttagatatttccggaataaataacaagtccgtgtctatcagatttttaacrgactctatactcctccctccatcccgctccccgcccccccccccacacctctcgcgcaagcattcttctccagaaataattttaaggtcatgcgtcttcatttttgaaacgaggcttgggcatttcgaccacacccaccctccctccctcgcatactcgtttcctaacagagcgctactccagcccacttgcccaagcccaccaggccgcagggtttggggcaaccaggggtggggcagccctgaaccggaacaagtgtcaattcacattacccgcactggtcctggttcgaagagcctgggcaggaaccgtgggacccagagaagccacccgcccaaggccgcctccggcctccgccccgccagcagcccagggccccgccctaccggcagccgcgcctcgccgccctccctccagcttggccctaacggctcgcaatggcggaacagggagccaggggcatcgccgcttggggaacctcacccgccggcccagggctcagctcgccgtgtgacagccccgggtactttgcccagcggggtgcaagcccggaccgcggcaagcgccactcccgggcagtcgcggccacaactgcttccgggtgagtgggtcgtcgaccctgtggccccgcccatccttcgcctcctcagtcggccgctcaggctgcggctcctcccggggccggttcccgctgtctcagccgcggcgcagagggcacatcggcctgaccgactagccggctgccagtgccgggagccgccgcgtccatccccgcccgcctggccggggacccaggactgagtcgtccagctgcgcccctcgcccatagccccagcgggcgccgggcgggcgagcagctcttcggcccttcccggacagcgacgcagtcgcagcgcgcgccctaacacagrtaagggccgctcctcccgccagcccggtgggagcagggagcggggagttgggaacctttttcccggcctccgcagtcccgtgggatccgcgccgcctccgacctcggctagggggccgggcttccctggggactggccggcccgcggcgggctcccgggctggggtcgccccctgcctgcggcgttctcagacatcccgtctgatttctaacgctcacccttccaccgcgctggggaaaaggtacgtgttattcccactgtgggagaaattaaattgggcagctgtccctccgtttcgggtgccctaggcgccttctcttcctccttagacgccacactacggttctgtcccaggacgagcacccccagggaacggtgtcaggacggtgtagggcgtagcattttttgggaattttacttcttcctccttgacctgagctggatcgcgcgggtttaacaggcgctagctgggttaatacttgactaataygaggcgttattgacacccagattgttaagttacagaactccagtcagccctgcctgtgagtaaccagcagcatgyaggaggacctaaggaaacccacttctttttctttcttagagggaaaaaagttcaagtgtttgctttacttttttcaccgtgggagatacaaatacaggctgctgagacatggctagataaatattgtatcctaaaccttaactgttagtagctggttttctttgagtttccatttagtgactcagcgtttctactataaacagaaaaattgtagagtggattgattgactaaaaatgatatgtaaggataaaggtgacttaatttttttatgttgtcataatgggaagagaatgtggatgtagtaatgaaacaagagagaaggagagcggggtatggatgtataagttcttaatcagtgtttaaaataatattttttcaagataacattttattttgaggataaatctatatgaaaaagtgcagttattggagaatgcagtgttgcaaatagaattagttggcagggactccacggttgttgtggtttgaatatcttgcagcactaaccctgtttaaccaacgtcatgctctgtttaacagatgcagagataatgacctagtattataatatgtagaataagaatttcagaaagtgtgattcatttcgaaggtagatcactcactttgtgaatcattgctatgaatctgaaaattgaaatagaggaaacctaagttcgtatctgcctaatgagatggcattctttactcattttataggaagtgttgtattatgttttgttaggtctgttgctggatatttatcatcgtgaagaatggtaatgaaataaaagttgaagtatttgcagaatgctggaatttagaatagtttgttggtttataagtgattgctttgattttactccttcccccccttttttttttgccagatgtgggaagataaatgaaggggtctagatgtaaatgtcagtggaraggagagctaccatcactaaggtatgaaaatgttcactgaaagaatttgcactatacaaaatagtcttttgagtggaaagcatcacccatttttgtgattctgtctttaaaaatgtagaatgaaactacatgagttattaagttctgttctagaagaaagtgtgtattgaagttgtgattggaatggattcactttaaactagaaatagctttttattgctgaaatgtaatttgctcatttttgactttaaaaatgttaagtaaaataaggttgaaatcacagagttcttaatacccttacccttgtttttcttttccttctgttagagttcagctgatttttaccttgattttcatttataaagaactttagttaaaaaataatgrcaagtctatcctgttggtctagcttactaaattcctttacttctttcactaaattttggcatcttttttttactttggatatccattatattcagagtgttccctaatgttgcttttgatttttgtccagctaatttaaatagtgacttaagagtttcagttccctgtgaacacagattcccttttggaaaatcccttttggaaatcaccgtaactgacagtcttgataggtaaatatgcaagggaaaccttcctaggtcaggatttaagtatctccgttaacgaaaggaaaaggtaatatggagaatatatttggcaaagtatctctgtctctcaaaacaaaaacaaatctttattagaaatgaatttagcaagagggagggagcaatttcttgaagaactctttgtggattgtttaccctgttcctagtgtgagaagcaacagagttgatgatatatagaaaaaaataattcttgcagtgtgctgggaatgttgatgaggatcattcagaaggaaataaaattcttctgtctttatcttaggatcatcatccattgcacctgcaaaatacaggctgtttcgtagctttttccttttaggtagttgctttctatgtggaacatctaaattgagagatggtcctttaatagggaaaatgtactactttgttcagtctgcaaataaagaatataatctgtgatcatcatttaaaactcaacttttggaagccaaggcagaaggattgcttgagcccaggagtttaagaccagtctgggcaacatagtgagaccctgtctctacaaaaaaattagctggtggtgtgtccctgcagtcccagctgcttgtgaggctgagatgggaagaccacatgagttctgcagtgagccctgaaaacaccactgcactccagccagggagacagggtgagaccctgtctcaagaataaataaatgaaactcaactttttttttttttaggtggagtctcgctctgtcgcccaggctggagtgcagtggcgcaatctcggctcactgcaagctccgccttctgggttcatgccattctcctgcctcagcctacccagtagctttgactacaggcgcccgccaccatgcccagctaattttttattttttattttttagtagagacggggtttcaccctgttagccaggatggcttcgatctcctgacctcgtgatctgcccgccttggcctcccaaagtgctgggattacagggatgagccaccacgcccggccaataaaactcaacttttaaaacttcagaaggaaggaattgaacaaaacttgccttgtgaactttttggcttataataaattatgctggacttcaaaggagtcaaacaactaggctaaaaactgggttgatcatgtgttatacttcttcattagttcattattcatttattttgatggggaggtcaagagataattccacttcatagggaacatatgtatgcatttgttttagcctagtggtagggagagcagtagataaaagtagagataattagggaaggggaagaaatggcattatagaaggagaatgcttatttcatgggttcagtagatgtttatgggacttttaaaaattgataaaacattttaaaaggtggtatatgatgaaaagaaagtctgctttccaccacaaactcccagcctttccttaccccaaccccccaatccaagcaaccatattcaatcacatatgtctaggagaaatatattgtatctttcattcttatctttggcatatgaagatctttttgtatttagcacatatttcttacttttttaaaaaagaccgcatgccttgctagtgtagatgaaccataatttattcattttccgtaatttattttaccattttctattgacagatatttaggttgtttttagccttctacaaacactgctgtaatgaacaatacatatataagtctttgcattagttagtatctatacagaatgtattttcaaagtgtgactgtaagattgagactgaagttatgaaaagttaaaactatttcaatcccatgttggctttatttataatagaatttaacttatttcttgggcttgtggaaggggaaaggagctcttaattactttgtattctttatccatctctccatttaaaaaatattgcaaattattttataaggtacttaaaaacatttgagtgtcaggtgattaattttatttgtattggtaaaagtagaaatattgtggtttgaagactggtactgtcatatagaagcatttatatttgataatagttaaatggctacatcttaagtaggttgattgtttcagaattttatgaccagtatcaattaaaagcattgtgtatagtttaaattcttkccctgcataagtcggctactatattattagtcaggaaagaagtaaataatctacctccttttttcctttaccttccacatcctaatctatacataataaaataaacctctatggagtttgagatccaaaaatccttttgcaaactagagtgctatttgatggattactttctcaaggcaggaaggaggtacagattcaatctttattctgcaaagtttttgtaaacagaataaaggaggcttaggtttgatgttatataggttacttgtggccaggaggaggttcaggattctttgcctttttgaaatgagagagacactagagagaaaaaaaaaaaattacatactgaagggctatagtttgatgaagtcggaactcatgagtggcagcttccctggcttgtgcccagggtctattttgagaccttgtcaaagcttgcctgacagaacctaccacataaccataatctggcctggtcctcttgcaagtcaggaaggcctgcggtttaggatcagtggcaagcacagaagggggagttataaaggacattttgccttcagaagattaaggctaggttttggggtgaacaactacttagcccgtatatccgaggatccaagtttttagtgctacctcctcctcccctgcttcttcctcttattaaggaaagctaaggaataaaggttttgtttgtttgtgtgtttgttttgagacagggtctcactctgatgcccacgctggagtccagtggtatgaacacagatcactgcagcctcgacttcctgggctcgggtgattctcccacctcagcctcccaagtagctgagactacatgcatacatcatcacacagggccaatttttgtattttttgtagaaacggggtgtccgcatgttgcccacgctggtctctaactcctgggctcacatcgttcacccaccttggcctcccaaattgctgggattacaagcatgagccactgcgcccgtccaggaggaaagtttttagaaaaaggtgcacaagaaagagcataggattgtgccagcattgatgttatcttctggttatatgagagtgtttgccaagaatcggtcaaatgttttacattagggaaaaagcattattgttactggcatagggagggccccagttaaaatagcagtccaattcagagaccttcgtatttgtcgttaagatcaaaaggactcttggaataatggactatgctacaggattattttaagttcagatagataaattagcttcttcccaaattctcattctgcttttcctgtggtactrtatagtatcatgaagttatatctttaaactcttagtttgtactatgtggtgtcttatgaaaaccttgatttgtttatacttagtgaatgaaacacttgggtttaaagttctttaactgatgtcacttcttaggctagaaagctgttgaaagaacttagtgttccacccttagaccaaggttcatgtcaccatatttaacagcagctttgtattacggtcaagattgtttgaagaattcagcatacaaacttaatttacagatgcaagcctgcagatggacctccccmcccccacttttttgctttagattaggttgtgactggaggaaatttagttttcctttgccttcagttatttgcagctgttcacatttatgatgatgagaatgatgatgatgataatgtatttaggattcagtgtgaggagaaaaaataaactagtttttctttcttccttatcagtttattcccattatcttattttcccttctctgtctctgccttcctttcctcctcgggaaaaaaaagaaaaagaaaagaaataaaaagcagcagtgaaagaaagtggtaaagagctgggaaaagccttggaatacataccagggtgctttctcagaggtggaatataaacaccttcattaaagaatcatggattatctttttccattgttttcattttgaaccctgtatatcttagtgttccttcattaccacattttaactacttttgatataacagatatctttactgctttagggaagcaaatttaatttttatgttactgttctgagcatgttgttccttacatgcccactttcctaagtagaaatatattaacagctasaagaaatcttttggctttctgttttgtaagttagagtataccgtactgtatgcagaggattaggatgttaaaatatttatttccctgttaaatggcttaaatcatgaacaaactgaatatatagcattgctttttttaaaaagtgagtatcccagttaagtgacctaaggattataggactaaatgtagaaaaaaattcagctttagattagatgttttttcccttgtcacagataatgctgtatctaggtgarcagtcaaggaaatgagagggcattgttcttgtcttgccagattcatcctttgcaatcaaataaagtttgttttgtttttaaaattgtggtacaatatagataacataaaatttactctgttgaccttttttaaaaatatttttattatggtaaaatacagtcatttgttgcttaatgacaggaatatgttctgggaaatgcatcattaggtaattttgtcaagcaaacatcatagagtatacttacactaacctggacagtatagcctactacacacctagactatatggtatagtctgtggttcctgggccataaacttgtgcagcatgtcactgtactgaatactataactgtagacaattataacacagtggtaaattttcgtgtatctaaacatagaaaagatacagttaaaatatgatataaaagattagaaaataggccaggcatggtggtgtgcacctgtaattccaggtactcaggctgaggtaggaggatcacttgagatcaggagttctaggctgtagtgtgctatgagcacatctatgaataggcactgcgttccagcctgggcaacatagtgaggccccatctcttaaaagggcacacgtgtataggacagctccattataatcttatgggaccactgtaatatgtgtaatccattgttgactggaacatccttatgcagcacatgactgtgtacataacttaaaatttatcatttaaaccatttttaagtgtacaattcggtggtataaagtacatttacattattgtgtaactatcacctctatccatctccctaactttttcatcatcctaaacaagctctgcccattaaacaatatcacctcatgcccatagcccttggtaaccattgttctactttttgactctatgaatttgtgtactccaggtacctcgtataaatggaattatgtaatatttgtctttgtgtctggctcatttctcttagcatgatgtcttcaagattcatccatgtcatagcatgtatcagaatttcatttgttttaaggctgaaaaatattccttcgtatgtttataccatattgtttaatcatcttttgatagatgggttgtttccatctttctgcttttgggaatagtgccaccatgaatatgagtatgcaaatgtctgtttgagtgccacattcaattcttttgtgtatgtacccagaagtggaattgctagtaatttgataattaccaaatttcatttggtaattctatgcttaatattttgagaaaccaccatactattttccacagtggctataccattttacattaccaccagcaatgcacaagggttccagtttctccacatccttgccaacatttactattttctgttttcttattgattgatttttatttatgttgagccagggtctcactctgtcaccaagactggaatgcaatggcccgaccacagctcactgtagccttgacctcccgggcttaagtgttccttcccacctcagtctctcgagtagctgggagtacaggtgtgcactgccatgcctggctaatttttgtatattttgtagagatgaggtctctccattagcccaggagggtctcaaactcctgagctccgccagccttggcctcccaaagtgctgggattacaggtgtgagccattgttcctggtcccgttttcttttttttttcttttttctttctttcttttttttttttttgagacagagtgttgctctgttgcctaggctagagtgcagtggcgcgatctcggctcactgcaacctctccctcctgggtttaagcgattctcctgccttagcctcccaagtagctgggactatgggcacccgccaccacgcccggctaattttcgtattttcagtagagacggggtttcgccctattggccaggctggtctcgaactcctgactttgtgatctgcccgcctcggcctcccaaagtgctgggattacaggcgtgagccactgcacccggcctgcttgtgcctggccctgttttctaacacaaaaaaatcgattatttttaaaataaaatctctaatagggtggtatttcactgtggttttgatttgtatttccctggtgatgggtgacattgtgcatcttttctttttctcttcttttctttctttctttcttttttttttttttttggagacaagattttgctttggcacccaggctggagtgtagtgtcacaatcatgcctcactgcagcctcgacctcctgggctaaaatgatcctcccacctcagcctctccagtagctgggaccacaggcatgtaccaccatgttcagctgattttcttttctccttctgtttcttttttttttgagacagagtttcgcccttgttgcccaggctggagtgcaatggcgctatctctgctcactgcaacctctgcctcccaggttgaagcgattctgcctcagcctcccaagtagctgggattacaggcatgcgccaccatgtccagctaattttgtatttacagtagagatggggtttctccatgttgaccaggctggtctcgaactcccaacctcaggtgatccgcccacctcagcctcccaaagtgctgggattacaggcatgagccactgtgccttgcctctttttttttatattttgtagagacatgttgcccaggctggtctccaactctgggttcaagcaacgtccaggctggtctccaactcctgggctcgagcaatactcctgcctcagcctcccaaagtgctgggattacgtatgttgagccatcatgcccggctgagcatcttttcatgtgaccatttttgtatcttctttgaagaaatgtctacttatgtcttttatctttttaattgggtttttgttgttgcttagttgtaggagttctttatatcaatcctttatcagctatgtgatttgcaaatttttttttattccgtggtttgcctttttactttttgatagtgtgctttgatgtacacagttttgtttttattttattttattttattttatgttatgttattttaagatggagtcttgctctgcccaggctggagtgcagtggcccaatctcggctcactgcaacctccgcctcctgggttcaagctattctcctgcctcagtctcctgaatagctgggattacaggcatgcgccaccatgcctggctaatttttgtatttttagtagagacgggttttcaccrtgttggccaggctggccttgaactcctgacctcgtgatctgcctgccttccaaagtgctgggattccagatgtgagccaccgcgccctgcccagagtttttaattttgatgaaatccaacttaccttttcttttgttgcttctgcttttggtattatgtccaagaaatcattgccaaattcaatatcatgaagtttttcccatatattttctcctacgagttttatggttttagctcatttgtttaggtctttgatccattttgagttttttcttctttctttctttctctttctttctttctttctttctttctttctttctttctttctttctttctttctttctttctctttctttctcttttcttttcttttcttttcttttttttgtgacagagtttctctcttgttgcccgggctagagtgcaatggtgtaatctcgggctcactgcaacctccaccacctcctgggttcgagcaattctctggcctcagcctcccgagtagatgggattacaggcacctgccaccacgcccagctaatttttgtatttttagtagagacagggtttcactggtcaggctggtcttgaactcttgacctcaggtgatccgcctgccttggcctcccaaagtgctgggattataggcgttagccaccatgcctgacccctgagttaacttttctatatggtataaggcagtggtccccaacctttttggcaccaggattcagttttgtggaaagcaatttttccatggacgggggtggggtgggtgggggggttggtttcgggatgaaaccatttcatctcagatgatcatcaggcattagattctcataaggaacgcacaacctagatccctcacatgcacagttcatttttttttgtttttttgtttttttttttgagacagagtctcgctctgtcacccaggctggagtgcagtggtgcagtctcggctcactggaagctccgcctcccaggttcacgccattctcctgcctcagcctcccaagtagctggaactataggcgctcaccaccacgcctggctaattttttgtatttttagtagagatggggtttcaccatgttagccaggatggtctcgatctcccgacctcgtgatctgccagcctcggcctcccaaagtgctgggattacaggcgtcagccaccgcaccaggctggaagacagtcttatataatgtaacatagttatgggagtagcatcctgtataacctttgccatattctgttggttagaagtaagtcacaggacccacctacattcatgggggaagtaattacacaaaggtgtgaacagtaggaagggcgattagggtggggaaccaccttagaatttgtctaccataactgattacaaaatagcatgttttaggaacttttttttttttttttgagacggagtctttttctgtcatccaggctggagtgcagtggcatgatcttggctcactgcaacctctgcctcccacattcaagcaattttcccgcctctgcctcccatgtggctgagattacaggcgcctgccaccatgcatgcctggctaatttttgtatttttagtagagatgggtttcaccatgttggtcaggctgatctcgaactcctgacctcaggtgatctgcccacttcagccttccaaagtgctggaattacaggcatgagccgccatgccctgccatattaaccaatttttgtttaaaaaataatgttattaaaataggagtatcttcggatggtgggacttactggtggttttattgttattttgtatttcttcactatttcatcccactttccctccctgcaacattccaattttgaaattttaaatcaatagttggtgttttcattataatgaaataaatattgtttactgatcagccatgtrgtatatcatacttgtttcctttcttgtttaactttgttttttcagggagttaaaatttgccttttacatttacataattttctgtttacctgttgctttccccctaaatgcgccaacagatttttcaagagtcttcatctatctatgtatctatccatccatccattctagcttataacatcaatttataagctataaaacgaatttattttgcataaaattagttgtgaactatagagaaatataaaacaaaaatacagttttaggaagaagaatacatgaacacctgtggtctcactacctaggtcaagaaattacatgttacatttatcctagaagtttcctcaagatatcctttaatggcaccccctcccttccaggaaatcacaagcctattttaacatattagtcattctcttgggaccattctctgctcaagcctgcaatatcctccatgtccatacatgtatttttggccaaaatttttaattttgaaaaaccaaaaagctctactacctctctaartctgttagtcaggataggctgaactactttaatgaataattaccaaatcagtggtttttaacacaaaatttatttctcactcacatctttgctgtgagttgaaaagcagtgacagagtggtggtctgttccacagagtcattgagggactcaggctgctttcagctagtgattctrccacccactggggcctcagagactttgaatttcctgcatctggctggcagatgcgaggacaaagagagggactgtggtagattgcatggaaagtttgatgggccaggccaggatgtggtatacatcagttttgtccgcattccactggctagaactgagtcaaatggctacacttaactgcaaggaaggaaagggaaaacgccttggtcaacaatgagccaatctctgccatggtatgtatccctaagaaatatatcattttgttttggaaaactgaatagcaagcatcaactgaggctgtgaaaggaaaggtacatactgctgctattagatgaaagctctcagaagataagctgaaaagagtcttccttgatcttttttggataagtcattgggaaagtttgttattgagtctggagaaacacaggctccccacagtcagggaatctggcaaaactaaagtgtttacaagatactacggtaaatatctagaagaaatgtgattgggagagtagattgctctatgtggttttgcttytaagctaagcttatcacgctttagctctcaagaataaggaaaagcaaaacatgtctgtgctgtgaaataagtcttcagcccatctaggctccaggaactttatcaacacggggtcaagacaaactaaattccaatgaaaacctggaccaggcacatctcatgttaaatggatgtgccccaaaggctgtggggattttggtaatgacagtccttcattatgtctcttgagtcatattgctccaatctgtagctttctttctgagatacacctatcattcttctggaggttcccttttgcccctcttctgtgtttgatttatttcctgtatgctaagtttccctctctgttggtttttcagttttacttgctgaagcctatcttctagtagcttattgacaaagagtgtaaaagaggtaaatttttgagacctttcatgtctgaaaatgcctttaataatcaagtatgaaaaagagggatttgactggtataggctacttatagattgtctataattttccttcaagagtttgaaggcatcactcttatcatcttcttgtttccagaattacttttgaaagtcttgaagccattcttaatcttttatgtgtggcctgactttcctaccctgtggaagcttgtaaagtcatctttgttctcattgtttaaaattcactaagatataccttggtgtgaactcaggacttgtgttgaacactctgggcccttttagtctggcacctcatgttcttaacttctgggaagttattttattaataatttatttttgttttctctctctctctcttctttttttttttttttttttttgagacagggtctcactttgtcacccaggctggagtacagtagcatcaacatgactcactacaacctcgacctcctgggctcaagcgatgctcctgcctcagtccccaccacgcctagctaatatttgtagtttttgatagagatgagaggaggttttgccatgttgtccaggctcgaactcctgagctcaagggatccacctgccttggtctcccaaaatgttgggattacagacatgaaccaccgcacccagcctgttttctctttctccagttatttgaacgttrgtccctatggactgatactttaaccttatatatttttctttcttattttctacctctctctcttttttttttttttctgttttctgtaagacttcttgaactttatttcccaacctgagttttgtaaaactaatttttttattgaggtactactcgtgtgtcataaaatttacccctttaaagtagtgaccttttcagtggttttttagtgtagtcacaaagttgtgcagccatcagccctaattccagaaggttttcattacccctacaaggaaacttcataccatagcagtcactctccatttcctctttacccgagactttgtggaaagcactagtctgttatactttctgtccctatggatttacctrttctggacattttacataaatgaagttattcaatatgtaatctttgtgtctggcttttatcacttctcatgttttcatgattcaaccttgttgtatgtagcacgagtcaatactttattcctttttttttctttctttcttgaaacagtcttgctttttgcccaggctggacggagtgcagtgatgcgatcttggctcactgtaacctctgcctcctgggttcaagtgattctcatgcctcagcctccaagtaactgggattacagatgtgtcccaccgtgcctggctaatctttgcttttttttttttttttttttagtagatggggtttcaccatgttgaccaggctggtctccaattcttgacctcaagtgatccacctgctttggccttccaaagtgctgggattacaggcgtgagccatcatgtcaggcccaatatatttgtttttatggctaggtaatattccattttatggatatgccgcatttgcttatccattcatcagctgatggacattggaattgttttcacttttggctgttaggagtagtgctactgtgaatattccgttacaagtttttgtgtgggcataagttttcaattctcttgagtatagagtggaattgattatttctgttgtgtttttaatttctactgtcatgttttaatttccaagatcttgtattctctgaatttttttttctttttttttttgagacagagtttcactcctgttgcccaggcttgagtgcaatggcgtgatctcggctcactgtaacctctgcctcctgggttaaagtgattctactgcctcagcctcctgagtagctgggattacaggcatgtaccaccacgcccagctaattttgtatttttagtagagatagggtttcaccatgttggtcaggctggtcttgaactcctgacctcaggtgatccgcctgcgtcagcctcccaaagtgttgggattacaggtgtgagacactgcgcccgaccctgttctctgaatattttaatagccccttgttcttgtttcatggctataatttgccttaattttctgaagatattaatgatggttatttttgaagttttcttctccctgcgtagtttattttcactaagttattcttctgagttagtgggttttcacagacttcttggtttgaaagtaggtggggttggtcaattttgacctccctcgaaaaggggtatatattttggtagcaggatgggtgatttaaagggggctgaagcagtcccacatttcaaaatgcatactttcacctaagcccacacttcctactccctccctgttcccattgcttacccttcccttccccagagcccctttgtcttctagaacttctggtrtcctggagaataggagatgaagttgaagctgaggtaatagcctagcaatggaaaggggacctggaggtctaactacttaattaaagacttttaagtgaatttttttttttttttttttttttttttttttgcgcatagggcttactcattgggctcaagcaatcctcctgcctcarccctgcaagtagctgggactacaggtgtgagccactatacctggctaatttttgtgtcaaaaccccagctgcctttttttcctccccttctttttctttccttttttttttttttcttccagaaattgagaaactcaggctgggtgcagtggctcacgcctgtaatcccagcactttgggaggtggaggcaggtggatcacctgatgtcaggagtttgagaacagcctggccaacgtggtgaaaccccatctctattaaaaatacaaaaattagccaggcgtggtggcacatgcctgtaatcccaggtattcaggargctgaggtaggagaattgcttgagtcagggagaaggaggttacactgagctgagatcgcaccactgcactccaacctggccagcagcgagactctgtcaaaaaaaacaaaaaagagaaagtaacaaactcattctaaaatttatatgggaatgtaaagggcccagaatagccaaacagtgttaaagaacaaaaaatttggaggactcactttttccaattaaaaaatttactgcaaagctatgtgaatcaagatggtgtgatactggcataggatagacatttagctcaatgaaatagaattaagtatccagaaagtaaacccttacttttatggtcagttgatttttgacaagggtggcaaggtaattcagtgggagaaacaatggtcttttcaacaaatgatgctgggacaaatagatatccatgtgcaaaagtgtgaagttggatccctgtcttataccatatatgaaaatgaactgaaaatggatcatggacctaaatataagaggtaaaactgaaactcttagaagaaaatgtaaaaataaatcttcatggccttgaggtaggtttcttggatatgacatcaaaagaagcaacaaaagaaaaaaatggataaattggacttcttcaaaataaaaacttttgtgcttcagagtaccttctctctggtctctttacttttattttcccagtattctcttttgcctactgagaaggcagtgacagtgctatataaatagtgccttgcaaattctcagtaaatatttgttgaaaagggaaaaattaaaggtatgtgataggttttactttatgaaaatttctagctttagagcctccttcatattaattgcatttttttaatattgaaaaattatatccttgttacatgtgttcccatttcccttactttttgtttcatcttgattctttggttctttgctacctaggcttatattgttctttctaatacttctagtcttttcctgttttctgctttatttcatacttttttttttttttgagaggagtctygctctgttacccaggctggagtgcagtgatgcgaccttggctcactgcaacctctgcctcccaggatcaagcaattctcctgcctcagcctcccaagtaactgggattacaggcatgtgccaccatgcctggctattttttgtatttttagtagagatggggttccaccatgttggccaagctggtctcaaactcctgacctcaagcgatccacctgccttgacctcccaaagtgctgggattacaggcatgagccaccgtgcctggcctgtttcacacttttaagtctttcctactctcagcaatatgtaattgttggtctccctttcttttatactctgattgtatgtccatacatctctgagatactttaaaaggtatcaagaaaggaggctatttgaatggtactagaaagtggtttgcttctcagaaaatacggataagtgaattgtttagtctatcttcctaatttgggttctgcacagttgatgaaatagtataaagatttatgtccaacatatagcccattaatgttcatttatagaataacataactaccaagtaaagaaatgcaaccactggcatgttatatgaagggaggaaatggaaagattatcagttgtgttggagayatgaggatagtgggtagtcaaaatatgatactttaaaaatatttttgataattcttaggacaaatgactataaaagtaggagaaataattatataggttctcttcctttgtaagcatttctctttataaagtatgagttgtaagttaaccattatagtttctaatgttcttctgacatttagtttgtgtttagcatttgcctttccttgttttgccaagttctccagttttgcctgtatatatttttttcattttgtactttgcctcaatttctgaatgtaccttctatattctttctgtaggttttgctaatgatttattcattttatgtaacgatctcatttagatatttgcaggattgatgtctttaactgtaatccctccctccttcctcttttcccctctctctcctccctctccttcttaattgtcttcctctccctttactttccttgttttcctcttctggttggagccattttctgcctgcccataatctttattttatcttacttttttgagacaaggtctcactctgtcatccaggctggagtgcagtggtgtgatcaaggcatactgcatcctctacctcctgggttcaagcaatccttccacctcagccttccaagtagttgggactataggtgtgtgccaccatgcctggttaatttttgtgttttttgtagagacagggtttctccatgttgcccaggctggtcttgaacccttgggctcaagtgatccgcctgcctcagcctcccaaagtactgggattacaggcatgagccacagtgacctgccataatctttattttgtttgtttgtttgttttgagacggggttgcactcttgttgcccaggctggagtccaatggtgcaatcttggctcactgcaacctctgccttccaggttccaggaattctcctgcctcagcctcccaagtagctgggattacaggcatgtgccaccacgcccagctaattttgtatttttagtagagatagggtttctccatgttggtcaggctggtcttgaactcccaacctcaggtgatgcgcctgccttggcctcccagagtgctgggattacagacatgagccaccacaccccgcataatctttatttttaatgtgtatgtaactactaggtattcttcagtgctatgattacctctgccttccttttyttttccactctagatttttaattgcaattcctaattcccatgcctttttttcacctagtcatccacacttcttttttttttttttttttttttttttttttgatactgagtctcgctctgtcgcccaggctggagtgcagtggcgcaatctaggttcactgcaagctccgcctcccaggttcacgccattctcctgcctcagcctcccgagtagctgggactacaggcgcctgccaccacgcccggctaattttttgtatttttagtagagacgggggtttcactgtgttagccaggatggtctcgatctcctgacctcatgatctgccagcctcagcctcccaaagtgctgggattacaggcatgagccaccgtgcctggccctagtcatccacatttcttaagcagttactctttccccaacattttattataaaaaattaaaaaaaaaattttttttaaagatagagtttcactttgctttctaggctggtctcaaactcctgggctcaagcaacttgcctgcctcggcctcgcagagtgctgggattacaggtgtgagccaccatgcttggctgatgataaaaaattttaagcatagcccgagcatggtggctttcgtctgtaatcctagcactttgggaagctgaggcaggtggattgctcgagcccaggggttcaagatgagcctggctaacatggtgtagccctgtgtctaccaaaaatacaaaaattcgccaaatgcagtggtgtacgcctgttgtaccaggtacttgggaggctgaggcaggagaatcgcctgagcctgggaggccgaggttgcagtgagccaaggtcgcactattgcactccagcctgggagacagagtgggagaccctgtctccaaaaaaaaactttttttaaacatacagaaaaattgaaagagttgtgctgtgaacactcatgtacctaccatctggatttcatcattttatcttttgttgttgcagtttaaagtagcagatctcagtacacttcaaccctaaatattttagcatgcacatgattggctagagtttaatatttgtgtagaggacttttttcttttgaggtaaaatttacatagaacaatatgcaaatattttaaatagaacatttaatgatctctatcttctgtttcaagtcacttgtgttctactaagaggactagcataaccattgtaaggctgcactcccaaaacttggcagttttagaagtaaactttgaatacaaagtaccttaaaaatttctccttttttgtttttattgtatacatgtgctagacagcaaaatgattatagtcaaggcatttattttttccaaattgttctatactatagcagaaactcttagcatggtttaatgctattagacagtgcatgctggaggaaatcgaggatatttttgtttagttaaaagtatgaaaaggattgctttttttttgtcaatttcacaagctaaatatgcaaaataggtagttaattcaaaatgctttaaatatttatggagtgctttatagtttattaagtgcttggatttttcttaattcatttgagcttcacattaaccatgttatatcagtgaaactgataaagagatggaggcttagaaagtggggagggtaacacaggaagtggtagtgcaatcagttgaacttggatcttctcattttaagttttgtcaagtggcaacaactgcagtcacactaagtctttagttcagggacaattccatatactgggatttgtttatgaataactatgaaatgttttcttgtgcagactagcgttcactgtaatggcagctgtgatgcaaagacatactaggacaatattttgaattctccatgatgcaatacttagatataaaagaactatctatcaggatccagattaggcacagaactttctaagtgtcctgtatttagaatgtgacatactgatgctacatgcacattctgttcttacaaaagtggacaatatcatgattgaagtgccacttttactgtggcaaaatgcctattgtttcagacgtatattatatgagaagctcattggagaagacaaagccttattgaaatatctgtctgttttggaaggtttatattctgcaagatcctgaagatactttccttcttttctgtaagtaaaatatgtcatgacaaaaccatctggggaaaatcaacttgacactatgtgggtaaaggacttgacaaaaatacaggcagttttgttcttaccaattgaggaaaaggtttagttctttaagttgtttgataccaccaaggaaacactggaaggagttaatgtgctcctgaagaaaagkgttcttgaggaaaccttagggtagaaatttactgcaagtcctttaggatcagaaacaaaattatttaaggtttcctttgagtctacattctcagttttgtcattttgttgaaaagtttcccactggctatgttaagaatcgtattcctttcaaggtttcctccatcactgatacagaatgacctggagttactagaaaatagattgcatgagaacggaaaaacctttcatctttccttcttttttttcttttttgagacagggtctccctctgtcacccaggctggagtgcagtggtattatcacggctcaccgtaaccttgacctcccttggctcacatagtcctcccacctcagcctcccaagtagctgggactacaggtgttcgtcaacatgtctggataattttttttttttgtaaagacaraatttcaccatgttgcctagtctggtcatttttctaatattggtaaggaaatctgcctacagggtccaaataatacagttcttttaaaagtactaggttatcctttgaactaggtagtccttgatctgcatcatgtgaactgaaaaaggtaactggacctggccaatcagtcatataaaaacctaggtgttctctgtagatatgacaagaagaataaggaagatagacaggaagttcttcctatttcctgcttatcctgtgctgctttttcctgtcatctctttctcagggctgtctattctggagcttgttgaaaccattttgtttggaagcaattttaagaaagaataattttttacataaatctgtggtccaggaatactctggcaggtctaaggcataggcattgttagttgagaaggaaagaaaatggatcatgggggtagaggagaaagaaaagaaagaagtacattcaaaagaatgctaccagaagtggtttcagattagtgtctcagtagtatggcatattatgtttaattttgatgtgatccagttggggactagtttattttttgagccttagattggaatgtttttatttttatttatttattttttgagatagggtctcactctgtcacccaggctggagtgcagtgatcatggctcactgcagcgttgacctcccagggtcagtcagttcttgcacctcagcctcccaagtagctggaactacaggcgtgtgccaccatgcctggctaatttttttaaaatttttctagagacagggttttgcccaggctggtctcaaactcctatgctcaagcagttctcctgattcagcctcccaaagtgctgggattattagatgtgagccaccacgcctggttttaaaatgcatctctttttccttaatgctattgaaattttagagaattaagaaaaaatgcatccataatcctatcttcctaaaaaaaccactgttaaactattgatatacttccagccaaatctatttttattctctaatgatttttatgtgtctggaattagaaaatgcttacatttttgtttcctgcttctgtgaaatatctttcattgtgtccttggaaagctgactgatggacaaatattggatgataccatagtgcattcactaaattgtcaatctagtctgaaaaggaacattgcattgcatgttgcttatttttagtagatggctaatatttgcatgcaccactaccatttttttaaaaatttcatttcggtcatgtggctcatgcctgtaatcctagcactttggaaggctgaggcgggcggatcacctgaggtcaggagtttgagaccagtctggccaacatggtgaaaccccgtctctactaaaattacaaaattagccaggtatggtggcacacacatgtagtcccagctactcgggaggctgagacaggagaatcacttgaacccgggaggcaaagactgcagtgagccaagatcatgtcactgcagtccagcctgggcaagaaagagcgagactccgtctcaaaaaaaaaaaattatttcaatagtttttggagtacagatggtttttggttatgtgggtaagttctttagtggtgatttctgagattttagtgcacctgtcacccaagcagtttatggtgtacccactgtgtagtattttactccttacccagccgtccttgcccccaccaccaagtccccaaagtctattatatcattcttatgcctttgtgtctgtatattttagctcccaattataagtgagatcatatgttacttcacttacagtaatggcctccagctccatccaagtcactgcaagagacattatttcattcatttttatggctgagtagtattacatggtgtatatatatcacattttctttatcttcttgttggttgatgagcacttgtgttttttccgtatctttgcaattgtgaattgttttgctataaacgtgtgtgtgtatgtgtctttttcatataataacttcttttccttggtagagacctagtagtgggattgctgaatcaaatggtagttctacttttagttctttaagaaatcttccggccaggcctggtggctcatgcctgtaatcccagcactttgggaggccgaggcaggcagatcacccgcctcctgaggtcaggagttcaagaccagcctggccaacatggcgaaaccccgtttctactaaaaatacataaattcgctgggcatggtggcatacgcctgtagttccagctacttggaaagctgaggcaggagaattgcttgaacccgggaggcggaggttgcagtgagctgagattgtaccactgcactctagcctgagtgacagagcgagactccatctcaacaaaaaaaaaaaaagaaaaaaaaaagaaatcttcatattgttttccatagtggttgtactagtttacatttccaccagcaatgtatacactgttactattaggtaagtgaataatctttaaaattatgctgaagatgattagagacctctgagaaaagttttctgtccttatcaggagttgttctgatttgtatctgggatatatcagctgctacattaagaagtaccttttgtcatgttcccttttttttttttgagatggagtcttgctctgttgcccaggttggagtgcagtggcacgatctcggttcactgcaatctccacctcctggattcaagcgattctcctccctcagcctcccgagtacctgggattacagacatgtgccacctcgcccagctaatttttgtatttttagtagagatggggtttcgccatgttggccagactggtcttgaactcctgatctcctgtgatttgcccgccttggcctcccaaagtgttgtattacaggcatgagccaccatgcccagctggtgtttccatttttaaatgagttcttaataatcatatccagatatatcttctctagtgaagtaaaagtaataaaccatcatcagtctttattctggtggacagaataacaagctagctctgatgaatgagaaatggtgtcagataagttgggaatgtcctgaatctttattggagaaaactttttggtggaatagttctgctttatttagccggaatcaactaaattccagtacattaaagtcacttagaatttcagtatagccaattgtgttaggacagacttacttgagaatttctttgtgattcatactgtaatgaaattttgctggtttattttgttaaagcaagtcaaaaattttttaagttayggaatatttagctaaatgagctatacttcttagcaatgtgtatagaagaaaagagggcatgaaatttgggttgcattctttcatggtaatctttaatctcaaataccatctaaccaaaggttagatggtctttttcatccttattatttaatcctggtggatgggtttttcttcttccttttgttaaaataggtctaataagtaatagtaacaggttcatagatatattcttttttttatatttcgagaaggagtttctctcttgttgcccaggctggagtgcagtggtgcaacctcggctcactgaaacctctgtctcccaggttcaagcgattctcctgccccagcctcccaagtagctgggattacaggcatgcaccaccatgtcctgctaattttgtatttttagtagagatggggtttcaccatgttggtcaggctggtcttgaactcctgatcccaggtgatccacctgctttggccttccaaagtgctgggattacaggcgtgagccaccgcgcctggcgatatattcttaatcatttgactatatcagttttcttcatcaccgtacctttagcacctcctatagtacctggtaacaacatggacagtgttggttattgttaattgcagagtaataaaccttcattttttcttttatatggttgtgggttttttttgtctgtttgtttttgtttttttttgaggtggagtctctctctgtcacccaggctggagtccagtggcgtgatcttggctgactgcaacctccatctcctgggtttaggtgactcttgtgcctcagccaccatagtagctgggattataggcatgcgccaccatgcctggctaatttttgaatttttagtggagatggggttttaccatgttggccaggctggtctcgaactcctggcttcaagtgatctgcccacctcagcctccccaagtgctgggattacaggtgagagccaccgtgcctgacgttgtcatggtttaattggaatttttcttaaattacactaaaaagcaaagttacttttgtaactataaggcttagtagtaaaacctcttgaacattttcttctaaaagtttaggctgaataacttctgaaatgtttttcattctgggatggaaattggttttagaaataactatagttatttatttatttatttatttattttgagacagagtcttgctccgtctcccaagctggagtgctgtggcgcaatcttggctcactacaacctccgcctcctaggttcaagtgattttcctgcctcagcctctagagtagctgggattacagacatrcaccaccctgctcgkctaatttttgtatttttgatagagacagggtttcaccatgttggccaggctgcccagctatagtaattttaaatggttaagtagaatttctgctgatggcagctttctgaggctaatattataatacacacagattgctgtgggtagcatagtgaaaagaagtagragttttagtaattagtataaaattaaatattctaaaatttattggaataatttggtagtgggaagaggtatttggtgactaatttctctgttaaaagtgaatatataaatgagcatgaaaattgcacaaagaaataccttaagttattatgtttttgtttacttcagggctgaaaacacagttaaatcactttcaaagttaaaagactattaagaacacaagatggggactcctgcttctggaaggaaaagaacacctgtgaaagaccgattttctgcagaagatgaagctttgagtaacattgccagagaggtatgtttggtaaatcccctctcaacactgagttgcacagatgtattgtaaaaatgccgatttgacagagatatagacgtttactcattgaactagtttcagatgtttattatgagcaagatgttatagctagtctctaaaatagtgtgttagaataaaatatagttggatattatcaacagaaatcaaatatagagatgaatctctgaacaacacattttatttgagacagtagaattgtaatttgggcatacacacagactgcattggtctttggtatgtccaaagaacaaagaaaagattgaggtttttattagagaaatgttatgcattgttttgaaagaaaatgcattggcactagcgaagtttttgggagctggcatgctctgatttgtgagtgactgtggtaggtaaaactagtcttagagttatagcagttcgtttccgcagctactaggtaaaactgatcttaaggttatagcaggtcatttcagcagctggcttgccagataatccctgggcaggtgcttgtgccctaagtgcttttcttttccttttcttcctccctcatctcatgactgtaatttaattgggtatgacaagataattccaatttatataatcaattttcacaatatccaatgcatccaaaattaatttttctttatatttttatgggttacttgagttccatgtacttgttataatgtattgaagtttataattaatctttcgaatgtaaacttaggataattagaatgttgaagatatgatgactatattatagaaatactcattgggctatgcagttaatatgcttcagacgtggtatgtaaatgttgatggaaacaatatttcatgtcggttcagattcagtgttttattttttgaaacattgcagtggaatttttatgtttaattctgttagctggtaacagaacttctggggcaattttgtttcagtttgttgtaactcagaaaaaagaaaaagggaaggggcgtcacctattgaatcgctggcaacatttcctgccgtatattggaaatttaagatgactgccagctgggatttcttacttaattgccaactttgtttcagactctatctgcaactgcagactgaccacaaactaatatggtataagaattgcttagagcatcattaaattatattcttttggtgagaattattaccatatcacttcctctttgttattagtaaataacttatttaggaatagtgtatttccttttgacacattacacacttttttgatccagctcattgttatgattttccttttggaagctgctcagttagcttttgaattagaagtcaaatgctgtaggaggctatttgtagcaaaggaaagttattacctaaaacctgataagaaattgtgatattactataacaaaaatacattaaaaatcaatgagagcgtttgggttgattccatgtctttgctgttgtgaatagtgctccagtgaacgtacatgtgcaggtatttttataatagaatgatttatattccttcaagtaatgggattgctgggtcaaatggtatttctggttctaggtctttgaggaatcaccacactgtcttctacaatggttgaactaactaacattctcaccaacagtgtagaagtgctcctgtttctccacagcctcgtcagcatctgttgtttcttgactttttaataatcaccattctgactggcgtgagatggtttctcattgtggttttgatttgcatttctctaatcagtgatgttgagctttttttcatgtttgttggctgcatacattgcttcttttgagaagtgtctgttcatgtcctttgcccactttttaatggagttttttttttcttgtaaatttctttaagttccttgtagattctggatattagacctttgtcaaatggatagattgcaaaaattttctcccattttgtagcttgtctgttcactctgatgatagtttcttttgccttacagaagctctttagtttaattagatcccatttgtcaattcttacttttgttgcgattgcttttgaacatgaaattttttgcctgtgcttatgtccttaatgacattgcctagattttcttctagggtttttatagttttgggttacatttgagttacatcaactcaaatgcccatcagtgatagactggataaagaaaatgtggtacatatacaccacggaatattgtgcagccataaaaaggaactatatcatatcctttgcagggacatggatggagctggaagccattatcctcaacagactaacacaggaacagaaaacccggcactgcatgttcgcggggaaaagtgggaggggaacaatgagaacgcctccccccccacccccccaaaaaagaaagaaaataaggatctatccttgctaagtaagtggtcaaaccatggtagatatattatctgaatagtttgggttttctattgtgaggtgattattcagataatttagtttaattttataagtatcaagagcaaaggtaagatttagtacagttgtaattggatcctgatatattacttaatcattatttcccaaactgtgtttcttggagcatgacccttgaagtatcatttagggtttatttagtaatgtggtcaagtctgagaaatactatatattctatcctcttctttgagattcataatgcatattattaaggactctgattttaaaaaatgtttaacttagcattttccaaacttgttattaataggttataagctcccctttatcccattttatatattaagttttatgtattagaattttatatattttagtatttatttagcttaggcatttttgatgcattcagtctcatctatttaaaaaatttaaattgagatataattcacataccatcaaaactattcaccatttaaaaatattcagtagtttttaatatattcacaaagatgtgcaactgtcacctacctaattgcataacatttcatcagcccaaaaagaaacctcataccacttagcagtcactcctcatcttccccttccccagcccctggcaaccagtaatctactttctgtctttatgtttttgcctattctggacatttcatataaattgaatcatgcaatatgtgaccttttgtgtctggcttctttgacttagcaaaatgttttcaaggttcattcatgttgcatcctgtatcagtgttcgatttctttttaaggctgaataatattccattgtatggataatctcgctggtttattcgttcatcagttgatggatatttgggttatttctactttttggctattgtcaataatgctgctatgaacattcatttacaggtttttgtgtggatatatgttctcgtttctcttaggtacatatttagaggtggatggatggtatcactgtgtttaacttttgaggaactgcctcagcagttcacacagcaattgtgccattttacatttacccctgtaatatatgagggttctaatttctccacatccttgccaattttagttattttcagttgaaaaacattttttatcatagcaatcctagtggatatcaagtatctcaatatggttttaatttacatttctttaatgactaatgatgttgagcatctttttatgtacttattggtcatttttatatcttctttggagaaatgtctatttaaatcctttgctcattttaaaattatttatatttttattgtatctcatctacttttctcaaattccaaaagaacataatacaaaattatgatggtaaaggaagtatctaatgtagaaatacataaaccatagtacatgtttagttctcttttcctggaagttctttttttttttttttgagactgagtcttgctctgttgcccaggctggagtgcagtggcataatctcggctcactgcagcctccgcctcctgggtgaagcgattcccctgcctcaggctcgcgagtagctgggattacaggttcacgccaccatgcccagctaatttgtgtatttttagtagagacaggatttcaccatattggccaggctggtcttgaactcctgacctagtgatcagcccgccttggactcccaaagtgctaggattacaggtgtgagccaacgtgcccagcctttttttttttttaaacagtaatttaaagtttattccagctataatgcaggttattctgactttaaggtagcatcatatggcattcttctgagtccattcccgagatattctgttgtacttttacgtctgtctattttatggatccgtgtgctctctggcactagggggtcatctgggtttggatcacatagcagtgaacaaatggataaaagaactttagaaatagttttaaagcaggcaaccactgtgatcttagaatatcgagacaaatgctgccattactgttaatatttggatgacaaatccttgttgtacaygcaaccttaggtggtttgaaggagcagtctgtaggaaaatgaattgccaaaaagaatacaccgctttgatatgggctgtcattaggtcccataattgtggcttgccaatgaaacataccatcctcaactggacctgcagaacattgtgctggagggtcatgggccaaatcactaagttccttattaatctgtcttagtgccatagtatgtgcttgtcatctggctcctcactctcycggtatgtgctcaaaagtctggccaaaactcctggttatcccggaggtgggacagcattgtctcatctcataccggctctgccagacacaagctcttggtattgtggagacgactctcatgacaactttgtggctggctaaccagagctgtagctttgcaatgacttaagagcagttttttgtgctcttccgaatggggttccacccccaaatccacaaattcttgcgagatgcagtgaggtaccggctcgaactggagcaggccaccgccaggccgagaagttctttcttagtgtccattatgtgattcctaattattcattgagtgatacagtgaatattctacaaatttaaaagttctgtgagtttaaatacaacctaatgcatttgttctgggagtgatcaaagcccatgattttcactgtctttttttttttttttttgagacagagtcttgctctgctgcccaggctagagtgcagtggtgccatctcggctcactgcaaccttcgtctcccaggttcaagcgattcttctgcctcagcctcccaagtagctgggactacaggcaagcgctaccatgcctggctaatttttgtatttttagtagagatggggtttcaccatattggccaggctggtgttgaactcctgaatttttctgaatttttctgaatttttatattaactttattataacagttggggtcatatcagccgaaagactctaaaagtatttaaataatttaggcttctgaatacttctaatttatatcttattctgacttttaaattagccaacttcttttggtaaaatatatgtaacatgaaatttatcatggtaactatatttaagtatatagtttagtggcattacatccatttgcattgtcatgcagccatcaccactatccttaagaactctgtcatcatccagtactggaactctgtactcattaaatagtragtcccatttccccctaccctcagtccctggcaaccactattgtgctttctgtctgtatgaatttgactattttaggtttctcattaagtggaagtatacaatattactcctttctgtctggcttatttcatttagtataatgtcttcaagattcatccatgttgcagcatgtatcaaaattttctttttaaggctgaatgatccaaagtatgtgtataccataatttgtctatccattcgtccattgatagatatttgggttgtttctgcattttgactgttgtgaataatgctgctatgaacattggtatataaatatatgttgtctctgctttccagttcttttgtatatgtacccataggtggaattattggatcaaatggtaattgtgtgttttagccaactttattttgttttgtttgtttgttttctgagacagagtttcactctgttgcccaggctggagtgcagtggtgcaatcttggctcactgtaacctctgcctccagggttcaagtgattctcatgcctcagcctctggagtagctgggattacaggcatgcaccaccacgcccagctaattttttccatttttagtagagacgggatttcgccatgttgaccaggctggtcttgaactcctggtctcaagtgatctgcccgccttgtcctcctaaagtgctgagattacaggcgtgagccaccacgcccagcctttactgtgaatttagttaaatcttggttgtcctttattgttatatcccatttattttgtatgtatgaggtgtatattaaaatgaatctgtagcagctctttatctgattgtattctgaggtaaaaatgctagtgttaactacctagaagtatgttttatgtacccataattgtctattcaaaaataattttaaaatatatcacaataagttatagagcatatatttcgtctactaggttggaatcagtgttggctccttgctactcctgcttrtccatgttgcttcaagcatctagtaataatgtatagaaagaaccagataaagtagttttaaatcctgtttatttcttttaaagcatgtggttttaatggcctctcttcaacacagtctccaagggaggtaacatctgagttggctaagtaacaaagggaagggtgtttgtgtgtctctgaagcccatgttctttctgttcctttcctttttgtagttaaaaatgtcttattaaagaatagattttaattatctctaagttgggttttatgaaggaagtctcattttagtatatatagattgtacagaattggccacagacaaatcttagaaggataaaattagcattcttgaattaaatttctaaaggaggcttcaggtacaatttaatatacatgtaaatgaaaattcctacacattgatagggctttcttaaaaaggtttgraagttttgatgctttgtgattttaaaatacatttgctatctacttaagcttaaaagccttgaagtgtttcctattaaaaaaaaaaaactctaataagaaactagtgtctactcatagaggggtgaagaaggcagataacttgaagcagagcataggttttgaaaagacggaggccagtgtaaaattcatgggagaaaactaatttctctagattgttagtggttacagcttacggttggtagattacaatttactttgcaggggtttttctattaaaagaccagttacacagactgggaaattgccacaattggaatagttgagtagcagttaactatttaactctctctgcttcttagaagcctgctgtgactttgccaggcaaaactaatttctccctcctacatgcttccttcccataagcattgtgtctctgtattcttcaactttgtgagctgctttagggcagagatgtcatactttactctgtattttcagcacctagcataattgcttaatgtagtagatccttttaaacattggttgagtttattcttactatgagacttgggcacgaatataacaacatgggaagacaacaactatagttatcagaggggatagtctgaatcagagttaggatgtgaccaaggacagaggaaaccattccactaccatatagaaagcagacagaagatttctaagtttcatgtggcacattaagctatttccttatctcatttccttgatactgtgacctatgccctgcaattcatttgtttttttttagcagaccttgaggcataaaagttgtggggtgagagaagcatggaattttaatacaacataataaagccgcaatagagacatgggtatagagccttactttatgaaagagggactggggagaatcttcatagaaggtaatattttactgaataagagaaaggagaacagctcctgccaaacagtttgtgaagagaggcgtaacagaacacaatagagtccaggaatggagagagatgggatgcacccagtacacgtggagcaagtagagtagtccccacccctccaatccatgggagatacattccaagccccccagcagatgcctgaaactgtggatagtagcaaacctgattgccatcaatcagaacacatttctattcatgttttccacctacaaatgtaatgccttttccatcttaactatcatgcactgtggctgtaacttttgccgtttgaggtgcggcagcaaaactagcacaaatttctttttccttcttcacaatttcatggatagaagatttgttcttaccatagatcttagcaacctcagtgcatgattcttttttctattaaggtagaacgttcaccttttcacttaaaggaagcactgtgtggcttctctttggcatacctgaattgtcagaattactcttgctctttggggccattattaaataaaatgaggattactccaacacaatcactgtgatttgataactgagacagctaacaaatgggtagcatagacaggatggatatactcgacaaagggatgattgacgtcctgagagattttatcatactactcagaatggcgtacaatttaaaacttatgaattgtttatttctggaattttccacttaatatttttgtaccttggttaaccatgggtaactgaaacaacagataaggggggaactactggacttggaagtaaggtggggacctgactgtgaggagccttatttcagttttacctttcttctttctgttcctccctttgtgctgttctgtggaatttttgctttaaccataagtaataaggagttggtggaggattttatgcagtggaatgatgtgatcagaaataatacattttgaaaggctgatttgtccatcatataaccatgtagaagataaattataaggcagattctggaagtaggcagatggatttggaggtaactgtaagcaagagatgaagaattcctatggtatgattccatgtatatgaaatgtccagaataggcgaatgcatggacacagaaagtagattagtggttgccaggagctgggagaaagggttaatggggaatgactactaatgggtaccaggtttcattttggggtgtgagaatgttctggaattagtcatgatgattgcacatcctgtgagtatactaaaaaccacagaattgtatacatttatttatttatttttgagacagcgtctcactctgtcatctaggctgcagtgcagtggcatgatctcagctcactgcagcctccaccttccaggttcgagtaattttcctgtctcagccacccaagtagctgggattacaagtgtgcaccaccacacctggctattttttttatttttagtagagacagggtttcatcatgttgcctaagctggtctcaaactcttggcctcatatgatcctcctgccttggcctcccaaagtgctgggattacaggcctgagccactgcatccagtcggaattgtatacatttaaatagtgaatttgatgatatgtgaattctgtctcaattttaaaacagaggtggggagtggggagatgaagagttcctgaaatgagcaggaacagtgagaataaagaaagctgagatgggtttgatagagactcagtggtagagaattgtcagtacttggagactgattattggcagtgtccaaaatgaaagagaggttggctctgaagtttctagtttatatgattgaatcaatggggaaaaaattctggaaaaagagtaagtttggagaggcatataacaaactgtatgaaatgtgttgagtgtgtaatcaaacaagaagttaaaggtaaaggcccggatttgaggaaagacttaggaactagagaaagaaatgagtttataagagttgattaaaacaatcaatcaaacttgcttgctgatagataatatcttstcctgcccaccccttttgcgtggtaatgtcccrttctttattttcaaatctggtgtacaggttgtttttgtttttgttgtataaagctgagttttatattacttttcaggcagaggcaaggctggcagcaaaacgggctgcccgggcagaagcaagagatatacgcatgagagaactggaacgacaacaaaaagaggtaatttgagggaataaccctaatttcatatttgtctcccccaaaatcagtacttggctagtttattctgatgtgaatctggtttcctttgaaacattgaaaatagtataaactgatgtatgtattttatcaagccattctgtgccagcaaattaaatgtgatatttgttttaagtagtaacaacaaacacatttatagctattatcgtgtccattgttataagttactagtattatgagtgcttcacttacattagctaargtagctttagcaatgacaaagtgtagtatagctttaattgtcctaaaatttggattaattatattatgatatctatatagtaaaacactgtaaagtcattcagacttacaattttaaaacatatttaataatagaggaaaatatgtaagaatatgagataaaagcaaaccaaaacaataaaatttgtaggaccccaattttatattacaaaaaccagtatccatatatagcatcaaaaaactactagaaggaagtgattattaatactgcagtttgtctatggtggaattattgttggtttttctttctttctatacttttctataatttacaaactttcagtatacttttatcagaaaggaaaacaagaaaaaaatttttaagaataggcatatggaaattgggctgattaaaatgaaataaatatgcttttacttttctgacattgacttggtcctgaaaattcccataataaatatttttgatgttgtagtagtatgaaggggcaaaagcctatgggacagtattaaacactttcttttgattttggtggtgaattttctgtgagcaggttaaaaagcaatgtaaatattttatattgtcacagctcaagaaaaacactaacaattgacatgttgctaattttcttttaacctcatgtatagtttcaaatatggaatgcagttcttgaagaggaagtgttgcaatccgttgtctttttactcctaaaattatactaaatataataataagtggataagctgaagtggaggatcacttgagcctgggagtttgaagttgtagtgagctatgatggcaccactgcattccagcctgggcaactaagtgagatcctgtctcaaaaaaataaataaataaataaataagtgaatgagacagttattaaatgtaagttctatttacagttctctgaactacagggaaacatgcatctcttactattgaacatatttagcttactaattttctgtattttgaatgtgtaactttgagtcagctatcattgttttttagggaaaatgtgtatgattaatttaaggtttttggagaatgcaatatgttagaaactatttggtttatgaaatttttgcatttctagtactctcttcattcctttgatcggaagtggggacagattcagaagtggctggtaggccagtattgcctgtcctgcatgttgtgatcaattgctgaaataatgcagtcttgaagtaaaacattaactaatagtttgcaaagtaggagtgtttggcctgtgtgaacctaaaggtcagagtgtctattctgtctatagtggaccagaggtatacttggagtcctgccattttatgttgtagtcagtatcctcaccttcatctcatgaatgctcctgatcaagaaagagtgagaaaatgaatgtgtgttttctttttatgggtttgttcttttcttccccccttctctctcccctttttttttaaaaaaataagtccacatggtcttcattgaaagatgacccaagtaattcttttcatttcctctgaaaattactcttattatatcaactccttcaggtcctttttaaattctctaccactactctcaaatttgttagctataaaaacaaattgtgaatcagtaaaatgttagataatgtgaatcattcctaaatttgaacttttttttaggcttggtaagttccccactgtctcctattacagggcttcttaacttggtatatgactaggcttgggagagggatatgaagccttaaattctactgcagactttcaaatgtaattatttttatgggaaatgcccacaggtatttttattgtcagattctcaaagtagtctgtaattcctaaagggttaagaaccactgtctgattgctgctaaacaagcaactttctttctttctttctttcttttttttttttgagatggagtttcgcgcttgttgcccaggctggagtkcagtggcacaatctcagctcactgcaacctccgtctcctgggttcaagcgattctcctgcctcagcatctcaagtagctgggattacaggcgcccgccaccatgcccagctgatttttgtatttttagtggagacagggtttcatcgtgttggccaggctggtctcgaactactgacctcaggtgatccgcccgcctcggcctctcaaagtgctgggattacaggtgtgagccaccgcgcccagccaaatcttttttttttttaaacctctgtgaaatttgtatagtttaggcagtgagtacgctagattttcattgaaaggggtgacctttgggctagagttttaaaattcaggtagtgactaatccaagtcttgatttatgggcaggacttggacctgcagagaaagtggcatttcttttcagatgggaataattatcacttctaacccgttctgacacttgcttttaccctgttaaaactgattctttgggtctgggcatagtggcccatgcctgtaatcccagcactttgggaggccgaggcaggtggattacctgaggtcaggagtttgagaccagcctggccaacatggtgaaaccccgtctctaccaaaaatacaaaaattagccaggcacgctggcgggcgcctgtaatcccagctactcagggaggctgaggcaggagaatcgcttgaacctgggaggtggaggttgcagtaagccaagattgtgccactgcactctagcctgggcaacagagtgagactgtgtctcaaacaaacaaacaaacaacaacaacaacaamaaaaaaactgattctttggtgtgagttggttgaaggtaaacaaaataaataaaaagaaaaagaaaaaaagaaaaaaattaaactgattcttctgctcatttatctttgtctctctggctgctttatctgtgagcccataaggagaagttggcatgtaatagttacaatacaaaatataaatggctaatgtttatagtaaaataaatgatgcatacacacacaatccacaataggattgtcagttactagaaggaaggaaattttcctatatttgtaatttcccctaattataatacctttttttgggtgggagtgtgatgttgggacatgaatagggaatgaaaaggaaggaagctcagaaatgagtccaactttgagtgcatactgtatatcagcactgtgctagggctttttacataggtttttatttcacattataagacagtattactgtctcaattttatagacatgtttataaagaattggtgaagtaaataacttgcatagtcattggcagaaccagtatttgaaggtatgagagagtgccacacctggtaatgtgctggaaggtgaaaggaccaggaagaaaaggacccacaccttcctgggcctcccattagtgttagtttagtcaactttccatgaacccaatgattctatttttaaactgggtgtctttcttaatcagtggtgattctgaaagagtaaatgcatgtcttgaagagtaaatacggtttttgaagttccttctaatttgaaactgaaggaatgactttggtgtcaacttagtaacaaatactatttgttgacagaaaagatggccaggtatattcatgggactgtggttttcttttaatagaaccattcatcctcccttcaggtgaacgtttaaaaacaaagagtatatttcattttcattaaatgtatcaaaacagcattttgaacaaatacatgtcttttttttttaaggcgttgtactgtttgtccagtctttagtgctttagtgctaataaggacttttgggataatgacgatgtattattttcctcactgtggaatagagggatacaccttgtaactggcacctaagaacacagtttgctgtaatctgttatctttgtccactggtataatttcttcaagagaaacctattggcaatataaatagtgctctagaaatacctggcaaatgaagctttttgttcttccagagaaggaagaatctctgagtaaaaaccagaataccttgccattttctttctttctttttttcttatgtaattggtggaaatttagccagtataggatgttatctttacagttcagttgtctggtgaataaaaacgtctaaatgctggtctcagctttatgatctcatagattcttacttaatccttctgtgctgcaactttcttactgcaaaatgaaggggtcagactagatratctctaaggactcttctagctcttaaaaatagaattgctaccagggtcactttatatcgttgctaccagggtctgtttccctcatgtttgccactgtgcaaaagtattcaaggtagaagtaattaaaaatgacccaaatgttttgcctttctatatgagagtggtcctacttagcaggctcttagtagaatatgtgttttgaacgtttttggtataattaaaatttgccttgagcttgccttacagttttacgtaaacacatttgtcaaataggtttagagaagtgctgtcaagtatggtagccccatgtaggtaattaaatttaaatttaaattgactaaaattaaataaaatttaaaatttggtttctcagttgcatttcaagtgctcagtagccacgtgtggctagtgggtactacattagcacaaatatagaatatttccatggtcagagaaagttgtattggacagtgcttatttaaggtatagtttgtgactgtggaataaactatactctytgtccaaattaactgacctgtatgggggtttatattttattctgtagttttcagaagtctttttaggccaatttttcaaatggagcaagaaaagctgtttaaatatagaggtactatgtatcaatacttaataaggtattttaatttataattgtttttattaatataaggggcataattgaaagtatgacttcatctgtctttgctgcatctttaatgggatatgctctttaggtgagatttttgaaaatgctctgtgtgatagatggaatggaaaaaaggctagaataaagggaagattagacattaaaccgtatttaccctagtacctcaaataatattggaagaggcatgttgagttaactcaccttatagtaaaggctttttgaactaaccaaactaagtagcctagaactgattaccacttactaagctgtacctgcccttctaggctaacacacatgcccccaaaactttcgtggttgataaagaaagggaagaaattttcttggcttcttgcagactacatgtgtctattgcataataaaaaatgtaaatcagtggccaggcatggtggctcatgcctgtaataccagcactttggaaggccgaggcgggcagatcccttgaggtcaggaattcgagaccagcctggccaacatggcgaaaccccatctctgctaaaacaaaaagtagccgggtgtggtggtgggtgcctgtggtcccagctacttagtagggggccaaagcacgagaattgctcgaatccaggaggctgaggttgccatgaactgaggtcgcgccactgcattccagcctaggcgacagagcgagactccgtctcaaaaaacaacaacaacaacaacaacaacaacaacaaatgtaaatcagtgaygaattcctaaagatcagaatacctgattagaaattgaatcatagtagtgcttataaacagacttcagcatacatttggtcaagggcatcagtcacagcagatgtcaaccagggagttttgaggcattgattcattttgcaaaaatacagcattgataagctatgaacccagttggtcagtaatgtatagattttcagtcagcacacattactttaacactttggacttgaaattctgaaagatcagaaattccttactgtttgagatgattaggttttagggactagccattttatctcacatgactcaggccttaatgctccattgctaatagctaaatgtggaaaagtttagaattacatttaatttagtcaactgttaggctgcaatcatttttttttaaaaatctgcttatggcattattcgagataacttgaccaactctaaaatatatatgtaattacttctagatgtaagtagtttttcatattaacaacacaatcaggctctgtttcagttagttcttagagtggtgaaaaaaaatctttacagtaagtgcaaaattataatccaagtatttttagaatcatatactgtcttaaaatacatcagtgataatgttaacacttcttcctacctgcataaactgatgatcacaatgaaaaaatagattaatgtctttttttaatgctgaactcaagttctctttgttaagtatacttgcacatttttatcttggtatattgaactctcttggtcttatacagaccattccaagtggtctgacatacatacgcctgataaaataggaacattgccaagattatttctactttctttccaaccaaagaatgtgaccgccccacacatacacaccatggaatactatgcaggcataaaaaaggatgagttcatgtcctttgtagggacatggatgaagctggaaaccatcattctcagcaaactgtcgcaaggacaaaaaaccaaacgccgcgtgttctcactcataggtgggaattgaacaatgagaacacttggacacaggaaggggaacatcacacatagggcttgttgtggggtggggggaggggggagggatagcattaggagatatacctaatgtaaataatgagttaatgggtgcagcacaccaacatggcacatgtatacatatgttacaaacctgcacgttgtgcacatgtaccatagaacttaaagtataattaaaaaaaaaaagaaagaaaactagtactgctatattgaaacttacacacacacacacacacacacacacacacacacacacacacacgaatgtggctgcccctaagataagttatccaaacctgcctgctctcaggagttgttgctgtgctgttaactgactgctctttgctcagttgttctgataaacaactgtctattcagtgattaactctccatgtactttctcctttcccaggaagattcggaaagggccaggtattcccaccggtccagtcaccatcgtccttatctggtttgtaataacctatacacttgcctctaatacttttcctcattagcttaatgtaatcactcacaaacttttactgtgtttattttyatttttatcagggagttgaggatgcattgtccattcgaagtgttggcagtcacagggttggtattttaacttgtctacacaatacaaagcttacgtgtgagctttcttcartaatgttgcctaaacaatctgacaatgttcctgtatttctttgcgtttttaaaagaagtataaaatattggcaaagacctttcattggaaaatgatgctttctttcaaattattgtcataagtaaatcaactctaaaatcatgaatactttaatctattaacatgggtcyaatctctttttctatagaaggacctttgattttggaaaagtatcacaaaataattaagattgatcttgtagaataacatttgtttggttctaactttcagactttccctactttcatatcttaaaaaatgacaattaaatgcaaaatagctttggggcttggatgattaattgtaattttattatgtggaaaatttgaacaactgatttgaaaagttctctgaatatgtataggaattatcatgctttgacattttgattaacattttatagaatgccccaggttgttttttgcatggattgttataagtcaggaggaaggagaagttgctccttaaaaacccttgtattatgccaagaccctaatttctgtcttaaaaaagtatgctttacaccttaaagcagcacttttattttgcacattgataatgctgtatgtatactttctttttttccattttattttatttaaaattttttttattttaatagcttttagggtacaattgcattttggttacaatgctgtatgtatacttccatgtagttttcttaatcagtaaaatgatctttcatgttaaagtctctatttgttagttttccctgactgtaattttctttctaccttgtataaatgataaaaatagactctaataaactgagtgtgctctggcatactagttattgacatgtttatattcacaaatataaactccaggctggctgtttttcttggtgaatgttctccaggctggttatttttcttggtgaatgtaatgtactgtctttttagagtaagttactaagctggttactaaatcaggaatattttagttataaaactttagatttttaagaatattggccaggcacggtggctcacacctgtaatcccagcacgttgggaggccaaggcgggtggatcacctgagatcgggagttcaagaccagcctggctaacatggtgaaacctgtctctactgaaaatacaaaattagccgggtgtggtggcgcatgcctgtaatcccagttacttgggaggctgaaacaggagaattgcttgaacctggaaggcggaggttgccgtgagccaagattcgccattgcactccagcctaggcaacaagagcaaaactccatctcaaaaaaaaaaaaaaaaaaagaatattaacagatctttacagaaatctaagataattggcagcttataaatgattttacagtagaaaaattttaatagtgaattcatcatacttctccctggagatatagtactttgtttttttctctttaaatattttgaaaaggccgggagcggtggctcacatctgtaatcccagcactttgggacactgaggcgagcagatcacctgaggttcagagttccagaccaacctggccaacatggcaaaaacccctgtctctactaaaaatacaaaaattagccaggtgtagtggctcacgcctgtaatcccagctacttgggaggctgaggcatgagaatcagttggatccgtgggcggaggttgcagtgagctgagatcgtgccaccgcactccagcctgggtgacagagtgatactctgtctcaaaataaaaattaraataaatattttgtaaagaatcatgcagggagtcagtcaataaaagctttaaagttaagtctcaaaggctgtgaaaataatcctcttcttgtatttatggctttttcatttgcttttcaktataatgttcgcagtgtgtattttcacacagttgttattaagccggttatttataaatttgtatgtggccttaggaaatttgattatatatttgtttaacttaaaggtagaaccagcaaaatttgaacatttgggggcctttaaaacaaatctgcaaacaaaaaaggaatctgcagttaaaccgataataactatataccagaatgtatataatcaggatgattttatttttatggcatttgtatcattaaacaaatttaagatataactccagtatttaatttcattatgttgattttgaaaatttgttactatgggatagaataaaactcccagtatttaaaaacgtcaatgtataaatgtaaaaattaataaaagttttacatcctagaggagattctagtacattactctctgtgagtgcacatctaacacagtttaaatgtttagactttcctggaaacaagtctgaaggctcactactaatttcatttaaaagaaatataattgagataaaactttttctgttttacccaaataatattgwgagttctaagttttcatcaaattatttgcttttaaaataatttttccattaagctgaattgttagacaacttttgtcctctgtagatggcctaaacactgacctaaatttccttgtggtttgctatataattttggagttatgcatttctcagccagttatttttaaaaacttaaggccgtgtactaagaggtctaatactttytgaacgtagtatttgatgtttgaacattagcagtacctgaatgtgaggtggatatatttatggtcttatgctgcattcttaggactttaggtttctccttttgtccaattaactttcatatactatctttttgaaaggtggcttaccagaagctatatgggctggaaatgttggtgtcagtgctatagacattatgtataaaaataaaaacagcaaaggtagttcaagactgtgaatggtaggattgggggagggaagattaaatcaaagttaggaatttagaattgaaacaatctgtgtctattagttttgtataatgattggattattaatagtgcagaacattagtagctgcttggtcattgctttatacattgaaatacaagaagacagtaaggtaaagatccaaaattagaaaatgaagtgatcttggccaggcacggtggctcacgcctttcatcccagcactttgggaggctgatgcagcagaatcacccaggagtttgagatcagcctgggcaaagtagtgagaccttgtatctactaaaaataaataaatacaaataaaataaattagctgggtgtggtgctgcatgcctgtggtctcagccagttgggaggctgaggtgggagctgtccgggaagtcgaggctgcagtgagcgttgattgtgccacagcataaaaacgaagaaaaagtgatcttgattgaatcagagcagtagggatacattgccttttctcattggtggagatttttactgttgcatgtatttagttactatttatataccagtagccttggtataattttaatgaatttaatttttaaaatatacttacaattttgtgttttattatttactattacactgtttaattctattgaagaacccatcaaaggatataactgggacactttggagtagagccagtacacccaaaaggaaagacactatggtgtgtagcccaggaaaatgtgtggtattagtgttatgcattcacttttgactttcagtgtccttgatatttgagtaataggtacattctaatagagattgacacttgctgaactttgttcactgtatgtactttctttctagtttgtttcctaatgaaaactttcaggcaagtttgacagttaaaatttctttaaaagattacaatagcaaattttggatttttttttaacttttaaagttaaaaaaaattttcttttttctctatggttatagcatcaaaaatttggaaatgagcccttactattttcacttttacctcctttgatgaatctttcttttctttacaacaatataaaggccaacttttacttattggggtgactttttttgtttgcccattgttctagtagaaattggtatgcccaaattatggattttcctaccagatagattcaacatttttttttaaaccagctgaattctacattatattttggraaaggaaaattgaaacaggttatttccagtttggcttgttaaatcctatgcctgtgtaaaatgccactggtgctatagagaggatgataagaggaaagacagctactcttttccatgaacttaccttatttggaggatggaatagcttatctgctagaatgtgtgacttgagtaatatgttttggtcatggaggttttttttttttttttaaacaaaagggttagattttttttaatttaraaatttctatagagaagcaactttatttttggggaagtgtctctccatggtaagtgacattttactactacacagtttaaatgcatactattacgcattttaraaaattttgtaacaagattttgttacacatgcaataataatattttttattgkgttttctgttagtttcaggataatataaraaaagcatgcggtacagatattttgctccaataaaattggtatttattacaataacattttcaatgaatttataccagtggtaaaatggtaccacttagtctgatacttatggaatttattttttgaggtttctgcaatgttttttgtaaatgaccatttcattaggcatgaatggaagggctttattctgactgaactattattttaatgtcttattagaactagattatatactttgattttctaatatattttaagctttttaaaaattgtgatctctacaacaagaaatacattttacaccataagtcagtatacacatgaagattcatgcatgtggatttgtatatatgtaaaagtatagaaaatacattattgaaacaaaagtttcacaaaataatatttgcacttactttgcacaacaccctctaatattttctcttctagtttagtttttaaaatgctggttgagggcagggtacggtggcctctgcctgtaatcccagccctttggaaggctgaggtaggagaattgcttgagcccaggagttcaagaccaacctgggcaacatagcaagaccccatctcctaaaattaaaaaaaaaaaaattaggtaagtatggtggcatgttcctgtagttctgtagttccaggtacttgggagcctgaagtgggaggatcacttgaacccaggagttcgatgttgcggtgaactatgatcaagctattgtactccaacctgggcaaaagagtgaaaccctgtctcaaaaaaagctggttgaccctactaagttgattttatgaactactgatgaattgcaacctatccttatgaaaacgttactttagattgggtttttgaatagtattgcttaaaattttaaatgaatataagagttggaaaagaaagatatttttatcaaacaattagtatttaaactacctgaggaacttgttcattgcttttatttgttttgtatatgactttctgggtagacagcttaaaaatataaactagaatgcttaagaaacgatgtgtgaaaaccataaatctatgtagttactatttagtttttcttccctggatttgaaatgtggtattacatatcttacttttaaaaaggatcctacatgaaatgtgggtgttctggtcttacgagttttgtatatttttctttgatttatattcagtgtcacacctgtatgtatactgtgcagttcacacattgaccagatttctcaaaatgagaaatcggcattttcttgaggaaggacattcttaggtgtttgttcacaagcagatccaagggaatgttccccatcttggtgctgcaattgttcttttgtaagcttgaccatgcttgttatgtcagcttgcctcattgcctgttcatcctttgcttttgccatttttcaaacaataggaaatgatgttaaaagtgataataattttcttaaaaagcatttttgactttagaatgcttaattcttgtatttaaaggctcccttaggatgttttgtgctrtagtgtactgagattgaatcatatcactattactgattatgaattttgttgtttaaaagaaaaataaacatacagttttgaatatacatacagtttagcaatactttatactaggaaaaagtaggaggaagaatattttttaattcaactggattagctttcatgtttaataattttttattttaaaatagtgctggatttttaaaataacctcaaatattacttcttctcttctttatatttctgaatttggaaacaaaccaactttcatgttttgctgaaacccagtatgatatgttcaaggatagatcatcaagactttcatcattagtatgtagcacatgactttgtgttatatgtggaattttactttataaacatctgttgatgctaattatagaatatgactaactttcatggctttgttatgaacttttggggaaaatgtgtgactaacaaagcaaaaagctaatgttttgtggttgtggcatgaatagtaatttttttctttaggatttcagaattagacacaagttattcttatctattgaggactaggattggtagtaatatcttttttttttttttaattttaaagatggggtccctctctgtcaaccaggctggagtgcagtggtgcaatcatagcttactgactgcaaccttgaactcctggattcaagggatcctcccacctcagccttctgagtagcgagtactataaacatgtgccaccatgcccagctaattgttttattttttttgtagagatggggttttgctatgctgtccaggctggtctcgaacttttggtctcaagtgatcctcccaccttggcctcccaaagtgatgggattacatatgtgagccatcatgcccagctggtagtaatatatcttttcttaaaatgatgagccacccacctaacatatactcattgtcattctaacactgttagaaacttgtcttcatgttgagcacaagcccaaattgtgttttatgtcatatgtcacaaagctggcaggtgtgaagttgctagatagaaaacatccagtagtgttagaggacacctaagacatcagttatgtccaaacattttggtttgatttggttagttttttatggtatgtcattaaccaaggaatttaagttatagcttgtttttcttgggttaatattttgtcaataggttgcctgagtttctaaattacatagacatctcttaaaatattcagagtaatgtataaaaagatgcatattcaaaaaaaaaaaagtaaaatgagtttttaatcattgattgggaatacagctatatatatgtgagatggtttacctagagcagtctgttgcctttggctcttgataggtagggcacttctagccacactctcttatttcaggcaagtagtacgtacctagattagatttcttatctaccaatttacctatttagtagtattgctagccttaatttccccatatgtacttggctgtgtactcctaggaaaagttaggtattgagacaatcctgtcttcaagggacccttttataaggtgaccatttatggtatgctgggcaatccataccatgttggttgttttcctcctgagcattacatactgtggattcactaatttgggttaagagtactgtctgggacagtttaatgtcatgttctttgttctctcagtcctgttttaattgttccaaaagattgctttttgacctttaggtaaggaagactatagaaggaaatgaattatcttgttacctatacccttagccaggagtggtgtctcatgcctgtaatcccagcatttcaggaggttgaggcaggaggatcacttgaggccaagagttcaagaccatcctggacaacatagcaagacattgtctctacctgttcccccaaccccaaattagctgggtgtagtggtacatgcctgtggtcctacctactcaggagactgtggcaggagtccaggagttctaggctgcagtgagccatgattgtaccactatacccctgtctgggtgacagagtgagaccctgtttctattgaaaaagaaaaaaaagaagtcagagggactcaagtgtggtgtgaaggtctccacaaatattctgcctggttcttagttctaatcaagttttctttagctggccagacacacagatgcttggcacagagggaggtgagggaggaatgcagatgtgtagagaggccaggtagactagctagtaaagtgcagtgaattgtttactaacctttgggaaataaattgcatgtaaactattgtgtatctcatatagacctttgtgtatataatttgaagatgaattttattattttcataacttcgctatgcaatcattgaagttaacttggaatatttacttccagaatcattcttacagtcactctcatggaatgaagaagaggtcttctgattctcatraagacctactggttagttctgttgtctctcatatcacaattcacgaagtactgttaggaacttaaggattatgattgctttggtgtgctactaggacattattgaaacttgataatctgctgaaacatgatttatcagaaatttaaaaataattttgttttcatttgcaagttttagtattaacatatgcaaaccctagcagccagagttagtactatatcacaagaagctcattaacaagtattttcatttattaattgtcctttggaatatacctcaagaataggtttagtaagattctcatccttattttaggaatttgaattgatttagttgtggtattatgggccgtaactaaactcacaaataggtttcattctaaaagtttgtgttttgggaacttggaatgcattttctagtttcttcaataaatatgtaatggcaaagtttccatactagcttgctgaaaactctttaacctataatgtaattaaactgcagaattaatatactctttattctagtcactttgtgaaacaacacttcttttttctttttctttttttcttttctttttttttttctttttttgagatggagtctcgctctgtctcccaggctggagtgcatggcgcgatctcggctcactgcaacctccacctcccaggttcaagcgattctcctgcctcagcctcccaagtagctgggattacaggcatgtgccactcttcctggctaatttttgtatttttgtagagatggggttttgccaggtgatctgcccgcctctgcctcccgaagttctgggattacaggcatgagccacagtgcccggctgctaaacaaatttctgtgaggaaaataatgtctccagaatgcccacttggtacattggaaacacccatttcctgttaggctgcaacagtactggcaaaggaagtgcagtcccaactccttgctaattcagggttcccatgggttgaacsgggagagggttggaaggctttggttggtacaagggaggagagaagggagaatgtaatggggaggaaattaacgagaggccctggaaggtagggtcttgggatctctggggagaggtgagccttaggtgcctagttgagggtgtgagtggggagtgaggagyggtgtgggaaggcagggctaggggtggtagggatggggtgggagtagggatgtcctcaactccactgtcaacactgatggagtctttaagtcagagattgcctaaatttgcttaaccttgagtaaaaaagttggctagagaagttgggaagggaattttatagatggttttctctccctcaattagctataatgtgtactattgtttattttgtacattgtataaatgaacctgccgtaagtgttttagatcaaaccatatttatcgtactctctctttcattttggtaacttaatttgtcagtttattttgacaagtaatgggactaggaaatgtttggaaccaaatacatagctctttaataacttctgtggctttgccagatggattgtaaaactggtaattattcagttgtccaggagtgttcaaggactttcttaagtatggcatgagaataaattgttttcattccattttctctgagggtttattgtcttgtttttaaatttaaaaatttagtaatgtctttgttttaggggcttgaaataattgtcrctttgacttaatgtgatatgatgatttaaaaacattttggagaagaagggatttggcaatatcatattttgcctttttgtgttcagttttgcctttgtgtgttgttaggttattaacatttagcctaagaaaaatgtgtttaattttgctttttgcagagtggcctctactttgaccagagaaactatagcagtcttagacatagcaaacccacctctgcctactacactcgggtttgtctaaacttttttggctttatgtgtttgattcacttttaacatatttctratctccccattttgcattttgactagctgtaactaatctgtaaatggctacgtatatactagtttttggtaactgaatttatatagtctgtgggagtctctttaaacaacgggaactattcagtcatcatgtttataaatcagtaccattaaagacatttttaaataaagatgtttaaatgtacaaaaaaagttcaaggaataatacagtgaacatcacatacctatcatttagattatataattcattatatttcctttatcacataattatctatttgaccctctaaccatcarttcatcttagtttttgatacatttcaaaataagttgtaagcatccatatacttcagagtgggtacccttttaaaaaagcttacatataaaaatgtaaacacgtggcatgagaagaatgtaattatttaatgttagaatctcttgtttttttaaaggcatttgacacatcatacatttaagacacattaagtgtatggcacacagtacatttaaaataattttgtttaaaaaacctgcacacgcaacttaagtactcttatttttcatctctgattgggtttggtgaaaacttgaaaagtatgtcctcagatgacatcaggaaaagcaagatttaattcctttaaaaacatgctgtgttcttttagtgcatggattcattgactagtacaatttatctaattcaactaaggcactttgtccatggcttgttttgaagaacaggttttctaatctatttggaaaagagtgtttgtagagataacttggagcttatttatctggttctccaaaaatcagtctaagccaattaggagttggtcataaaatcactgaaaatatcataagaactgggtgagtgggatgtggccactgttttccacactcccggtaccatgaccctctttccctcagtgttttcttacttgccattccatatcctaacaataatgctcgaagaccaatgggacataaacatatttataattcatagaaaactgttccagctgtttcttatcccttacaattaatattcaaaacaatttctaattacttaagtttttcttatttcttgtgtttcttaactaccttaagcactcaggaattgctaatgaattatggagtataaaatcataaacttaagtcctctgcattcatgatggtgagaccaattcatctttgtttttgtttttgcttatttattttgtttttgtctcttagcagtcttcttccctgtacagtgaccctctggcaacatrtaagagtgacagggttagtactttctgaggaatgttctgcctttagagctaccagttgctttttttggggtttaataatacacttttttcttaggcctctcctaytgcaaattctggtctgctgagaagtgccagtctggtttgtattttcctcttccagtgtgtgcastgctggtggggtcaatgtcatggtgctaactctatggcttgacagcttttctccaaaatagttaaggacacatgattttagtgtcatgtatactgcagaatgtgctgcctgtgcttaaaatatacaactttagggtattaaaaatgaacatattcctttcacagagggctgttggtagcccttgcttagaatcagtttttttttatctagagaagatagatttgcttgagtcctaccacactcacatacttttgtgagatggctgcttatggaaaggatattgtttttctttgggacagttatgatcttggcctctgatactaggatctaataaagcaagctgactagaaaagtaaaagcagtagctctgtgtaatgtgtgagctgtgaatttgttgctttcaagctgtttgttgtgttgtggcctgttctagtggactgggatcctgaggttttataacttaattttattgtagtagtaggcaaaatgctctttgtacctcagtttcctttcctgctctgtttcctcttttgagaagataaatgtgtacacgttaattctcccagtttcataacatgatggtgaaagaaaatactgtaaccaggggtgttttttaaaaaatgaagtgcaaggttgatagcaatttttgcatataaatgagtattaccgccttcagggttttcattctgggaggctatacacttatatcattctccaaaacttttttggtactgagtattgtgaaaacattaagtcattttcaaaacaaccttgaagctaaatagctaagtgatatttcctttgttccttaggcatcattgtacaatggtggattatataacccttatggtcctcgaactgtaagtctaaataggggaaggtggtgaagaggagggaaatgtgggtgggcacagtttactttcaaagaaaaagtcaaaaattaataaaaaagaaaaatatacaaagaaaaagtcatttaatctgacctggaattactctctaagctgtgatcaagtcattgagctagccagttgtgactctcacccaagctgtgataaaatgcctgctggaaatcatgatttcaagtattagggaaatgcatagaaaaaccacttttcttgttcattagttcctcctgaagaagttctgagcagcacttctcagggcatccccttcctcttcgctccctctagccaagggctggtggatcttgagggtggggatgaggtagagttctacaccactgaataacagttacctttatcttgagaaccaggggcaagttaggtaaatggtccctaatgtattctcattagaataatgaggtgatcattgttgtaaaacctttcttcttggaaactttatagccwtctgaatgcagttattattcatcaagaataagttcagcccgaagcagtccaggggtgagctgtctagtctctgcatgctttgtagaaatttttgattgttgcgttaatctgtactcactgtttagaatattgaggatatggtgtgattcacttygttgtgcatggattagrtgttcccttagtacataaactcaagcactaatttgtcctaataattggtgatttctctataaatgtgacttagcatgtaatttcttaaatgagtctctaaccagtgccattagaatttttaaagtttttatatttaattttcatttgtgtagaacttcttgtctttcagtggtgataattcattgtataggttgactatcctgtgtttctcctttctatctttacattctgcacattgagccatttcacctgcttgccagcgcttctatcagtgcagtgaaaggagaagaaataaaacaagctgattaaaaaaaattgttatacgaaagacaaaactgggacaattataattacctaatctttctagagtatttttaaaagtttataaaaataatattagttaaggaaaattcaaagtaaaattccccattttccttccccaaatgtaatctctgttcttcaataacctttcagagatattttatgcaygtatgagtgctctttattttgagtgcaaatgggtcatattacatactgctcctcaatatattttctttatttaaagtagctttctgtatcagcacctataaatttatttcattctttctttttttgataaaaattttaaacaagtaagctgtgtcccttagtttttccacttcatgtctcttagaggtagtttcatattagcacattctttttaatggcaatatattctgttagtgcgtaagtatacattttaaaagtcatttcctgtccgggcatggtggctcacgcctgtaatcccagcactttgggaggccgagggcacattacctgagatcgggagtttgagactagcctgaccgacatggtgaaaccccacctctactaaaaatacacaattagcctggcgtggtggcacatgcctgtaatcccagctactcgggaggctgaggcaggagaattgcttgaacccgggaggtggaggctgcggtgagccaagatcacgccattgcactccagcctgggcaacaagagcaaaactccatctcaaaaaaaaaaaaaaatagtcatttccctgtgatggacattagattgtcatatttttgctactatagacacttatacaatgaccattcttatccaagtatatttttgtgtacttacatgggtaaatctgcaaggtaaattgtgaatcatgaaacttgtgacctcaggtggtccacccacctcaaacttgtgacctcaggtggtccacccacctcggcctcccaaagtgctgggattacaggcgtgaaccactgtgcctggcctaattttaatttttatttagagagggtagctttctatgtggcccctgctagatttgaactcttgggctcaagtaatcctcctgcctcagcctcctgagtagctgggactgcaggtgtgtattactgtacccagcttatattttcagtcaaatgtaggatcttgtccttataggctggctagatcgtatttcatttgcaggttggggttagaataactattttagtgatgccagaatggtttcttagtgatgttagaatggagataaactacacatatcgaagatgagtctttggctggtaaagcaagaagatgacagagccatgtagggtgatgttagcaacatctccactagctgcataggaatgaataaaggaaataagaaccatcacttcgttgtccttgttgtaggaatttctgtcattgacttacattgttttgctttaaaatattcttttattttctctctcaaacaaaaacattaagtatatttgttgacccctgatgggatcccaaagggcccagaggtttaaaaagtatgaaatccctagctggttttggttggcttacttatgcacctcmccttctttaattttttgaggtggtgtcttgctctgccacccagactggagtgcaatggcacgatcttggctcactgcaacctccgcctcctgggttccagcaattctcctgcctcggcctcccgagtagctggtattacaggcacccgccaccatacccggctaatttttgtatttttagtagagacggggtttcaccatgttggtcaggttcrtcttgaactcctgacctcaagcaatccacccaccttggcctcccaaagtgctgggattacaggcatgagccaccgctcctggctttctttaatgtaacttaaataaaatataaggttttactttatttgtgctttttggaaatgtctcctgatttttaataacagtttattatgccttgtaccagcttttttattaatatataaggtgcccactatattataccaattatgctgcttatatagttattcatatgcatctcaaaaccttccttaatgtacttataatgaggtaacaccatagcaaaattgcatctttttcattatctgcatttaatatctatagtttaccaacgatgacactgcaagcattgtgtcttctgatcgtgccagtcgtggacgaagggagagtgtggtgagcatgatttgcatgcaaagaaataagatgagttttaaatgacagcaatgcatgatcacatgaagtctgttggaaagtgaagtttgcatttgacaaaaagagcattttcctcaaatttagttatataaatattttgccttataaaacatgttgagaacacatattctctgtgggctgtgcaagctttcattaataatttgcctttttacatctcttaggagtgaatcattatttgaaaagtttttactttttcttctttgttgctgttttatgcacatacatgtgtgtgcagttcaccaaagacaaatttcttcagcaaaattaatgtttccatattgtataaaactcataactatggattacaaatcatgttaccattaattgctttctatattgttgtatttagatttaaccagtgtttatccacctgttaagacctgtaatccagtcagggtggctcatgcctataatcccagctacttgggagactgaggtgggaggattgcttgagcccaggagtttgaggctgcagtgagctatgattgcatcactgcactccagtgtgggtagcaaagtgagactgtgcctctcaaaagaaaaaaaaaaaaagacttgtgaacttaagaattgctaatgacaaaatttaaaaattctagtcttagacattcaattggataataattgtagaggcaacaaatagctatgttagaatacaaataatataatttcaggttattctttaatgaagctttaaattttacagaaaactgatgacatttttgttatatttaagaaattgatttggaaaatacattgttccggatggtatgtcagcttagagctagaataaagagcataagaggctgtaattcctttaagaaaaataggccatttaacatgagttatgtgaaagattataaacccgagttttcatagagaaggggaacattaaatgttggagagatttgttaccatacattcatttatttaattaaagccgttttagttccttagcaaagcaactaatgctcacgctcacaactgaaggagaaataatatgccacaacacctaaaaacaccttggaacgcagtggagtggaaagggcagggactttaaataatgatgcttgggcttgtatccacttctactacctgttagtgtgtaaatggcagtgtctttatttgtacattggggatgttaatactatctttgtaggtaggtttaatatatggattaaatggaatactatatagaaaatgcctatcaaaattctcaaataggtgccaataaatattaatatctataaatgcaatcattattattattattgtgaataaaaataccattgcttgattttatcagtccttagcaaaacttcatacttgtaagcctgttttatctctgtggatgggcttctgaattcccttccttgagaagtattttaaagcaaggcaaacagtcagctgaagtaaggaatagatgatgaatgaggttaaaaaaaaatcacttattttaaaattaaataaatgtttgtggagtacctgttgtattcaaagccctgtgttaagtgctaggaatactattttaagccagtcagactagatttctgactttatggaatttatatcctcgtgaaagagatggaaaataagctagtaaagaaacaaaaagaaagaaatgtcagggactgtgaagagaacagataatgtgatagggaacctggaggggtctatgtgtgtgggttaccctttggatggggtgattagaratgcttctctgagaaactgacctttgagctgagacctgaaatgtgaggagccagttgcttgaagagctgggaggggagcgttctaggccagtgccaaggcctaaggtgagggagaactggtgtgtttggggaactaaaaagaggccggtatagtttatttccttcattattttgtcttacatttcctggtctttgggaatataaaaaaaggggaactgtgtaaactgagaaaaggtgcagtaaacaccctgcaaataattctgcattcagcatatatattcttaacagagttgatagctataatgaattataaattttgagaattatagtagaggtatatactgacctagaaatgcctctgttcagggtgataaatatcttaaacatgagagatttgctggtcctcaggaagtaaatgttctctgtagcataggactctagttaagatgagtaaaaaagctgattgtagagctgtgatttcatttaggaaccccttttcttttttatttttttgagtaggttaattgcagcagtttcctcattttatttcttggtactttatcacccatcaaaattttaaaaaacttttccctaattggccaatgttcttatttttttctttcttttttcttaaccttkaaagcatcttgttttttttctgaccgaaaggtatctgccgctgattatttcagtcgctccaatcgtaggggaagtgttgtctctgaggtggatgatatcagtatcccagatttgtccagcgtgagtgtattgcatggggtggttggttatgttgtcccaggcttgtgactaacagctaatatgttagctattttataataaaagtgggaacttgatttattgtcttaagaaatatttgtttgggccgggcatggtggctcacacttgtaatcccagcactttgagagaccagaacaggcagatcacctgaggtcaggagttcgagaccagcctggccaacgtggtgaaactctgtctctattaaaaatacaaaaaaaattagctgggtgtgggggcgcacacctgtaatcccagctactctggaggctgaggcaggaatatcgcttgaacctaggaggtggaggttgcagtgagccgagaccacaccactgcactgtatcctgggcaacagagtgagactccatctcaaaaaaaaaaaaaaaaaagaattgtttgaacatgttaaaatcaaacacatttgctctgttttggaatgtatttattaatatgttcttttttaaaaaaaaactttttccccctctgtggaaaaatctccgcatagaacccatcagcatctgcaacaattatcaatattttgccaattttgtttcattgatttcttcccccttccctcctttttttccctgagttattctaaagcaaatcccatgtcatgtcatttcccaataaatagttcaatatgtatctgtaactgaacattttttcagatctcttatatcattatcatcactaatgaaataagtaattccttagtatcatctaatacctagcccttattcagacattccttattggttaaaaaaagtattttcctttttgattttagtgaatctataaagtgataggtagacttagaaagttgaataatgaaatatagcacttagtaaagtgtcactaatttgtactaaccaggaacaatctgaatatattttaaatatttggattatggcattgttctgaagaagtgtgcctatccattgctcccacattcatcaggaactgaatttaggaaaggattgtccttggggcatttgtcttaatgaatgaactccagccaacaacttaggatctacctgctcatctcaaaataacagcctgattatctctctgacgcttctcctctcttgctggcattagtgttgttttgcccatggaccaaggctatactgattgtactgattgtcaagcactttggagggggtgagaggtggcatttttctttctttcttcttcttcttcttttttttttttttttcttggtgacagggttgagacctatcgtccaggtcggagtgcagcagtgcgatcacagctcactgcaacttcaacctcctgggctcaagtgatcctcccacctcaacctcccaagtagctgggactacaagcgtgtgtcatcacgcccagctaatttttgtattttttgtagagctagggttttgctgtcttgtccaggctggtctcgaattcctgacctcaatcaatctacctgcctcagcctcccaaagtgttgggattacaggcatgagccatcacttctggccaacatttctttcttttttttttttttgagacggagtctcactctgtcacctaggctggcatgcagtggcacgatcttggcttactgcaacccccaccctccgagttcaagtgattctcctgcctcagcctcccgagtagctgggattacaggcgtctgccaccacgcctggctaattttttttatttttagtagagacggggtttcaccatcttggccaggttggtcttgaactcctgacctcatggtccacccacctcagcctcccaaagtgctgagattacatacatgagccaccgcgcccagccaacatttcttaatagaaacgttagacagtagttttaaatgaagaaataattatttataattagcatttcactgatcgtatttaaataactatttctgaactgttttaattctagaagataattttatgtgtggttcttaagcattccagatcattggttctcaaatctggctatgcaacagtatcatcttggtgtgggtctaatcaataactctctctgcatacaaagttagaagactggtttccaagtcattcccctgaaatattgccctttatattaaattgcctagcaatccccgtttttcccccataagtatggacaattaaacttactgtttacatctgttctcttaaaaactgaattctgtcagcctcttaatttataatatctgaattaatagttatgtcttccttatatttattttgtgatgatttactttagtacttacatataagtgaaagtgctgacagtttaaaaaatctccccctgcccctactagttaactgtaactctttaacataaggaaaaagttctctagaacagggatttacaaatctggctaacccctgttattttatagtctgcaagctactggtttatttatatgtatttgtgtatacacacacagacacacacatgtgtatacatatatgtatgtatatgtatatatacatacacatgtatgtatgtatgtatacatgtatgtatgtatgtgtatatatatacgcatacatacatatatttttttaaagagacagggtctcgctctgtctcgcaggctggagtgctgtggagccatcatagctcactgcagcctcaaactcttgggctcaactgatcttcctgcctcagtctctcaaagcgctgggattacaggtgatttgtgtatttttaaatggttacatatcagtaccttatccttaattttgcctcctggaaaagcctacagtattttctgggcctctctctggagcaaataactttctctagtagtatttctttttaagggtatgctgtagtccaactcatcttgtagaggaatacaaaggggacttgatgttgatagacctccctcccctcccactttcaaaaaacggtgacctggaaatatttcaacatgaaatattatgatttttaaatgctggcaacgaattcagaattttaaaagacattttctggttacctcgttgtgtactaaatatgtttgtaggctaatagtttataacttctgagctaggaggtgctgagaaagggtgccaggtcatgtttctgcaagcctatataatatttttgggggttctagcctcttattttcttctacattggctttatttctgttttgtaagtcaggctacaataaagcaaacaaatgtaaatgttttttaagcaaaactgaaattttgctgattgttaataattaaacccatttctaaatggaatccttagccagttttgctttaggaaattgttaaaattgattgatgtcttcccttctgtggttgtggaaatcagatattttttcaaacaatttttgagtagcattatcaagttagtatatatataaattagaaattaacaaaagatcaagatccaatgactgcattgaagaaactacactgtaaatactttattaaactacagttttacagcttaatatattaaatatgattaaattttattctgtttaaaaagcttttttctggatctggcagactctggatcatcattatgaacattagcttgttattgcattgcagccatgtagaactcttggctgttggatcctattgggcttttagaataccaagtttcagctaggtttttgtctaaatggaagatagcacacaagatagtacaagtctaagaagtgagaacttgccaagttagtgtagccaaaataagagaactatggcatggttgctttgggtaatttttgctggcttgacaatctccgaggtttggtgcatgatcagtttgggttgcgacaattgggatctctcagaagatggtgaaagcaatagagtcaacattgtgatggattagttcagtgatgcaacctctgaaatataagattattccatggacagtctattaaaaactggatgattttggaggtcatttttgtgagaagtgggtatgaggaaggatttcaaataagcttagaagacttttaattttgaatgctgtgtgcttttctctttaacacattagcagaaaagagttggaaaatactcaggaagataaggcagtttattcaaatataatatttctttcatcttgaagaataatacattaaatattgggcaatgcagtatagatgtgtaaaaggattattcctttttatggcaataattggcaatatagtatttaaaaacaaatttcaggccaggcatggtggctcatgcctgtaatcccagcactttgggaggctgaggtgggcggatcacttgaggtcaggagttcgagaccagcctggccaacatgttgaaaccccatctcttctaaaaatacaaaaaaaaattagccgggcgtgatggcgggtgcctgtaatcccagttacttaggaggctgaggcaaggagactagcttgaacctgggaggcagagggtgcagtgagccaagatcgcaccattgcactccagcctgggtgacagagtgagaccctgtctcaaaaaaaagaaaaaaaagaaaaaaaattaaagttaaaaaaagcagcatggcacatgtatacatatgtaacaaacctgcacgttgtacacatgtaccctagaacttaaagtatagtaaaaaaaaaaacatttcaatcgctgtcattacctgctttgaaacatttatatgttgttttaaaaattaaaatgaactaaaattagtttctttttcagagtttttacagcaagaagtaacaaagagttaaatgtctaaaaatagtgtttatattactgatgtaatactatcatcataataaagaatatttataaacataagtgtgggtaataaaaagaacactaaaaactttcagatatgtggaagttagggtgaagtgttctgagtagagccagaaatgatgtttcatgttttaataattaactgagaaggttttcagatctcttctctagattgggtctagaaggtttgtgtaggagttggagttattttcatttagttacatccctatgtgccttttttctcctggtgataattggaataacatatatattcaggtaaacaatatgaacactgaattgaaaatttacaaaactaagggttggattcagctctgcaaccttcagcaaaatctgtcacctctgaatttctttttccttagctataaaactcagggtttggactagacttttaaggtacctcccttcttgaaatactgtctgaaacaaccttaaggcctatctacagaagataggttaatttaattgtggcaagttgagataacaggctactatgaagctgtttaaaataaatgagggaagtctattagtatagatggggtatgatttattcattcatccaacaaattttgagcccttctctatgccagacactattcttgatactaggagtacagaaaagaacatactgatatagagcttacattatagaaagagagcagacaataaataaatggataaataccgtagtgtcagggagtgataaatgctatgaagaaagatgaagtaatttctcaaatctctgagacttggtaaggggaaaaagaagatgtagaacatatatgggacacttactagaatttttttaaagactttgtggttggttgctattagagactggtggtcagggtatggcatggtagggagagagccctactcatactcttttgtgctgtttgattttttttttttttttggtcatgtgcatgtattactgagaaaacaaaaaatccttgatgtgggggaaaatattttggtgacatatttaacatgctttaatctaatctgaacttttttggctgagtgtactagtctttatctgtgtgtcctgtgtcctaataatgtttagaaataaaagtttttcgcttttggttttatcagacttttctttttgatatgtacaagctttttttgtattaacatttgcagtgctaaaactttatatgtagccttctttaatgtgttttaaataccttaaacagaaaatttacccaaaagttctaaacttttgagtaaacatagattgcttactcagtgtctcccttaggataaaaattaaagttgctgacattttatcttatgttaaactggaattttaatttcatttttaatatgtttatttttaggcttcaaacatcattgaacttggaaaactcaagatcacttttttcctcccaaaaaaagtcaacttgctaagcatctttactgatttttatctttgttcttttctagttggatgaaaaatctgacaaacagtatgctgaaaattatacaagagtgagtatgtaaattcctaagggaaattctcaaggtcarttaaacttgctatctgtaacttgttcattatttattttacaacaattggtctgatgtagctgctcttcctcccttcatctatttcctgtccttgaccctccaaaattccttcggagttaaatcatgtgaggccctgggaagagaagaggcactgcattttatttccttgaatgtcacctctttagcttttggctgctcttttgattttcattcctctagaaattgatcctgagaagaagccagtaaacactgaaaatgaagtttctttaggaatggtggtgacaaactctgagatattttttccttttatatatataaattgtttcttgaagtaaaataactcctttctagaatttgctttgtgttaaagtctctttcttctgaaagtattattagaaagtcagggagatgatttatcaagattaattttatgctatacccaagaaagataaattaactctgtccagtagaaatgtaatgcgagccacaaatgcgaacttatatgtaagtttaaattttctggtagccacatttaaaaagtaaaaagcaggtaaaattaatttaggtgatatattttatttaatccaaatatccaaactatttcaacatataaccaatataaaattactaggccagactaggtagctcatgcctgtaatcccaacactttgggaggccaaggcaggtggatcacttgaggtcaggagttcgagaccagtctgaccaacacggtaaaaccctgtctctgctaaaaatgcaaaaaaaatattagccagtcatggttttgcgtgcctgttgtcccagctactcctcagtctgggaggctgaggcattaaaattgcctgaacccaggaggtagaggttgcagtgagccaagattgtgccactgcactccagcctgggcaacagcgagactccacctcaaaaaaaataataaaaataataaatataaaattattaatgagatatatttcattcttttttctacactaagccttcaaaatctggtatgtatcctatatgcaactctcaatttggactaaccacatttcaagtgctcagtagctgcatgtggctaatcgcaagtatattggacagcacagattcatgcagtttattaatcaatagcataatctcacgtttaaatgaattttgggaagaacagtctacattcatagtgatatccagtgttgctactctctgctgcaaatagtatcttcacctttatcaactcaacagagtattagagaaagaagagattgataagcagttcagaaattaaaaaggggaagtgctgattagcatatcagttataaaattctaaaactgctttaagttaatctgatgtgctcacttcagtattgtttacaggatagcaaagataaacttagaaaataaccctcataaaaacgattttctttttggttattacgaattatagattttgataaggtatttgtgtcatgaaattttgcttagtatgcttgggcccttctctgtatacctggatacctgcaaagccaatctaaattgaccattgattacacatggtaacttcttcatctgaaacccacatcttcccccaaccaccctgccctgttttyagtttccacagcaaacatatttttaaagaaatgagacttagaagggtcatatttctctttctagccttcatctcgaaattctgcctcagcaacaacccctctaagtggaaactcatccagacgaggaagtggggacaccagcagcttaatagatccagacacttcattaagtgaattgcgggtaaactgaagtttttggttttctttttaaaagcagttttttgacttggtaatatactggaacttttaacctttaatgtgacttagtagaaagaaggaatatgatttctttttaaaaaataagtactgtacaaaagtgtgactcaagtgtttcagagcttgaaaggaaggagattagatagttcttttttctgtcctctttcctgtaaatttaatggtgttggaatttctgctaatttacaaatgccaaaaaaaacccactttgtaatgtatgtaaaagtaattctctcagaaacaactggccatgttttaaatggaaaatatgtgagtgtacaaagaactagattgtgggaattattagtcttttgagccttgatggtattcagctgcttgaatatagttatctctcagtttttcatagtaatagaagtgtaataatatttgggtaacagaaatacctgagataatgaaaagcttatttgactcattaagtctccatccttattaacccctttacttggaaaaagagaactttaaaaaatatatattttatttgctgaacctgctgtttgtgaggcaggggatagtgagagaaattgcatacatttgttcattcaagatttattgagcacttggccttggagatttaagaggcaaaatatgttctggccttcaggatttccctttttcatagggaagacaaactgatacaaaccaataaaaccaggtggtgttatacaatggtagtagcaagaatggggctgttaaggtaattcaagaaagcatcatttaaattggactaggagaagaggtaacaaaaggcttttcagaaaagacaaactctgagctaaagtttgaaggaaaaataaaaattaaccaaggaaagtaattgaagggggaaggcttcctcaaagagatgcattcagacaacccagaaagctacctgtatagcaaagttgccagagggtggcatgagaagtgaagaatagtagcgtgtaagagagaaggctggaaaagtagtgaggggccaaatcacaaagcatcttgtatgctagcctgaaaggaattcagttttaccctgacaactgtgggatattaaataggagagcaatactatctgctttgcattcttaaaaaataactttgatcacagtcagaggaagcattgcaggccagaagttcagtaaccctgtggttcaacagtgaggatgaggtgagcaagtcaaaactgcaaggggagaaaatatgagaaacttgctctggagtgaatacgagagactgggaattggttgggcaattggtagggagagagaaatttaagaaaaggtttttagctttcttttaaaggtgagagtgattattattttctttggttgggttgaaccagtagagagaggaggaaggttgaggaaggagagaggggtaactgacagatcaaaatacctgcgtgggtgagaggagagtccaggactcagatggatgagcttgcctggactggaggtcccctcttcactggaggggaggtagaggacaggcggtgactaagattgtaggtaggggctagtctgagtgcagtaatgtttacaagtaattgatcacaagcggttacagatttatttgttccttctccaccttcattgcttcacttgactagccttaaaaaaaaatttgtcacccatgtaatcccaggactttgggaggccaaggcaggtggatcacgaggtcaggagtttgagaccagcctggccaacatagtgaaaccccgtctctactaaaaatacaaaaaattagctgggcatggtggtagccacctgtaatcacagctacttgggrggctgaggcaggagaattgcttgaacccgggaggcagaggttgcagtgagccgagatcgtgcctctgcactccagcctgggcaacagtgcgagaatccatctcaaaaaaaaaaataaattgtcggtagggttggaaaaggagtcttacttgtgaaaatgggttggggggttaggggaggatagagaggcttgcaacagcggcagagaaggagagcacctaggccagcatggccattggtttgaaggtgacagtattaattgagctcttaccagctcttactatgtaccagacataaatgccagggtggaaagttgaataagataaactcttgcctttagctactgcattctaatgggacaaaaggatatgagaggacaaggccttccagccttagacttagctttcttttgtcatactacttgttgcttgttttttcttccttgagagaatgaccttcttgaaggaagtgttatttttgtatcctaccatctgcctcctaaataggtccttcataaatgtgtattgaatgaatcgataagtaaaagacagtcaaacctactggagaggcaatgaaggaggcagggaaaatataatacyaaaaatgtgtataatcagcctttaataattgatcctgcttgtaattgcagaattgtatttagggccctgtgcagttatttcggacataaatcgagcattcagaatagaccttatataacaaggtcagacacagggaaacagtattttccatttaaaatttgacctgtttcacttttcttataaggattatagtaacatttggagcaagtgcttttctcatcatttaaatggtatcctcaggatagaatatctcatttgacattctgttcaaaatgtttaacttccctccctttactccctttctctcaagttaattgtggccagtaaccaagtcattgaaagaaaactttgttcatattcatttattatatttttaaaaaacttttgcatgaatcattaaaatttgccacctcttattaatttactgtatattttactagttctaggtgaagcattgtgctaaaaaaattttaagtgatttataaaatattaaaagttgtatgattttaaatattataatttatatagctttttcctccatatatagccctgtccccatttgctacactgttattaacagaatttaatgccaagaaaatatttaacattagattgattactctagaccttcccccagtcccactatcccctgacctatttgcccttttcagtggttgggagtgggagttatgtttttgtactttgatttctctgcttttagtctggaayatacaaaagtgagtcacatttcatctgaatcctttgcgatttaagatacgtttgtgcatggttttatgcaatggttcattcctatgtcctgcaggatatctatgaccttaaggaccagatacaggatgtagaagggagatacatgcaggggcttaaagaactaaaggtatcagggcccattctgcagcccaagcatgctctgtatgcagaagtgttggcaatggtggctttgcaagttctgttaaccaactgcacatagctttactaacagtgtttgtctttcaagcatgtgcttaacctgcagtgcataggaatggtgaactttcaatctctgcttatgtttaaatgtgtagtacagtttttgaatattccgcagaagatatcatttacagttttttttttttcttttttatttttcttgtacagacaggatcttactgtgttgcccaggctggtctcaaattcctgggctcaagccatcctcctgccttggcctctcaaagtgctgggattacaggcatgagccacctcgcccagcctcctttacagttttaaaaccttgtaaaatacatgcatatccgtggtgtcttagccatacaaaattaaattggtcaaacacctaaaaaaatactaagaatatttttattgagaattagacctcaaaatttcttccacgctaaatgaaaaagtgttgcatatttctgttaccaaactcagtcagtattaaatgtgagaggaagtagcaactgagacaccattattataaatatcccccctggaggaaggaacatgaaggcatgaggcctatattttcttttggcttggatttttttaacctataggtcaaaaaagatgacacagatctagtgccttaaagaatttggaggtaaatgtaaatggtctttatcttttcccagaaaggatcactgacatttttcaatataaatgtgtgaggcagacagtttggttgtacatagcatttggttatcatgctcttcttttcctcacatgtcattctgaagttcaagcctcctgttatgaagaaaccagaagtttatttgaacacatgtatgtcctgatttgaaatcaaaatacacactacagggcaggcacagtggctcatgcctgtaatcccagcactttgggaggccgaggtgggcggatgacctgaggtcaggagtttgagaccagcctggctaacatggtgaaaccctgtctctactaaaaatacaaaaaattcaccaggcatggtggcaggcgcctgtaatccaagctacttgggaggctgaggcaggagaattgcttgaacctggaaggtggaggttgcagtgagctgagatggtgccatttcactccagcctgggtgacggagcgagactctgtctcaaaacaaacaaacaaacaaacaaacaaaaaaagtaaaatacacactacacctctaaaaaagcaaaaagcaagacatttagaagggtgactcaggatatatccaaaggacaaagcatagatttcatgggcaagggttttgtcatcttccctggcatgatttgaagtagcgccactatcagccaaactcttcatgcaagtgatatggtccatgagaaacagagtaagactcaggacccaaaaaggtgagaagtccaatgggaagtgcccatgagggaagcctgcaagttgctgatagggcagcatgagtttgtcagtaaatatcagaagaattacrgaaatagttgatgttctcatttaatcttactcctttaatcttcaggatttaatctctcttttaaggttttagagatacgacttttgaaattatcttggatcaaacaaatcggtacattaaataaatatattaaagtcacatgtgtaacagtgtatcaggaaagcaatcatgtgattcaggggcattcttactggcattttatttaaaacgttttttcctttcatgttagatctaccatttattgcattctttgaagaatacaaaagaacagattagatttgagatttgaacagatgagatcccttgtcctaattcatgccagaatataattgaacttgacttcagattacgtttatccttgacacttgaagtggaaaaaaacccataaaaataaagaaaagattgtctgattggtgaccaagcatggtggtatgatgtatcctattgaaaaaggatgttggstcattgcttgtgacattactgttattatgtttgcctttgggatgctctcaaccactctcccctccatccttttatcaggaaagtttattattactaatacagcatttgcccatgctgtactagtatatatgtgtatatatgtgtatatatattcatgtgtactattacccagaaaatgcagtaaaatattaattgtaaaatttaggtgatctatttcatgaaagattaacgattttgtaagtcaaaggactaaacccattaacccattttaaaaactattaaaattaatactttattaaatttaagtacagagttatagcaataaataacaatagtaaatctatagtgactgaaaactttccaagatgtattgaaaaaaggcaagctatagaacaaaatgtagagtatataatttgtattaaaaatatatatgaagtcaagggtatatattttatactgtaaacaaataggaaatggcctgaaagataatctaccaaaccaatagcacttgtgcctctggagggcgcgtggtcaaggaagacttttgctttatctgtattatttatttttacctccaatgaaaatcttatgttttacttaggtactttttttaaaattaaaattttatttttttatttaaaatttttttttagagacaaggtctcttgctctgtcactcaagctggagtgtagtgacacaatcgtagctcattgccaccttgaactcctggactcaagcgatcctaagcctgctgggactataggggtgcaccaccatgcctggctgatgttttaattttttatagatacggagtcttgctatgctgcccaggatggtcttgaactcctgggctcaagcagttctcccgcttggcctctcaaagcattgggatgacagacattagccaccatgcttgaccccttcgcttttttttttttttaaatgcagtctcaccatgttgctcaggctcatctacaactcctgggctcaagcaatcctcccacctctgcctcccaaagtgctgggattacaggtgtgagccaccatgcctggccaatgttctttttaaatattgcccatgcctttaattcttagaaggacagtaagaataaggagagaaatagctttaacttcagtaatcccagaaagaactgtcaagagttaatagactgtaggggtaagtcttgccatcagctgtaaattgactgatgtatgaagtgactgagaataaaacaatgaaggtatcatgtccctgaattcagatagctcacaatctggttgacaattttggtcatagggttgtgaaggcttgttctagaagtatatgggcataggtaatcaatgcttaaacattaacacagtggcttcagcactttggtgtgtgtcataatcacctggagcttttaataaatacagattgctagactttaccctcagattttctattcattgggtctgggatggcattggaaatttgcatttttacccagttcccaggagatgctgttgctgctgatctggaacccacactttgaaaatcggtgacttagaagcattcaaggctgggcacggtggcttacgcctataatcacagcactatggggaggctgaggtgggtggatcacctgaggtcaggaggtcaagaccagcctggccaacatggtgaaaccctgtttctactaaaaatacaaaaactagccaggcatggtggcgggagcctataatcccaacttctcaggaggctgaggcaggagaatcacttgaacccgggaggctgaggttgcagtgagctgagattgtgccattgcactccaggttgggtgacacagtgagactccgtctcaaaaaaaaaaaaaagaagcatttaagtaaaaccaattccaaatgggtatcactatgtgagtgagattaagatcactaaaatacctgacacttctgtttaaaacagtcttttgtggtctagtgtttaaaggaagattacattggatacatttatgtcttatttattgtattatatattttgtgcatgcatctagtacttgagctatcttaaattctggtgttcatgtggttttatatggcactgagttgtgatgacttttttcctgctattagcctctcagatggatgagaattatttaaagtctgcagtatagtaagatacatttagatacatttagagcactgtataattgactttgcttatattctttgttttggttaaatttgtttctaatcgtagtttaaatcttccctgacaacttaattctggtttatgaagcattattaaaagtgtgtgtggccaggcgtggtgactcataccttcaatccagttttggaggccaaggtgggtggatcacttgagcccaggagtttgagatcaacccgggcaacatggtgaaaccttgtctctacaaaaaattagccaggtgtggtagtacgtgcctgtggtcccagttactcgggaggctgacatgggaggatcacctgagtctggggaggtcgaagctgcagttagctgagattgtgccacagtggtctagcctgggtgacagagtgagaccctgtctccaagaaaaaaaaaaaaaagtgtgtgtatgtatgtatgtatttttatttagatataattcacattccataagaatttacccatttaaaatatataattcagtagtttttagcatactcacagagttgtgcaactagcaccacaacccatctttagaacattttcatcagccagaaaagaaaccccaatcactaactttctgtctctgtagattcgcctattctggagattttatacaaatggaatcatacaatatgtggtcttttgtgattggctttcatttagcataatatattcaatattcacccatgtcatgttatctgtcagtctttttttaatggctagatagtattctactgtatggatttgctgcattttgttaatccatttgtcagttgataggcatttgggttgtttatacttttctgtctattatgaataatgctgctgtgaacatttgtgtgcaagtttttgtgtagacatatcttttcaattctctttggtagattgctaggaatagaattgctggctcatgtggtaacactatatttaacattttgaggaattgtcaaactgttttccaaagtagctgcaccattttatgttcctaccagcaatatatgggaaatgtagtttctccacatccttactaacacttgtcttctgtatttttgattatagattatagccatcctagtgagtgtggtggtatcttattgtggtttcgatgtgcattttcctaatgactaatgatgttgagcgtgttttcatgtgcttatttgccatttgcatatcctctttggagaaatatccaggtccttgcccatttttaaattgatttgtgtgtcctttattgttgagttgtaagagttgtttatatattattctgcatataagtcccttatcagatataagatttataaatattttctcccattctgtgggttgtctttttactttcttgatcatatcatttgcagcataaaggttttacatttgggccaggcgcagtggctcatacctgtaatcccagcactttgggaggcggaggtgggcagatcatgaggtcaggagttcgagaccagtctggccaacatagtgaaaccccatctctactaaaaaatacaaaaaattagccgggagtggtgatgtgtgcctgtaattccagctacgcgggaggctgaggcaggagaatcgcgtgaacccgggaggtggaggttgcagtgagccaagatcgcgccattgcactccagcccgggcaataatgtgagactccatctcgaaaaaaaaaaaaagttttatatttgagtgaagtctttttttttggtttataatgctttttgtttgtttgtttgtttttgagacatggtctcactctgttacccaggctggggtacagtggcatgatcttggctcactgcaacctctgcctcctgggttcaagcaattctcctgcctcagcctcctgagtagctgggattacaggcacccaccaccatgcccggctaatttttgtatttttggtacaagagatagggttttagggttttaccatgttggtcaagctggtcttgaactcctgacctcaagtgatccacctgcctcagcctcccaaagtaccaggattacaggcatgaggcaccgcacccggctggtttatagtgcttttggtgtatctgaaaaaccattgcctatcccaacttcatgaagatttgtccatattttctttgaagcgttttattgttttagctcttacatttacatctatggcttatgctgagttaatttttgtgtatggtgtgaggtgggagtccaacttcattcttttgtttgtgggtatccacttgtcccaataccatttattcttttcccattgagttacatggacccctttgtccaaattaactgattgtaaatgtaagttctgggctgttagttccatttcattgataaacatttgtgctagtattttttaaatttatttccataaatgattacttttcctgtgtgaaacattttttttagctttaaaaaagtcattaggcagtagtaattaccaaagtagatatagttacacacaaaaaaacatgtaagctattttaggcagaaaattttgagatatgtaacgttccaggcattttgtggtaccttttttttttacttcaaaactgtgacactagatcagactctcttattttgttttgttttattgatagagatagggtctcgctctgtcacccaggctggagtgcggtggcacaatctctgcttactgtagccttgacctcctgggctcaatcggtcctcccacctagcatcccaagtagctgggactacaggtgtgcgccactgtgtctggctaatttttgtacttttttttttacagagacaggtttttgtcatgttgcccaggcttgtcttgagctcctgggctcaagcagtctacccccttggcctcccaaagtgctgggattacagagatgagccactgtgcctggccaagctctttttttaatattcatttttgtgttgcttatttaaacatgattgaaatttggataattgctagaaaaaatatttacctttatgttggcatttttatgcagaacaggaaagtactaaaaacaactgtctagaaagtggcaaaattcaaatgcgtatgaagttcacctgtgtaaagagaggctgtattctgtggtatcactgygttctgaacaccagtctgttattaaaattataagagtaaaatttctgaaaatattgatgattcttcattttatgacccttacagatatatgttgttgcaattcttttcatctttcagaggctatgttgctgcttaattttgttttcttggggaacagagagcacatattgttcttataaaggcattatcggcttattattgtcttcctgtttcacatgcatgttactaaacaaggagttccccaaaccgcttgtattttatgaaaatgcatctttatgtgtttgtggcagtgctataatttcctgttatattgcatgtattcaattaacattttagatatcagactgatgacttaactctcatttargaatctttgtctgaagtggaagaaaaatacaagaaagccatggtttccaatgcacagttagacaatgagaagaacaatttgatctaccaagtagacacactcaaggatgttattgaagagcaggargaacagatggcagaattttatagagaaaatgaagaaaaatcaaaggtaatgcttatcttgtattttctcttggggcagaaaataaaagcctgccacttacaaagtgatggaagattgcagcatacttatttaggaatgatgtttcagtcaaaactgaatggcccaaggaaattgacagaacaccatgagatatcaggccctggatgactctttttttatttaaaaaaatattttcttgaggaaaagcttatgtcttctgttaagtttctgaaaatagaatacaactcaagttttagcktcattttctatctcttaattgggactgtaattacagtgttacttatttcttctggttacaagtgactggaactcccgcaaagctccaaagactctcaataggatgattcattttttttctatgaacttctgaacggttcaagagaatccattttctaaataattggatagaagtctttaatcagttatttaaaatcagcaatttggagatgtgggtcagaaattgaaagatgttttctttagaggtttataagytgtaatgttaaaatgtacagatggagaatataacgcattgtccaaggcccagatttgctctctgacaactgcagaaaacaaattggattcttttaaaagcatatgttttagactttttgaagggttgatgtcagttcaagcagaggtcaaatgggtattattgccagaaatggattgctactacattgccaatataaaaaatccagaaaataatttaggaagtgcatattgataaattgttagaaacagcaatctgaatttgcacataataaagggagagaagctgtttatataacctgtaggagaccaacattattactgtagtctttataggaatttctttccttgaggactagaaatgcccattccagcctgttttggtcacattcaaaaagtgttagaaagtgtttgccaggcgtttggaggagagggatgaatagaccagagcacagaggatttttagggcagtgatactattctgtatcatattataatggtggatacatgttattatggatacatgtatggatacatttgtccaaaaccatagaatgtacaccaccaagagtgaaccctaatgtaaactctggactttgggtgatagtgatctgtcaatgttggttcagtgatagaacgaaatgtaccactctattgtgggttgtttataatagggtagactgtgcgtgtgtggggacagggagtatatgaaaactctctgtactttaaacataattttactgtgaatcttaaactgctctaaaattgtttatttaggattggtatttagatggtgaaaaagaggcttctagttgttttcatattggactgacagtggcccattgaagagcattatatatgctagatatgtatatctttgattcttcttatatatcccataggccatttttggagattctgagccatcatgcttttcctagagcctctggactcctttttttgctgtcccacacattttttcttatctgtctttggctctttgcttctagcagactagagtaaaaatctcatgctaagtatttaagggtcattactaaaatgaattatctttccatcgtctcaaatatccttcagcatttttaaaaataaagaaaacccttataattagctattttaaccaacttagtttttccctccatcattttagaaggtaatagagttattttagtatgcatagagttgttttcttaatcttgkcctttttttttttttttttttcttttggagacaaggtctcactctgtagcccaggctggagtggagtagcgcaagtatagctcactgcagcctctgtctccaggctcaagtgatcctcccacctcagcctcctgagtagctgggactacaggcacgtaccaccacgcctggctaattaaagacaaatttttttttatagaaacggtttcaccatgttgcccaggctggtctcgaactcctgggctcaagcaatccacccacctcagcttcccacagtgctgagattacagttgtgagccaccgtggcaggtcttgtacttttcaaacctaaaatgtattgttttttttaataccctggaaatttgcttcacgtactgtgatgcagaacactttgtgacagtatctctctctaacatacctttactccgagctctcttgttctaaacaactattgctttataaagtagaatgtttatattcagagatacacaaagaggtcaggcattctggtgtatttcattacagaagcaggtagtgagagtagagaaggaccattccataataattatacagtattaataaaaattttcaaaatgtctttggtgcctcctcctggaattacaataactattttgttttatattttaatttaatttaattttattgtttttacagacagggtcttgctctgctccccaggctggagtgcagtggcacgatcatagcccactgtaactttgatctcctacgcttaagtaatctggagtagctagaactgtaggcacatgctaccatgcctggctgttttttaaaaatctttttgtggagatggggccttgctgtattgcccaatcctccttctttgacctcccaaagtgttgggattacaggcatgagccactttgcccagcccattgtttctcttttaaagcataatcaaaagaccatttcacacctgtaaaattaacaataattcatattatatatctaatcaatgttaaaatttcagtagtttcaaaatgtcataaatgatttttcttttttacacttaaaaaaatcgggatccaggtaagttkcacaccttagaatgagttgataaatcttttaagtctcttttcatgtataggtcctctttcatgttttttctccttataatatatatgttgaagaaactgggttgcttaatatttcccagtcttacaagtttttccgttttcgtccccatagtatctttaccatgtttccctttcctctgtattctctgtaaataggtagttaggcacagaggcttaatcaaatataacttcagttttttttgaaagtctgcttcatagatgatgcagttgtcttccttcaggaggcccagatgtgtggctgactgttaggctgtatgtgtgtgcttagatcctttaattgactaggggctgcaaaatgggatgttctgattttatcattaccaatttattttattttatgttattttatttatttttttaaattttatttattttatttttttagacgagttttgctcttgttgcccagggtggagtgcaatggygcaatctcggctcactgcaacctctgcctcccgggttcaagtgattctcctgcctcagccttctgagtagctgggattacaggcatggaccaccacgcctggctaattttgtatttttagtagagatggggtttcactttgttggtcaggctggtcccgaactgacctcaggtgatccacccacctcggcctcccaaagtgctgggattacaggtgtgagccactgcgccyggcctatttaatgttatttttaagcagctttattgagatataattcaaataacatacaaatcatccatttaaagtgtacaattcagtggtttttagtatattcacatatatgtgtaaccttcatcacagttacttttagtatgttttcattacctcagaaagaaaccatataccctttagtatcatcttcctttcccccaaacccctcagtcttaagtaaccactgatctactttctatctatagagttccctattctagactcatatgaaaggagtcatataatacatggtcttttgtgactggcttctttcgcttagygtgatgttttcaaggttcatccatgttataccatgtatcaatacttaattcctttttatagcctattaatattccatttttttgggtatgctacattttgtttacccatttgtgcattgattgacatttgggttgtttatactttttcctgttaagaataatgcttccataaacatttgtatacaggttgttttttggacgtaagttttctttttcttttttattctaagagatggggccttgctatgttgcccaggctggtaactcctggcctcaagcaatcttcctgccttggcctcccaaagtgttggaattacaggcatgagccactgctcatggtctggatatatgctttcctttttcttaagtatatacttgggagtggaattgctgattcatacgataaatctgtgtttaaccatttgaacagtgccagactgttttccgaagtggctgcaccattttatattctcacaccagcaatgtatgcaggttttgatttccccacatcctcaccaacacttgttatctgtcctttttattctagccatcctaataggtgtggttttgatgtgcatctccctggtgactaatgattttgaacatattttcatgggcttattggctatttgcatatcttccttggcaaaatgtctattcagatcctttgtccattttaaaattggattttgccttattattattgacttgtaaggtttatatattctagatataagaattttatcagatatattattcgcaaatattttctccctttatgagttttcaaaaaaaggaattggttgtgaccaattacttttctcttaaaatatcaatatgaagtcataaattcaagcatttgatatcttcagttgcattgcagcttttattctttttgatgataaaattgtcccatctttggctaatgtgaacctcttgaggttgattctcaagtacttctggtgagtctaattgtttttgatagcttctttgctttctggcagaagatgtcccagtctcatcttgtacattttctgccccagacctggaatcagccatttgtccaaggagccctagttctgttttagtatgagtgctagagatgctcattgccaccaagtaggtcagtgtttatgggtcttttcagtggataaatttgggaaatatgtgtgtgaagtttttttttgtttttaacaacaaaatacattatgagttcttgctgatagttccagttcacatgcaggactctagggttatttaacctcttctgtcttacatctgtatctttgtttgtttcccctacactacaattcctagttctcaaagtttctagggatgatagtaattatgttacgttctgttctctttgctttatccgaagttgcctagaatagcaataccaacattaacaccaacaatttaattactgaaaatagttaaaagatttttattttgttkgttttgcttggctgttatttttgccactagtctgtgtgtggccaaactattgtttttagaagttacttgaaatagtttctttctgcgcttctaactggatgtatagttaggttcactgcattttattttcaatatttggaattacttttaaaattatttttattttaaaaaatttaattatcattaaaaaacatgataaatttattatcttaaccattttaaagtgtagagttcagtagtgtgaagcatattcacattagtgtacatcagatctccagaaattttttatctttcaaaactagaactctgtacccattaaacaattacccatttctccctaccaccagcccttggcaactaccatcctactttctgtctctgtgagtttggctactctgtgtaccaaactcataagtaagtagaatcatataataatatatcttttcttgactggtttacttcatttagcataatgtcctaaggctcatccatgttgtagcgtgtgacaagagtttcttttttaaagctgaataatattccactgtatatataccacattttgcttatgcattcatctatcaatggccacttgaattgtttccactaggaattgctttttaaatttaattttgttttacaattttgtaactatctagaatagttacatagatctggagtcacgttaacaaagaatatatctgaagaagttaatcttctatccctgtctctgtctctattttctccttcctttagggaattttaaattttaatggtttatctttccatgttttaaatccaagaagataaattaggtagccatttttaatctaaaaagatatatatgtatatataatcattcaaaatatatgtacaaatatatgtatttcttactcttcttagaaaatagtagcatattgttaatataaatgctgtcgtgcatgtagattttatcaccttatgaatgttgtatagagatatcttgctcattctttttcaccactgcataattattccacagtatggatgtaccacactttattctaccagttccctatattaatagacattcaagtttgtcatgttttgctgttaaaaatagtcctgtagaaataacatactgcataggtctttttgtatttttgccaatgtatctatgatgaagagtgagattgctgggtcgaaaggtatgtagttttgcagatactgctgtagtctcctttgtaagcattataccatttgcattctcaccaaaatgtatgagggcctatttctttccccatagttctgttctggaatatgttgtcaagtttttgaacttttgctagtattttgtttgtttccgtttctcttagtatgagtatcttttcatattcagagctatttctatttctttttctgtaaactgtccgtttccgtagcttattattctatgcagttagtgttttctttctttctagtttttgtttgtttgttttttaagacagagtttcgctcctgttgcccaggctggagtgcaatggcgcaatctcggctcaccacaatctccgcctcccaggttcaagcaattctcctgcctcagcctcccgagtagctgggattacaggcatgcaccaccacgcctgactaattttgtatttttagtagagacagggtttctctatgttggtcaggctggtctcgaactcccgacctcaggtgatccgcccacctcggcctcccaaagtgctgggattacaggcgtgagccaccgtgcctggcctagttttagagattctctgccattcaaaagttttatttatttatgtatttattttttggagacagagtctcactccgtcgtcaggctggagtgcaatggcaccatcatggctcactatagccttgacctccccaggctcaggtggtcctcccacctcagcctccagagtacctgggactacaggcacacgccaccaaccctggctaatttttgaattttttttatagagatggggttttgccatgttgcccaggcagggtcttgaattcttcggctcaagggatctgcctgcttcagcctcccagagtgctgggattacaggcatgagctaccaygcccagcccaaaatttttatttttatgtagtctaatttattgtaccattacctcattgcttgtggatttttgagtcattttttcagtaaagattgccccactccttggttacttttattcctgtacagtttgttctcccttcccttccctcttcccccattcactccctggctttctttccttatgtaaatctctgattgatttggaatttgtcctggtgtgtggtatgaggtatagttccaattttatctttttccaaatggatatccagttatcccaacattactaatttaaaagtctttccttctcattgatttgagatgctcttatttttattgtttttaaatatatttgtatatttaagtgggtttttcctgaattctctattctgctcccttggtctatattcatgtgccataacaacattgttttaattatagaagctttataatatgttttaatacctaataaggccggctttcttctttttcagtatgtatttttctggctactttttcttgtgtttttctttcaaatcaacttgctctgatgatgataaaagaaaaacctgatggtatttttatttgtactacattaaatgtatagattaatttagggagaactggcatttttataatgttgtgagacttttaatccaagaagacggtatgcctttccatttattcaatcctatttctctgtcttttgggaatgctttatataattttcctcatataggtttttgatatattttgtaagtttacatgtatgttttttatttaatattgattttattttgatattgcatttattattccttctttgaattttatttgtatatgaatgtcattgaattgtatatgttcattttataacctgttactttactaaattatcttttgtttttaataattttgccattgattagttcasgttttcctgataattatacaagatggaattttaaaattttcttaacttttctatagaatacacaatttttctaagttactatgaatcaggagtttgggcatgtttctggaggtcatacttaacctctgtgttgtattgtgtatgttcaaatttcttgtgtgccatgacctgtgtaaatgatattatttgtttaataacaggagttagaaaggcagaaacatatgtgtagtgtgctgcagcataagatggaagaacttaaagaaggcctgcggcaaagagatgagcttattgaggtatgtacatgaactgtgggaatacttaattttgaaaaaaaatgagttgaatgggatgaggatgtgttgggagggaaggagagttaagatgcatcagagtttgtctctttatatttgactgtacactamaaattttcaaacataaaccagattatgcttaaaaattaatactataaatcctataaacattaccccactttggtagcagaaatttttgtgtcttttattcctaagcacactgtttcctacagatatcttaggaaatgggcaaaaggaaaaattatagaataacattattctttggaattagtgaatgccatcttttgggacatgattcttggggaataagtttgattttcactcaggtaaatacatttctcaggtggctaaatgaaaaaagaagaaacatcaagatacgttctgtacaaaaaggtaaagaatggttagtctgaaggttcaggtttctgcaagcraagggactctgccacattgctggcaacatcttaggaatggaatgaagcatagtctaccaagaactctttgaaaacattagtcatccttgcaggcctgctacattgcatgcatcttttttctttaaatgtggttttccctcctgagacgatgtttttagataaatatggaaataagtttgaagggggatcctgcccactatctaggtgtggctatcaaaggcatctaatgttaagttagtgttgacacgccagagatgtcaggaagcatagattgttaatgatcccaggagagagatctcacaaccacacttgtccacattcctggctactcagaccttagcctttctttttctctccctctttctctctttcccctcggacctrcctcttaatatgtctctctacaaatgatttttaaaaaccatttaatagagaaaaagaaatgactttaaatttgaagacgtgttaatttttgtcatcattaagaataattgaacatactcagaatttgtggatttcaagtgcagatacagataaccttttggatctatcagattacatgtgaagttaattttcttggtttttctccatataaggtaggaagcatattttccagaatctgtatcctgctggtattttaaaataatgtgaaattctttccctttttgttcttttatctttttgtgccaaaatgccaaccacataaaataataaacctgctttgggggctgcttctcaaattcaatagcttaagttaggactggtaaagtgttctagtaattaattgtaattgcatttaagaagaatataatgcttgatttctatagttcatcactgtggcttctttaaaagcttagggtgctaggtatacaaactttgagaactatagttttagatgttttttacatctagaatgaacatcttttagatgttagtatctatggttatgctgaaaaactttaaatattacaaataatgttttttggtctttggaattgaaaattccatggtaaagtacctaatgtatgagtagggaaaggaggacataataatttaccaataatgcataagaagaaaacctgttaagcaccattgcctaattagaaaggtcatttaaggattgttaaatgctaaatttaaatgtttcaaaataatataattttaaaataatacaaaattcatggtgttcttgctgtcatagattttgctaacagaaattcaaaatgatcagttctgcttaaaaaataaaattcaaaactgcttgttctctaagatgaaagatcatttgttcataagcaaacctaaatttccctctctaggaatgtaagttcttgtttggtaaaaaggcagttatcaaagaaagaatatacatatggagctgtatgtacacagaaattctagctggcttgctgccacgtagctgtggttggaacaattattcctggttcctttgcttacttttgtaggggcaagccaataagaatcttgtggccaagactgtgaatgtcatcttttcttttggcagaccaattttgcttttcctgttcatcacagactttcccttttggttaagtttctttatcggctttatttttgtttcctccctcaaacctcctctcccttttctttctgctcttttattacttctcttcccctcttcctctgcaggagaagcagcgcatgcagcagaaaatagacaccatgacaaaagaggtgtttgacctccaggagacacttctttggaaagataaaaaaattggggtatgaaatgaaattgggctttggttagaagctcattgatgaggactacagtagaatttaacctagagattgaaaaaacctgtccttttgattcttcttgagcatttacacagtatgaaaaatgagtcagtaggagacagagacttccataggaaaacctgacgttgtgcctggaagaactcttcttttcagcaaacactaggcttgtaaaatgtataagtaggaacttttaaaggaagtttctctgtattcccttaggattctttttttttttttttttttttttttgagacggagtctcactctgttgcccaggctggagtgcagtggcatgatctcggctcactacaacctctgcctcctgggttcaagtgattctcctgcctcagcctcccgagtagctgggattacaggcacacacaaccatgcccagctaattttttgtctttttattagagacggggtttcaccatgttagccaggctggtctccaactcctgacctcaggtaatccacccaccttggcctcccaaagtgctaggattataggcgtgagccaccatgcctggcctcccttcagattcttatccagaaacagccacaggcattcaattcaaactctgtggttaacttgatatccttacgttacaggaatttggataagaagagggtagtggtggggagaaagttattagcatcctataaatccttggtgtataaaataggaagagattaaaatcaattcaattacagaaatggataggaatgtaagactttctagggtggctgtctgtaattataaccacagaactcccccaagtaagggcccagataaacgaaatgtcttcattgctgttttgctaagccttgcaggtagattccatgtacaccaaaagctggaaaaaattccctccagttcatctcatgtggcctttgattggcagtcccatcacctggctgagctctctgttctacagtaggggaaccacttagccatagttgccagaggcttaccttgtcagggaagggcagaggaaatagaacatgtaagaaaagtcttgttctgcttaaggttagggggagtagggaatagttgttaaagatccctgagaacatctcttgagagacaggcctggatatgaaatcctgtggattataccctcagaatgttgttaggaacattctgaagcccaaccagtagtcagcaggatccagtctttttcatcacttcaaggacctctctcattaatatacacatgggaagattacattacctcttaagagtttgtaggctcatgcctggaatcctagcacggaggatcgcttgaggccagaggattgcttgaggtcaggagcttgagaccagcttgggcaacatagtgagacccaccctgtctctgcaaaagaattttaaaatttgcagagcatgcacctgccccagctacttaggaggctgaggtgggaggatcactggagcccacacgatggaggctgcagtgagctatgatcgtgccatggcactccagcctaagcaatagagtgataccctttctttaaaaaagtttgtagaccaaaaatttaaagaacaaaagctactttatagataattctctgactttcaaattgctgagtattaaaaattccatctaaacctagaaaagccttctggggaataaatcaataattctgttaggtgttttgaaactatgattttaaaattgaaatttgaaattgaaaagtgaaatttgattgttgaaccattgatttgatttaaatttttgcttgggaaatataagaggtgaaaaaacgtggggcaaagtaggtaatttaaaatttttagttaaaatctggtcactgtctagaatgggcttcttttaggacttcacataattttctttaacacagatctgtaggcccaggatttctagcttgtatgagtgccttaatattttaaactgataatcttggaccagccatagaaacccctcagatgtctcagtttaaaatataaattatttggcttttaattggaaaatattttattttagtattctttttttgagatggaatctctctctctccccaaggctggagtatagtggcacgatctcagctcactgcaacctcctgggttcaagcaattctcctgcctcagcctcctgagtagctgggactacaggtgtgcaccaccacgtccggctaatttttgtatttttagtagagatggggtttcaccatgttggccaggctggtctcgaactcctgacctcaagtgatccacccacctcggccttccaaagtggtggtactacaggcgttaacccccgcaaccgggcctaaccctttttaaattaaccattcagtggcattcaatacatttaccgtgttaggcaacccctacctttacctagctttaaagcctttccatcccttttcgattaacccccttaactgttccttccatttccttttccctccgccatttgcaaccctccatttgccttttgtctctatgatttttttttttttttttgagacaggatctcactctgtcacccaggctgaagttcagtagcgtgatctcggctcactgcaacctgtctcccaggttcaaccaattgnnnnnnnnnnnnnnnnnnnntttcctcttaagaggcctttccattataccccgtgggaagttccctcccctcttaagagttggagggcccagccggaacccctagcacgaagttccgtttgaggccagaggattgcttgaggtcaggagctgaagccaggtttggccacattagtgagacccacccttgtctctgcaaaggatttttaaaaatttgcagagcatgcacctgccccagctacttaggaggctgaggcatgagaatcacttgaatccgggaggccaaggttgcagtgagctgagatcatgtcactgcagtccagcctgggcaacagaccaaaaccctgtttcaaaaaaaaaaaaaaaaagaggaaatttaacagagatcctatatattctttgctcaatcttccccaaatgtaacatcttacaaaactatagtacaatatcacaaccaggatattgcccttgatatggtgaagatacagaacatttccatcaatataagggatttctcctcctcttgcctttttatagtcatagccttaatctccccttcccctcccaagccctaagaaccactaatcttttcttcatttgtgtagttttgctcttttaagaatgttataaaaatggaattatatagtatatgttaaccttttggaattatcccttttcactctgtataagtccctcaagattcttccaagttattgaatcacgagttgactcttttttaatttgaaaaattgtgctaaagtacaaataacataaaatttaccattttaactatttttaagtgtacagttcagtggcattgagtacattcatgttgttgtgctactgtcaccaccatagaactttttagtcttccccagctgaaatctgtacccattaaacaactccccattcagtcccttctcccaaacccctggtggaatggcaactaccattccaccttctgtctctgtgaatttgactgctctaggtacttcatgtaagtggaatcatacagtatctgatttatttcacttggcattatgccctcaaggttcattttgcagcatatgtcagaatgtccatcccttttaaggctgaatcatattccattgtatgtatataccacattcttctgttgatatatcaacacatctaccttttggccattgtgaataatgctgctgtgaacatgggtattcaaataactcttcaagactctgccttcagttgttttcggtatgtacccagaagtggaattgctggatcatatggtaattctgtgtttaatttttttgagtaacagttatactgtgttctgtagcagatgtaccattttacattcccaccactagtgaacaagggttccaatttctccatgtccttgccaacatttgttatcattataatacaagggcagtggtcctcccttgacttttaagacacattttcagtatggtcagtaactacttgtctctagcttcatttttaagatttacatttagtaacttaatgaagaaatatgtccattattcccaggttaaagttcagttcattagtggtcttgcctctagctccactgcggttctaaacaccaggagcccatgtatagaataggtgcgtatgaagaacttgcgtatctctatagcccagcataaactcacttccattctgaccaaagatatttgttccccagtacaattatgtggagaattaaccccttgcccaaaagttcagcccattatacacatccttttggcttccgggtggtaggatttgaggttaggtcagggataaagagttattttgaactctacaagcgtgtactttttaccctaaaaaaaatctactgtaggagctattgttgcacacaaacacaagggtagtggttatatggtcaggtaatacagagggttttagatccagcttgaatacatttgatccaattataaggtattttagtagtcttcaaactttgtggtgaagtgggtgaatttacaggatgtattttattttctcatctgtaattatgggaagaggaaattaaaaagtccgaaggtaaaaataaaacccagtgcaatacgatgtggaagaagagcaaatgtcatgtatatcatttgctagaattcctagtttcaaattggcctgttcctcagaggtcttttttattcagtgttgttgtttatgtagagcatgttgtgacagtgatcatttacccacttatatgtggtgatacatgacataactatgcatgcagataccagtaaccaaaaatacytaatccataaagtgacactcaacacatgggaaagtattgttgtgctttgttttcccaatgtttcagttattattaattattaacataatggagtgttaacactagctagatggtgctagaaatgcacattgttaattcacaggcagacttgagacacatcatatagtgtgaatgtaaattgttgaaaagaagtcagatattgacattgcagtttggataagtaaagagtaggatttgccgtatggactcctttcctagcatcatctgggctaacaataagggaatataatgtggccttcatagagctgtgatatttaaaaaactatttaagggctttggaaacaaaaacaaccagattcattttctggttttgccacttactgtgactttgggcgaaaaaatataaccactgtgagcctcaattttctgatctgttaaatggggataatacaagtacctcacaggatatgtagaggtttcaaatgtaaaataatgtataagagagaaattatataaaatagtgcctgccatataatttgtgctatacaaatcgtagttgctatcatcccttatttacttgctccctatttggttgcaaaacaggattataatgattttttgaattgcccagctattcagctatcaatttctcagcaattcgctgtcccacttccaaacccagtgaactgagaggaaagttacctgatatagtttaacttcttggattaatgggaatgctaacagaagacattaaatatatgaacaaaaatatttggggaaaggctttttcaaataggccagtaatcagattcctgcatagactacttaccttgggtgtatttttaattctgggttattttcttttacaatagattttattttttcatagtagattttatttttcattgatgaccaaagtatgttcctgcttctgcattgtcctcagctgacagttgtgagattaaggaaatggcagggaatttacaaatgaaatcaccaacctgattctcctgaactgtccctgctatctaggcattacaggcaatgctttaccttgatttatgcctctgcccttgggatgggtgctattatcccttctgtttttccagtgaggaaactgaggcataggacaagtatgtgccagaacccaaaagcctgattctgaaatccatattctgtaactcttcatagcttggctgtatttattttgtcagtgtttatttttgtttttcacattttgggagtataacagaaagccaaatgagtctcagttatatttaattaagttgtcagaagttgatctttgaatccttttggaggttaactattttgaattaagtggtatttgagtattttgccacactacttggagaaaaatctacagccaatattaaattaaaatacctatgtataatagttatttttattccagaactattttttaaaaaatcaactgtattcttgaataaactagtttagttaaacatgaaatgtggggttttttttgttcaccaaataaaaatgcacttaggcagtcagtaaggaaagctttattttactctggcttctctctttatcttccttttcctgttttatttttttcattgactggaaaagatttatttccctgcttgatgtgattaaacatgttttgccaaattgatgcatgagaaccagtttctatgagaagtctcttctggagatgtatatccatgtaactytgtatttcctcccatatctgactgtttgtttccaatcttttgactgctttcttgctttttatgcctttatctttgcttatttgaattaggtacttctctgctacctttcacctgctctttttctgtgccattgtttcccttgctaccttacctaaaaccaggccctagagaaacagaaagaatacattgcctgccttaggaatgagcgagatatgctcagagaggagctggctgacctgcaggagacagtgaagacgggagaggtatgttagcattagcctggaattcaggtccctcactgttttactctctatcttccttcctttcatcctgccatctttcctagcctaaatacaaactacagtgtttattctctaatccagatttggtaggttgaagctatttcttacacagagctatatttcatgtaactgattctaaccaggttttacctgtagcaaacatgtattgttgcagagtgacctcacagagcttacagcttccataygggccttttgtgatggtgggtttttcccccctgcagaaacatggcttagttataatccccgatggcactcccaatggtgatgtcagtcatgaaccagtggctggagccatcactgttgtgtctcaggaagctgctcaggtcttggagtcagcaggagaagggccattaggtaagatactggttgctatgttgacttggattaatgttaccctattgggttttctgctttttcatatcccagcttggaaaacaaaaacagcataagggctgagactcaagtagatccttaactagaagaatctgggcacattggcacattgtcttcagacatccttgaccttgggaaatcagcatctgggtcactgtaaggcaataagtgtaactgtaaggcctgtggatggaagtactatgggcctatacacatcggtttttacttaactacaaactkttctgcaaagagatagtctagtatacctgtgctaggggagcagtaggctagcaggagacttctcaagtgtgttataagtttctcatccttggaacatctggttttatgttccactgcttaccccagggttctgtacctcttttccaccacatttcttaagccaagaaacagatgaccaaaaagatatcagagaagtatgacttccagagcagggcttcccagactcttaaagtctaaacctcttaaatttaaccctttgagaatctgacacctctctccaggaaaccacaaagttgctgacacctctgtctgagaaatcaaagtcacccatccattgaccccacaaagaaatctactctagaggaagaaaaatggcacagatagatactgtatcattagctcacttttattttaaaaaaaaacaatttttttgtttttcatcttgttttcatatatgtgtaagcttcttagaggagtgagagatacaagtgtgaagcaaactgaaaaacattttgaaagttagtaagcacattctctaatgtgcattccagaaatgtgattgtagggcactttgaataaaacaggatgctgggtgagcaagagagatctggagaatggaacgagagtctggctataggcagcccagagtgtttccctgctgttttttccctcgtctgcaggtccaagcaggcagatctgcttggaaggtgcagaagaaaccaaaatctttatttggctatgaccctgtttacagagggtagtggttggcgaggtatcagctgcttttttaagtgaaccatggtatctcctcagctgaaggggcctattttaatgcaggcttgggaagagtcaaacctccacaggctaggagtgagccctaatggtgctgccaccaagccgcagatcyacccatggatgcccacatcttttttttttttttttttgagacgaagtctcactcggtcgcccaggcaggattgtagtggcgcgatctcagttcactgcaacrtacaacctctatctcccaggttcagacggcttcccgagtagctgggattacaggcgcctgccaccacgcttggttaatttttgtatttgtttagtagagacgtggtttcaccattttggccaggctggtcttgaactcctgacctcaagtgatccacccacctaggcctcccaaagtgctgggattacaggcgtgagccaccacacctggcctggctgcccacatcttggagtgggtccccttccctccctactagcttttggggactttgcttcttccagcattatgctcctctcttttctcttctctagcttcctttgcccagtcctgctcttaccccatcttctttcacatatttggatctctcccgctaagggctcagcctttaggaacacacttgacatttgagttgtctgtctactagtgaaagcttgaaacaaggaaatgacctcctttgtayttctgtttgtctttaagtggcaaatcactgctgtggggaacaaatgttggatttggtgccctgataaatatcagttgtgtggaaatactttttagatagttaagaacttttctgtaatgctattaacacctttatttctttagatattcagagctgtaagtaatgtaatttatcagataatattagctgtttatgagtttgaaaaatttttaattgtttatgtactatatcatcacatatttagtttatgatctttttcatttgttttagatgtaaggctacgaaaacttgctggagagaaggaagaactactgtcacaggtaaaggcattcttattggagtgtaatataattttaacaaagttacatggtaaaatactggctaattgaaatgttcattaaaaaaatatgcttctttcaaacatcagtactcaagtgagatatgaaggatagataattcatattttacctctttgttattttctgttcttaaaacatttttttaaggacacatagtttaaggagtcatatagttttttacaaagcttgttatgaacacagcagtcccctgccctggctcctctgacctcgcccctgaccatttctgttaaatacttttagctgattcttgtgtactgtccttgtatctctgtataamatacttatgttgcatcttgattgttctgcttcaggcattctatattgacatccttttatggaagatgaggatttagctgtttttcatcctttgtccctgccacacacatacttattttccactcttatatcctcctaataaaggaacagtgtaattccagcctgcttgtgtcattaggaccctctaaacactactcacacagtggagccaggttgcattctaggatcatctccctcagaactattagtttcctctaaagttaatgttatggtttttctttgtatttgcttggttttctatcatcaatttagccacagaatctccaagagtagattaatcccactcagtattttcagatgcatctggtgttatttcagttccagtttgttgaatcttggtgcatctgacttgtccctttctaaactagtgacttgccctctcggtacatagatgtggtcacccttcattggcatctggagattttctttgcatgtgatttaggttgggttccctttttccggtgtctcatgcctttctccttatttattctcttattttggtacatcttccagtagcttcctgagaagagggtttgtggattgttaatttttcatgaccttgcaggcctgaagatgtcttcattctaccctctcacttgattaaaatagtttggctgggtagagaatcctgagttgccatggttctccttaagattttttaaaaggacatttcttcattgtgctgtgacttcgagcatggctgttgagttttcatgaacattttgagttctgatcttttctgatttgtgatctatttttctcctctttgtggaagcttgtatcctattctctttctctctagcattctggtgtaatttgaagatagtcatgtgatttgaagttttcatgtgtgatgctgggcccctgtcaattctaggagctcccatcctttagttctgggaaaatttcttgaatgattttgttactgatttttttcccctcccatatgctgtgttctctattttggaactcctattcagtcattcaacaaatgttgagtgagattctactatttaacatgcactattctaggcactgggatatttcagtgaataaattagtttagaaaaaaaaaattcctgcctgagaggcattctagtaggaagacatcagacaatattatatgatatgttagaaggtttgtgtgaatgcatttattatatgtgtttctctggctacttacagcagcataggggcaggcatggagtgggtagagagctagattttactaggacagtattaatggggcaggagaggtgagggagtatgtaagaaaatgattataatgatggaccttgaaattaaactggatgaagaggattcgggagatattcaggaacacatcaaggtatagtagaaagaagatgtaatctgtagattagtggtaccagtgtggttgaagggttgttggaattcgggtctagagagaatgacctggaaagatgaggaatagtggttagagagaggatacatggaactaaattgtgtagggattacaattgtctaatgatgagatctggtatatgactgtgggagtgagtagctgagggcaagaagggatagatagcaagatccttggaagggaggtgggttagtccattttttgcttcgctataaaggaatacctgaggctgggtaatttataaagaaaagatgtttgactgggcacagcagctcatgcctgtaatcccagcacttttggaggctgaggcaggtggttgaggtcaggagttgagaccagcctggccaacatggtgaaaccccaactctactaaaaatatacaaaaattagccgggcatggtggtgggtgcctgtagtcccagctacttgggaagctgaggcaggagggaggtggaggctgcagtgagccaagattgcgccactgcactccagccttgggtggcagagtgagactttgtctcaaaaaaaaaaaaaaggaaaaaagaaaaagaaaaagaaaagaggtttaaactggctcatggttctgcaagctgtagaggaagtatgttgtcagcatctgctcagcttctgagctcagtttcctgaggcctcaggccaggctggtcttgaactcctgaccttaggtgatccacccacctcgtcctcccaaagtgctgggattacaggcatgagccaccgcgcccagccagcctcaggaaacttctcatcacggcggaaggtgaaggggcagcaggcacgtcatatctcgagcggaagccagagagagtggggaggtaacatacactcttaaacaaccagatcttgtgtgaactaccagagcgagaactcactcatcaccaagggaatggtgcaaagctattcatgagggatctgccccatgacccagatacctcctgccaggccccaccttcagcactggggaatacatttcaacatgagatttggaggggacagacatccaaaccgtaagaggagatataccagaaattgagagatcatttgtaagggagatcctctacttagatgtacattgaaattgccaaaaattaagacaggaatagtctagagggagtgcaagttgggagctatttaataaatggtgatgaaggaatgggattttggcaatgataagtagttagtgtatataatttgaagagacgagattaagacctgggacttttagggaagatggagggaaaataccagcaaggaaagcaagaggacacctattccatttctagattcagtggtaggaagctgtggaagtacaaaaaaaaaaagggccgggcatggtggctcatgtctgtaatcccagcacttggggaggccaaggtgggtggatgacttgaggtcaggagttcaagaccagcctggccaacatgacgaaaccccatctactaaaaatacaaaaattggacgtggtggcatgcacctggaatcccagctactcggggggctgaggcaggaaaatcgcttgaacccgggaggcggaggttgcagtgagctgagatcatgccactgcactccagtctgggccacagagcgagaccctgtctcaaacaaacaaacaaaacaaaacaaaacaaaacaaaaacagtgtttgagagagctgcagaagcagcaggagagggttatcagagcacgagggtaaaggggggatgctcagaaaagactgaggacagagggtgtttgctgatgatggactgataattctagagggcccagtggaaaagtttcaggcattgggaaaggttaggagatgaaggttagtggtcgtacagacccttgtgaggaagactgcagaggaaggatatgaccctttgtgagatgcacataaataggaatgatggagatactgagatttgtcctggttccctcaaggcagctaatgatggtgaccctgtgtgttgaaagggcagaggtgcctgggaagtatagagttagtcccaatatagagcttacccttttcccattggggagtggcaaacttaatcttagtgcagaggcctccctttgacccctgttggtggagttaaggacagctggggaagccatctctatgtatccaattattattattattattatttttttttttgagacagagtctcgctctgtcaccaggctggagtgcagtgatgtgatctccactcactgcaacctccacctaccaggttcaaatgattctcctgcctcagcctctggagtagttgggactacatgcgygtgccaccatgccccactaatttttgtagttttagtagagatggggtttcaccatgttggccaggatggyctcgatctcttgaccttgtgatccgcccgcctcagcttcccaaagtgctgggattacaggcgtgagccaccgtgcccagccccaattatttttacatacaggatgttttctaagtaagaaaatttaacctatgtctaaaagtaaacaacaaaaaactgctcatggaatcttccattttaagaaataatctcttgaatataccctatcagttaactgtttatatttttgttttattttttttagagatgaggtctcactgtgttgcccaggtcggtctcaaactcctgggctcatgtgatcctcatgcctcagcctcccaagtagcctgatacataggtacatgccactatgcctggctagaattttccattttaaataaaagtaacaaaaaataccccaaagatgtactgttccataagcagacacaaatttaaaatatggctattttctactgggacacctggtcctggggcttgctcttttcgatrtttgttcgtagcttatctttagcacctaggacgatgtgtgtctcctattaggcactcaagaaaataggttttgaatgaatgtggstgatacgataagggtctgctttgttctatgatgtgaccatagaataagcatcggcttcatttgagagattggatcttgctgatgaacctttattttcatttcagattagaaaactgaagcttcagttagaggaggaacgacagaaatgctccaggaatgatggcacagtgggtgacctggcaggactgcagaatggctcagacttgcagttcatcgaaatgcagagtaggtaccaggggacaggccagtcccagtctgtatatagactgtgtcccaggggtgggtttgtcagcaggttgctggtatcttgtaatacacttttcttttttttttttttttgagatgggagtctcactctgtcacccaggtcagagtgcagtggtgcaatctccgttcactgcagcctctgcctcctgggttcaagtaattctcctgcctcagcctcctgagtagctgggattataggcgcctgccaccatgcccggctagttttttatgtttttagcagagacagagtttcaccatagttaccaggctggtctcgaactcctggcctcaggtgatctgcccacctcagcctcccagagtgctgggattacaggcgtgagccaccgcgcctggccgttaatatgcttttcttaagaagagctatgctgcaaaaattggttagtccttggctagtccagaaaaacagtcctagtcagcaatatagctgaatagaggctccactagcctgtgtgcttcaggggataatgaggtttattgctcttaccctttctggataaagtgatttctaggaactttttgcacacagtgaaatgccttttgacaacctggcactgtccttttccacatccatttgtcatctttaagctcccatacagcaagcacccttccccattaaagttttttctctggaatttgtcttggataattggaygaatctatttggaactacttcacactaaattgagtagtttcagaattttcctagaagtattttgttaatccaagtttatctttattagatgaaatttaaaataagtccacaaaataaagtctattctattcattttacccgaattattccagtttttctcatttttctacttctgacctcataataaaatgatcactgyagtcacactaattcccatagtaggaagatttcagcaggaatttgtagttagcctttgttagtgattatgtgtaattctcggacagaggagattttcatttttccaataagaatagtgacttttctgataactaatattaaaatcttgtttattccatggacttttcatctaaaccttctgagataggctgccaagaaaagacatgttggggccaggcgtggtggcccgcacccataatcccagcatttggagaggctgaggtggtggattgcttgagctcagaagtttgagaccagcctgggcaatgtggtgaaaacccgtctcttcaaaaaaaaaaaaaagagaaaagactttttgggttaaggcttattaatactaacttttgatattggtattatcttttctgttggacatcagttaggacacttgtgacatttcctggtgaatattttgttcaagaatgtcattttggtgttggcggtagatgagaacagggacatgggaaaaggcaggctgactagttaggaagctactacagtggtgagcctgaaccagttcagtagctgtcagcagtcttagagagagggtagggaatagatctgagagattgtccttaagcagcaaatttaaaaggaaacagatttagggggaatgggctggcatttatgtgtgaatacttcctagagtaggtaggttgttgtatagctggtatttgcagaaggtaaagtacccaggcaggaggtgtagaacaaagtgagctttgcaggactgtgggaaagctggcaaagacaaaagcaagcagcttccctggaccagaaggccaggagtggagcaactcttggttctggatggtgccttgcctattatgagagtgttttggaatgggatttcaaaacacacatgaagttactgagataagagacttaaacttttgaaaacaggaagggaaaggtggtttggagagtgagaaggaagaagtacatttggataatcaatagattgctgaggataacaatttaaaaatcagatcctgaagcttgttttagggctcagaaataggaatacttctctttcactaccagatatggcttttggggagatggtaaccctgttccttttaaggtgacagtaattgtccaattagaaaaacctctcaccactttaggaggctgaggtgggtggatcacgaggtcaggagatcgagaccatcctggctaacatggtgaaaccccgtctctactaaaaatacaaaaatttagccaggcatggtggcgggtgcctgtagtcccagctactcaggaggctgaggcaggagaatggcgtgaacctgggtgatggagcttgcagtgagccgagatcgcgccactgcactctagcctgggcgacagagcgagactccatctcaaaaaaaaaaaaagaaaaacctctcacattgaagactgtataagtaattgtaaccttggtcatgtggaaatgtagaaaagttcttaagttagataatctgaatatttcctgtggtatgttagatttggtttatcttttgcaaatcttattactgtaatcatgccagagactgatttttgctaaacttggattcttggagggattttaaaagtcccctgccatcatttctaaacttttcattttaagtgatttacttcctaggtcagatgttcatctagtaacttatagctctacccataacacattatcacattactgaacagcatttattccaacatatatttatttaggcatacactgtgtgcacttggctaggtacataggtagatttaggaaggccaagacagggcccctctycttgcttacacatacgatgtttaaaaagcatgacaaatgtcataaaaatgcaaataaaatacagcaagggaaggacttataattaaggggagtcatgaaagaggtgaaaattgagcttggccttgaagcaagtcagaggtgggagaaaaggacccttacagtattggacagcagaagcaaaacctgggagatgggaaggcatggggccgcgttcagggaactagagggcccagtcccgtgggcagggaggctccacaaggttacacacagggttggtaggggctgctgctgaattggcagggctcctttctcaagccctgctcacacatatcatagggtaaagaattttcttctaactcttgctgcaagggatactgtagtaacatatatgctagagcatcttgtagtatatacagtccagaacctgggctgctgaagatgctgtggttgttgtgtgtrcatttgtattttgtaatttttttttggcagggggacggagtatcgctctgttgccaggctggagtgcagtggcgcgatcttagctcactgcaacctctgcctcccgggttcaagtgattctcctgcctcagcttcccgagtagctgggactacaggcctgtgccaccacgcccagctaatttttatatttttagtagagacagggtttcaccatgttggccaggatggtcgcctctatctcttgacctcatgatccacccacctcggcctcccaaaatgctgggattacaggcgtgagtcaccgcgcccagccctgtattttgtaatcttaagactgcatggtcctctctgtgccacagaggtactgcctgatggctcatactgtcatctctgacaggtgaagataattcattgtcttcttctgttctaggagatgccaatagacaaattagcgaatacaaatttaagctttcaaaagcagaacaggatataactaccttggagcaaagtgtaagtacttctatatggtactaagttatttaaatgtccttcctgcatctaagtggctaacaacccatgagtgcctgggttgcctttgcagttggatcaataatagttctgtattaaaatagaaaagccagcagagagcacttgttgggacattttagccttctgttttctctaaaaccataggaaactatagctatcaktttttgtagatatttcaggagaattcaagatcatcatttgtaataaaatcccttacgcattccaaaaagtgtamgaacttttccatttagtgtctcttcctatattgctttggcacttaaacaatatggtcataataaaacttagcatgggaaattggccctaaaatgactctacagctgtaatcctctctggggacattacttgatttataaatagcaactgagttctgagaggacttatgagtcacccttaggggacttgttagtagattacttggcatttataatgacattgtatttccatcctggctaccaaaaagtggtgacttctagtgcccagtactagaggcctrtgttctcatayttacagattagccggcttgagggacaggttctgagatataaaactgctgctgagaatgctgagaaagttgaagatgaattgaaagcagaaaaacggaagctacaacgagaggtacttcttttaatatgtttcttggagaatacattcctaaaaagaaaaaatcttctggaaataattcttagctgtgtaagaaatttgatacttaaggaaacagcagtggagtcacttaactaatttgtgttggtttttgacctgcatagtgactgccatttacttttatgttttggtcaattagatactaagtaaaaagatagtttgtatttttgcttcagatcaggtctatttctccaacttctatatatcctttctgtgattaaaacaaataaacaatcctcagtatcatcatttaacacctctaactgatagaaaaaatgaggttgtgggtcctgtgcaaggccatcacagttagcagtgctttcatttcccaggaagttgaaaatagagtagcactggatgttgtttctgaccacatgtagtgactgcattctccctgtctccagttacgaacagcactggacaagattgaggagatggagatgaccaacagccacctggccaagcggctggagaagatgaaggccaataggacagcacttctggcccagcagtaggaaaaccacccttcaacctgggtgatgctccttggggccctacctagagggactgacttttgtccattgacacaaaccccttttagtactgttttgagttttgtcattaaaacagccacctttgtattttataatttatgacagaatgaagtcattttgaatctacatgaatgaacactttggattttgttgtagtttgattctagggtagaaccagtccatgctgtttttattttttatctccgtaattgtagaatcatgtttactcaacrtttttccccagctgcctcagtaactgggcactcggaggccttggcacgggttctggaggacagacagcaattctatgagtgctcactgagatacttgctggagacctcagaaaacacaagtgccttctccacggtgcaattcagacttcagtgatctccagtggtcaaaagacatttacccttaatatcagacaacatttatattttagtgaagaaacaagttctcgggtggggaatctatgtttcactcagatttatatgtttggaggaaaaaagcctttttttgtaaaatatttaaatttatataagaaaatgttagaaaaaaatatggggagtgtatataaaacttgctttattgcatggggcaggggaagtccaggcctaatactcytaaagtaagagttgggtcctttttttcttcaatacaactgtgctgtaccttgtaaagtattttatctgctgcttatttgtggaatgaaacctcaaacaaacccaaagggggagggtagggcagggcaggcagattggaaatctgcctgcagattctrttaaatacacccttttgccaaccacaattggctactgacatgttcattttgttataggagactttaaaacaaatcatggcaaccacatccctcttcttttgtctccttctcaaggaaaaacaatctggaatgtagaacttttaaagacttgagtttcacctttagaggtaccctgtccaagaggtttttttaaaatcatggagtgcaactactttgcagaatttatgattctcttttgctcttagtacccaggtggttttatagaaatgattattgtatctttaaagtgcttacacagaaaatatattgggggaaaatctagtgactaaaggcacataagataataaaactagactttaaaaaggtaactcaaaagtgaataaaatctctaatatttgttccttttttaattagcccttcatttaaaaaatatggataccaatcttctgaattgagatgattttctatacattttctttcttttttttttgagacagagtttcgctcagtcacccaggctggagtgcagtggcacgatctcggctcactgcaacctctgcctcccaggttcaggtgattcttctgcctcagcctcccgaggagctgggactacaggtgtgcaccaccacacccgactgatttttgtatttttagtagagatggggtttcaccatgttggccaggctggtcttgaactcctgacttcaagtgatctgcccacctcaacctcccaaagtgctgggattagaggtgtgggccactgtgcctggcctcttttttttttttgagagacagtctcgtgctgtcacccatgctggggtgcagtggtatgatcttggctcactgcaacctctgccttccgggttcaagcttgattctcctgcctcagccccccaagtaggtgggattacaggtgtctgccaccacaccctgctaatttttgtatttttagtagagttagggtttcaccatgttgcccaggctggtcttgaactactgaccacaagtgatctgcctgcctcagcctcccaaagtgttgggattacaggcatgagccaccgtgcctcagcctatacatttactaatagtagcaagttgtgtggttgggggtgggtagaaaggtgttctaaagtgcaggtttgttctagaactccatcccagctaaaaccaacacactgtgtggcccagctcttgaagctcagaaaacccctcttcctctccactcaagatcacccagcctgtgccccacctgggctcatggaacctcacttctgagatgccctggtctactttatggagttcttattgttcaaaactgaccttgcctattttgtggcacaacaaatacgtctgtaacattttgtcttcctagtctttccaagtgaaattgctccatttcttcataagatgagagtagtctgttctttatcactgaactttcttcactgagtcttggaatatggattttaccttaaaaccacagacattcttcctttctgagctgaatgctccatttctctaaatgtaggcaaatattaaggaagtttattttgtcactcacagtttaaatttatatttttacatcatccttcaaacaagattacctagaaacttctttatcttaagctattagtactcatagtcattaacaaagtgggctaacttaaaaactcatacttaatgccggccgcagtggctcatgcctgtaatcccagcacttaactttgggaggctgaggtgggaggatcacctgaggtcaggagtttgagaccagcttggccagcatcgtgaaaccacatctctactaaaaatacaaaaattagccgggcgtggtggcaggtgcctgtaatcccagctactcaggaagctgaggcaggagaattgcttgaacccggtaagcggaggttgcagtgagccaatatcgcgccactgcactccggcctgggcaacaaagcaagactccgtctcaaaacaaaaaaacaaaaacctcattatagatgaagtaaggactattttctttcttcaagtttttttccttaataattagctttggttattgtagacaccagatgatcaaatcaagctttctccatggtcagtgccatcagagcctgtgacatgttcaagacctctttttggcatctgaactgacacaatatatacataataaaattaaataagaaattatgttaagacacatctatttatttataatcaatccactgtgtataaaggaatactatcagaaggcaagtataagtcttaagtgctaccaacacttatgttggtacactttgtatatcacactttgatacaacactttgtatcggaatacagagaaagaagaacacatcccacagtgcataaataaccatatttaacaccwctcaaagactytstatagatcaggcaggttagcaagctgcaggatatttccatcttctgtgaaatgttwaggaggcasaatgtgtgagcgcaaggctttwtagacaatrtrttccayagtycacttccaggagtttggaatggarccaggcacttcactctggaaaacacattagatgtcataagcctccctgtttgcatcccaacatacactggtgtcctggctgatgggatgtgcactgggtctggaaagacttggtgttatctagggcttttgaagtggatcttgtgggctagcctctcaggggatcccacaggcctgaacacaagaggattttttgtttgtttgtttatttagagacaaggtcttgctctgtcacccaggctgaagggcagtggtgtgatcatagctctacagcctcaaactcctgggcttaagccatcttcccacctcagcctcctaaaatgctgggattacaggtgtgagccactgtgtccagccaacatgaggttttaaagggaggaaaagaagccactgctctgtgggactgtctcctgtggaacctttgttttcattcagggagaaaatggttttattgtagcaggagctaacatcatgtctgatcctgactgatatttggatggcaactgtaggaagtacctaacttaccattaaaatcgggtctgaaagtagttctaatccccaggggaggaatgaaaatattaatgaggattattttgcctcattattcctctccttcttgtaagccttagctgtctcatgtgtaagaaaatgttctttctcaactgtccttcctcttcttgaggtaaaatttctaatcaaatgagatagtttccacacagtttggtaagtgtgttgccttctccactggagtgagaaattccctagaggctttggccaacaggactaaatctctgccctcccacctacagacttggaatcctcgagcatgcctgactggccttcagcctcctcatctgaaactcgctcacactgctcaggagatgactgtgagcaatcaggggtcatactctgattaaagtgggctactctttgattcttagaatatttcaactctcccttccaacctcccccaaaatatatgttgatttgaaaagcattatcatctgactgggaaaagtgacaatgaaacattaggaatccaggcaccctttttgtgtcaagctgacctgtaagaggagttatagagccttgttttcctggcagggcagtggtcggataaagagtaaggcaaaagctaagagagactgaggcaactgacccagaatctgaagactggctacacacttcagagctaacagtgggagtatatggactctccagccttagacaatctaactcaacctcccatttctcactgtgatggcttgtgttttcacatttgacaatttctgaggtcactctggaggtatgttctacatcagcagatggaagtaaaaatcatgaataaaagctgactgttgtgtttgaaccttgttgggtacaaagaaatcccgaaattttagagatgggcaagtttcatctcctaaagattgtatgaggtcctgtcctagtcctggggtgccagtgtgcatcaccactgtacctgctggcctsagagggtcgactcctcagatatgtactgcttccrgatggaatagaacatagygcattctttactgaggctttcaaaacattccttttcttcgtcccaattcacctggtccaaagaaattcaatacctcaaaataggtacgaatttaaacattctcattctaaacggagatcacagactacttaaagctaaaaaacgaaatgtgatactttaggcgttaaaactrtaaatgggactgctgaatattgctgggaatgaatattagtggggatgagagcaggccttcagctatcccacccttatcatctttatcattccagatcaaagggtggtcatttgccctttccctccagcacacatgcatgtaccgaaatgcttagtatctgcttgatcactgacctcagkggctagtsraagaatgaagataggmagtccctccaaaggggrcacatagttgtcaatcagaaggggtaatccaatyaggttcccttcctgcttgcaggaaaaasgacaagggaacaagaaataatgctgtcatagtttaaacaaatcccatttctccagtgctttcccaggccttgtgctcctatctgccactctgggtgaccacgttacttgattgggctgggcactgggggcagacctaaacacttaaaaaagagtttttcatcctgacaaacagcacggcagaacaaccttttctttggatctgttcacgatccaaagaacacatcaagatggagagccccaaaaatgaaagaataagaagaaatgggagcaaatggcataatctcatttataatggcctgcagggattcggctctccatgtctgggtccttcaccctgggaacaagagtaggcatgcatggatagtagtacagttatataacctagaaatgcaaatagggagtggagaggatgtcacatatgtcacttgctgcttctgaggggaggcctagtcctgaccttggaacgttctttttttttttttttgagacgcagtctcgctgtcgcctaggctagagtgcagtggtgcaatctcggctcactgcaacttctacctcttgggtttaagtgattcttctgcctcagcctcctgagcagcttggattacaggtacccgccaccacgcctggctaatttttctatttttttagtagagacggggtttcatcatgttggccagctggttttgaactcctgaccccaagttatctgcccacctcagcctcccaaagtgctgggattacagccatgagccaccgcacccggctggaaattttatttgaagaatacaacagaagtataagaatggctgtcacacctcatcaatttccaaagagaaatagtctgcaagcatctcagcckwcttcttcagaaactcaacaatgtattcagcawgtccttcttwgsgaccatcttcctctgtccagccactctctggactatctaaggcaagcatggcaaggtcaaagascggtgctggcycctaggaagaagcaagaacatgaaggagcaagctttaacggagcatccaaatgaagcctgaattcccaagaatccactatcagaatggcaggtgagaaaccataaatgtaacactcatcccccatataccccaaaggaagtgcctgaacaatccacaacaaaacccctttcctcctcttgtcaatggccatttcaacagagaagatacgacagacaaaaagcctgctgaaaggatgggaagggtgaagccctggggaggtactttctttctgtgtagccttaaggactcaactttcgtatttctagaaaaccacaggcagatcatttctttctactgcctcataaccaaagctgggcgggtgaggatggagagtaagttaaattgaatgacatttcaggtaaatcatctaatgcagaaacaaagggaaaactatgcttaaaaataagatgcctaagttatcttccatttctccccttctgataatatgttactcatacttttacatatgttataaacccacagtatattatcttttcataatagaagagtccattatcaaaaggatataacaatcctaaatgttt

SEQ ID NO: 12199 - DNA, 62892 bp, Homo sapiens
ttacagacatgagccaccccacctggcaagatcttatatgtgtattcaagatattacacaactcactaagtctccagatgaaaaccagaatctctaaatatagtttgacagtttgacaatgcccaatgacagactaaatgagaaattaggaggcagcttgatttttttttatttcctcagagatctttgttctgagttctgactcttgttctacaaatattcaaagtcgaaatgattatcatgttaatgggtaaagagcttcaaatctttggctatctcatttttttttaatttttattcatttgttttaccttatgtgttcctctacaatggatatctaggaagttaacaaccattctagctatctagcattctggttcttgatatcatgtaaaatgagcgttctgatctctgacacacaaagctatttagaagataaaaaatagacatttttttcaacaatcattttacttttttctctacatctacatactctacatgtcagagtttttgtttctgttttttcgagagtagctgggattacaggcacctgccacaacacctggataattttttgtatttttagtagagatggggtttcatcatgttggccaggttggtctccaactcctgacctcaggtgatccacctgcctcagcctcccaaagtgcagggattacaggcatgagccactgcacccagccaagtactttgattcttaatggaggatttaatccactgacatcccaaaggacaaactatccaatggaattcctggataaaacacaggcacacagtgtctcttcctcagaggaaagaaatttttgtcaacagaagaattttgctcttctgggcgtggtggctcctgcctgtaatcctagcactttgggaggctgagcctggaggatcacctgaggtcaggagttcgagaccagcctggccaacctggtgaaaccctgtctctactaaaaatacaaaaattagcctagcgtggtggctaatgcctgtaatcccagctacttgggaggctgaggcaggagaatcgcttgaacccgggagtcggaggttgcagtgagccgagattgcgccattgcactccagcctgggcgacaagagcgaaactccatctcaaaaaaaaaacaaaaaacaaaattgatttgctctagcagaaaaataattatatttcaggaattccttcaggaatcctataccagtactaaaagatcctatattggaaaatgaaaatgcccaaattaataagtcctgagatagaggagaagggatcttgttttgtccatcactgtatcttagtacctggaatagtgcttggcacataataagcattaaatacatacatggcagtcttgtttctgaaccaaaatgaggtggtttaatgaaagagatgggtttggctaggcgtggtggctcacacctgtaatcccagcactttgggaggctgaggcaggtggatcacttgaggtcaggagtatgagaacagcttggctactggctaacatggtgaaaccctgtctctactaacaatacaaaaattagccaggtgtagtggtgcgtgcctgtaaacccagctgctcaggacattgaggcaggagaatcacttgaatccgggtggcagaggctacagtgagtcaaaatcctgccactgcattccaaactgggctacagagcaagactccatctcaaaaaaaacaaaacaaaacaaaaaaaacaacaacaagtgaaatactgaaatactgatcagctttaaaaagagaactgtcataaccaccccaatttagttccaagacttaggcttccccaccaaggcaaaattaacacagtaagaaggctattccagttcattttggagaaaatcttggatttggtaagcaggtaaaaagagctgggcatgctggctcacatctgtaatcccagcaaactgggaggccaagacaggaggatggcttgaggccaggagttcaagaccagattgatctacatagcaagacctgggccaggtgcagtggctcactcctataatcccagcactttggaaggccgagacggctggagaacttgaggttaggagttcgtgaccagcctggccaacgtggggaaaccctgtctcaactaaaaatacaaaaatcagcagggcgtgttggcacgcgcctgtaatcccagctatttgggaagctgaggaaagagaatcacttgaacctgggaggcagaggttgcagtgaggcaagattgtgccattgtactccagcctgggcgaggagagcgaaactctctctcaaaaacaaaaacaaaaacaaaaaaccatagcgagacctaatctcaattaaaaaaataaagaaattgtatacacatacatgcacatatatgcacactacacacacatatcacatgtacgttttgagaaaaataacaccatgaacctactacccgttaaaaattagagaaaatattaaacttttcacaaatttacatagcattcttatacaggggccatgtcaatagaaagaaaggactatcagacaatttttcctaaaacttctccattatctcactgaatcctataatctgtcctattaaaacacctttttacatttcttgcttttttttttttttttgtgagacagagtgttgctctgatgccgaggctagagtgcagtggcatgatttcagctcactgcaacttccccctcccagttcaagcaattcttggttcaagcaattctcgtgcctcagcttcccgagtagctgggactacaggtgcactccaacacatgcagctaattttttgtattttagtagagacggggtttcaccgtgttgcccaggctggtctcgatcttctgagctctgacaatccatccgcctcgtcctcccaaagtgctaggattacaggcgtgagccaccccacctgaccaatttcttgttcttttaaaagtacagtaattatttttaagttccagtaataaattaatgggtagtctgtcaaatagctactggattttatatcaggagggctttctacatgtatgtatacccaaaaatgacattaagacctttttacataaactcactgtagagatacatcccaaaacaaggtaaggaatataaatgatgtttaccttcttttcaaaccaacagttcctttatacaaaaacaccagatgatacaaaacatatttttttaaagtacaaagttccatacagaataaaataaacactttatggttattcctaagaataagtagtgacaaaaagtctttgcaattgggtaataaaatttcagcttctaggaatatgtttccctcttccttgtccttttgagagctgccactatcacacaattcacagcatctcttcaaccacagaaaattagcgtctcttcaagcacagagaccatatattaattatctttgtgtctcctgcataggattaactcagtgtttgttataactaagttaaactccaagacaggagcttcaaatcacctcaggcccaatccaaaactgaaaaaaagacgcttctcagagtttgagaacaaaaagatactgacaaagaacaaagccatagatacttgtgcgacattagcttccctttttaccaaatacagagtcatttactaatactgcagaaatgtttgcagacgataaaaagaataaattaaaaatatggatcctgtcaacatgttcaaatactaacatagactccttcaccttaaactcatactaacatccacacacccgaacaatgaaaatgaaaggttttcaaatgagatctaaatataaattggctctatttcattacagtttaagttcctaaaatcatatatataaatcatgtgattgcgcttatgctcatcttctaacttgagggcccagtgtctttcatccgattctctgaaggataagtgaccccaaaaaacttttaagaaccactaatctagcctatcaagaaacatcccattttccagaagaatacagctaagttggcttagttcatgcattcttacctcatattcatagagttcatagacgggatccttactacatgaaatcagtcttttttttttttttttttttttttttggagatggagtctcctctgtggcccaggctggagtgcagtggcgcaatctcagctcactgcaagctctgcctcccgggttcacgccattctcctgcctcagcctccccgagtagctgggactacaggcgcccgccaccacgcccggctaattttttgtatttttagtagagacggggtttcatcctgttagccaggatagtctcgatctcctgacctcgtgattcgatctcctgacctcgtgatccgcccacctcggcctcccaaagtgctgggattacaggtgtgagccaccgcgccctgccgaaatcagtctttcaaaggattccttcagcccagccaagaagttccaacatccacaggcacatatattaacaattaccagtacccaaaaacagttctctggttttaattccacactgcctccctcaacttaatacctaccaccgtcaaaacaactcccctcagattgcatccaggctatttacagagacaccttgatgatcctcacctcaaggcatggaccattcattgaatggttatatttgttgaatgagtgaaaaaggatccttcctcccacagatttcaagttaagctgtcagcacccatgcagctgctctggtacaagttaagctgtgaaagccttctccctcacgcatacaaccttaagtgtcagaaatgctctgcttcctccataaatccaaaataatatagccatggatatgcatttcatacaggtcagactcggcaaggacagctacgttccacatacatatctgacacaatcggtctcccccaaatacaagccaaccagtcttatgtgctcctatctttccagcatactcagatttgccgacaaagacttcctgaggcaccatggtatgctgaatatactgctgcagtagtagtgaaaatatgggagttacagttccaactttgtcaccaatttaacatgcggccttggagaagttctctccttatgcctaaatttcctattttgtaaaatggaagaaagcatcctaccattttcacagagattcagtatcacaaagaaactgaaagagctttcttattgtattgtaaactattactataaacccgcgacaacaaataaggccacccattctttacagctttgtagcaatgattctgttaaagatattttggcccttcacatttacacaactcactctaaccaaaggcacaaactattcttaagaccacaactggctatgccaagtttctcccctccctgacctcacagacacatgctgtacagaacactaccattgccgctctttcccaacaagtaactaggggctcccaatccctaaaatacacacacatatcaacctgcaaggaacctcccaacatttattcaagaaataagctaacttataaggggaactccattacacttacacaaataaaggcaaactcttacggaaacacttgccatcctcacatacacacaccaacacagccgctacacaccaacagaccatctgtctgctagaccaaaaacatctctttccatgtacaaactaaccagtgacatttattaaacgtacaacactgagatcatcctgtcgttcccacataccgttcaacgcggcagggacaccacagaccttgtcacacaggtaaaatcccctctcaagatcgtgtcctcgaccactcttatcccttaattaaacacacacaaactggactatgggggaggctccgatcatgcctacaaacacaaactaacctgtcaggggcacagccgactccgcctccactcgcttacttcccagccccctccgggagtctgcctgtcagggacaccccttcaccccgcctggagggacttcccggtaggctcaggatccccctccctgctctcccctcccccatcttcaccactgctctcycagagrtccaggtccgggagatgacagtggctcccagaaagcccaggattcaatcgctgagagagtgcttaggcccgaatgccggcccaaatcgttctactcaccgtgtcggaggccgagagcgatgagagtrcagggaagtgaggaagagggggtggccgccaggctcctccgcttccctgggtccaccgcggatccctcccgcttgtcaggaggcggccagcgggtaagccgactggcggaaatgcgagagaggagaagggaaaggtggagggctaaaggggcaaactgagaggaggcggatcccgcaaccgacactgggatcgtytcccctcgcaaagcgaacccaaaatggcggcggcagcggcggcagcagagtggccgcggcagctcctccagagggagggagctaagggcgcctagcgacacccccaacctcccactcctccctcctcgcgttcttccccacggycccccgcttcgcccgactccggccatgtagcgcgcacgtcagcccgcacgcgtacgagtgtctacgggctcgtcgctggctgctcccaccaaccaccaccttcggccgtccygcgagccagccatcccgtacgcgctcacccacgggaacctcctcgcccagttctccactccccctcagaccctgtcaagccggctccagcgcaggccctcacgcgtaccttcagcggcgcgagcccaagccttctccacctcctcttctctcctccccctccctccccgcccgcacggccaccaaccgccgccaaagcagccgccgccagcacccccaccctacactcctcgcgcgtgcgcctcccacagtccccaccgcgggactgttccattcctggcggctgcaggggcaggagaggaagggaccggcaaagcgagtctggcttgccrtttgactggaattgccagggtggccggccgagtcccatgacaacctacctccctgggttcgtcgccgcggcgctgcggctcgcctcctcctccatgggaccgcggcgaggggatcgagggcggcctagcgcccctctgccggccggtggttggaggccgcggcggctgcgcgttgagtcgtttcctgccggatgacccgacccttttttgcagtctcaggacgggcgctttggagccggccccaggcagcgtgtgtcggtcgcctagkctggagaactagtcctcgactcacggtgagggaatggaccgacacgggtattgtaccgctgagggaaaggagcgggactccggacctccaggaggtagggagtgaggccggtagaccggcgcgcctccgggggggattcctcccgggcgttgagttgccaacctgggacccgaggaagwtcggcgtggtggtgtgctttttgttgttgttaaccctcctcggatttctcgaatttcacaccactgtccatatgcgatgatgtttgtttgcccttgacgcacttactcatggatggtacttcagcctcgttagacagcctggtgatggaggatgaagaaaccatgtgcttytcattcagttctggactyagtttcccttgtcttcagcaagttatttttgttagttccttatcaaaaagtgtacataaaaattaggcaactccaaacatgcctccagggttggtgtgtgaaataataagatagggctgggcgcggtggctcacgcctgtaatcccagcactttgggaggccgaggcaggtggatgacaaggtgaagagatcgagacaatcctggccaacatggtgaaaccccgtctctactaaaaatacaaatattagccggccgtggtggcgggcgcctgtagccccagctactcgggaggctgaggcaggagaattgcttgaacccgggcggcggaagttgcagtgagccgagatcgcgccactgcactccagcctggcgacaaagcgagactccgtcacacacacacacacacacgaaataataatatatgtaaagtggaattagctcctaggcatagggaaggtgcagagtattgccgtgttgtcatttacagttctgttgatgtcgataacgtttgtgggtgtaatgggtagtgttctgtccctccaagtcgttaataaaacaaagcaggccgggcgtcttgttaaatagttgtatcaatgacttgatttagattaatgaggatatatttttcaaatttatgccttttacaaaatttttaaagagtaggtaatgtcggtgatagatataaagaaaggaaaagatctccagatgtggaatcttctactggatcctgtaacagaaagaagacattaggctgggcgcagtggctcacacctgtaatctcagcactttgggaggcggaggagggcgcattgcttgagcctaggagttcgagaccagcttaggcaacacggtgaaaccccatctctacaaaaagacacaaaaattagacaggtgtggcacacgcttgtagtctgagctacttgggaggctgaagcaggaggattgaggaagaggttgcaaagttagccgagatcacgccatcacactgcagcctaggtgacagagcgagaccctgtctcaaaaaaagaaagaagacattagcagaaaagctgaggaaatgcaaataaagtctgcaatttttaaatagtattgtaccagctttaatttcttaattttgaaaattgtaccatggtcatatgtatgtaacattaaggaaactctaatgaaaattgtaagaaagcactttgtactacctttgcaactcttctgtaaatttacacttttttttgtttgtttgctttgagataggatctatgtcgccaaggctggaaggcagtagtgcagtcctggctcactgcaacctcaagctccttggctcaagggatcctcccacctcagccatctgagcaactaggactacaggcacatgccaccacatccagctaatttattttattttttttttgagacggagtctcgctctgtcacccaggctggagtgcagtggcgcgatctcggctcactgcaagctccgcctcccgggttcgcgccattctcctacctcagcctcctgagtagctgggactacaggcacccgccaccacgtccagctaattttttgtatttttagtagagacggggtttcaccgtgttagccaggctggtctcgatctcctgacctcatgatccacctgcctcagcctcccaaagtgctgggattacaggcgtgagccaccatgcccagcctccactatcgaactttagaacattttttatcacccccaaaagaatcttatcagtaagttgctttccattcctccctcccattgcctctcgcaaccactaaatcagtttatgtaattaataagcaaattatggacatttcatgtaattgaaatcatactatatgcaactgtcttcttttactttgttttgaaggttcatccagttgtgtaatgcatcagaactttgtttcgtattgccaaataatattccattatatggctataccacgttatgtttattcatcaattgatggacatgtgaggtatttccactttttggctcttatgcataatactgctacgaacatttgtgtacaacttttgcatacacttgtttttatttctcttttatacctgagagtggaattgcaggttcatatggtaactccatgttttaccttttgaggaactgccaaacttttccaaagtggcctcaccgcttaaaaaatcctaacagcaacatataagaatcctagtttttccagattctatccaacacatgttattatcagttcttttgaatttcatcattctagtgggtgtgaagtgtatctcattgtggtttttatttgcattttcttaattttgggggaccagtctcagcaccacccgtagggtatccgaagtccggtggcgacaaaggaatgagaagagacaggttaagtgttcataaaggtgggagccagggggccagttgcaaaatggaggctgcaaaaggcccagagttctgatctccacactgtttattgagtacagtcacttagatctaagaagcagatgttcagggcgaaacagtcaaagggaagcagtacgtcatacacataatctgtagcagtggcggtttaagtgaatctcctttgtgcttaaacaacgtatctttagttagctggtgggagtgggcttaactaggagcctgcatatctagccacattccagtgcttcagaggagcgtctttcttcttgagcacagtgtttatagataagagagcaggttgtgctcagagcatgggaacataatggcgataagaaggctttcctcctcagagtcctcttgtggctttccacaacttactgtcccatgtttttatggccagtttatgcaggcaccctgtaagcctttttcccaacatgccccccttttttcttttttaaaactgccattgctattaagacttgttcctggtgtctggtctctctccagaggcatcttccgcatctgcagactaaaagcaaacagcataaacaggtacacattaaagcaaaatttgcgatagttgattctctaacggtcttaatccacttaagaggatttatgtttgaaagtccatcagcagctccagtgagaatgtcagtcccaggcaggagagttaaatgagcctgagatgctttaaaaacctgttcctttaatttggctatattcagtgtaaaatttccatccctttcttccagatgatgtctaactttttcccagtgatgttcagtagcattgtatgaatggggagttatgcagaaatcagaagtattccaatcacattgcatttgcaatcgatgctctaagcttattatacgatctctcatccaaataacagtctgtctaagatcatttatttgatttgccaattgttggtctatccgggtctgataattccacaattttgaggaattcttttgccaattatttacatattctgcagtttgaacagaggagtgtaaagcaattccagcagccacaacagtagctgtgactgcaataaggcccataatgactgctataagggtaaaaataaatctttttgttctggtaaacactccctttaacatttctgtgaggatatgaatggaagaagaggctttccaaggtctattgagggaaaccggtatctaaactcctctagccctcaccagcaacacagatgttttcacatcaaacgtggaatcaatacaggtgaaaaggtgacagttttgacaagtaatagtttgagaattaggtcgaatatcaatatttccgaccatcaacataaaaggaggcttgacacagctctgaatgggcgccattcggttggaagaaaactgatacacaaattgaagtctctcaccttttccctcaaggtaatatttttcttctcaaacctgaatatgagattgggccatcattaccttccataatttgggatgttcagggcctattattggattaatcatttttggatgtgggccggctataccaaaattggttgaaattatgggaaactgggcatgtttttcagtgtaaatagtgtcatctctttgayagtatagttcctgttttagtcctgtcttgtatctatcattctgattggtacaattaactgcaaaggtccccttaggggaccaatcagtgacaattccataggaattattttgaagtaccacagcgtgatcagagatgcaatcctggccgggagtggtggctcacgcctgtaatcccagcactttgggaggccgaggccggcagatcacctgaggtcgggagttcgagaccagtctggccaacatggagaaaccccctctctactaaaaatacaaaattagcagggtgtggtggcacatgcctgtaatcgcagctacttgggaggctgaggcaggagaatcccttgaacttggggggcggaggttgcagtgagctgagattgcgccattgcactccagcctgtgcaacaagagcaaaactccctctcaaaaaaaaagaaagaaaaaaaaagagatacaatcctttcaaatcaatatttctaaatcatttgactgttgttgaggttgttgacacctctcttttctgggcttaaactgttacagttgaactgaactctgtggatgatccgggctccatccagaaaataaatgataggatactggtctttgattatgacctgaaattttaactagccaatgttgtccgtagccttttaggcaaccgacagctggccctatgcaaagaggaggggaactgataacccatggacatatttattaacattccttcctcctctgggtgagagggcccttgagtatctgtaggctcaggcatccaaacactattattaacataagcctcaaccgggggttccaaccatgtgacaggcctaattaaaggtggaaatgggacgtatgcccaataggtataattttggtctgctgtagccacagggagacttaccaccatggtaattaccgcaatcatagctaccatcaggttactcgaggttagtggtttttgttgtgttttcaggttttcttctgcaaggtgggtcagcctcttgatctgtccccaagttggtgggctcgcttgatgggttttgttggtcttcatctggttggctgaaatgttcattcgagccatcaggcgtgctgggagtggagatcttggttccaaaatccttttctcttctttggaaatttgctcatggtagaatttaagatgtcttgtaggtacccaaactggaagctggttttcttctggggaaatacaaacaaaccctcttccccatgttatatctctctttttcccaggtctttgttttaaagtccttccaccacacaggttttccttcatgaacatttaccttctgtcctgttaaatgctcttcagctgctatagtaacctgattgcggaagatgttcaaaaaatttaaggtaacaagagccaattgtaactgcatatgaggggtggaatattccctatctccccctattttctttttatgtaattgcatttttaaggttcagttggctcgctcaacaatcgcttgcctttgagaattataggggataaccgtactgtgttcaatgctctgttgttttaaaaatgtttggaaagatctactacagtagcctggtctgttgtctgtttttaatttttgtggaattcccatgacagtaaaacaggaaagcaagtgtctttttatatgtgttgtagtctggctggtttggcaagtagaccatataaatgagaatatgtatctatggtcacatggacataagaaagtttgccaaatgcaggaatgtgggtgacgtccatttgccagatcatgttaggtgccaaccctcgagggttaacaccagttccttgatacggtagttgcagtacctggcactgaggacgatgttgtacaatgtccttggcctgtttccacataatttgatagttgtttgtaagtcctgttacattaaggtgtgttaatgagtggaaagtctgggcatcagtaagtatgggggaaaccaacaagtcagcttgctcattagcctcagtcaagggtcctggaagattggtatgtgctcggatatgagttatatagaaaggaaaatcccgagcacacacagctgtttgtaaagagttgaacaattgataaagctgtttatcaataatatatttaattaaggcagtttcaatatgctgagtagcttatacaacataagctgaatctgaaacagtattaactggctgattaaaatcttctaatactgcaatcattgcctgtaatttagctctttggactgaggaagagttagtgtggataactttaccacaaggtcccacatatgccgctttcccagtactggagccatcagtaaaaacaatcatggctccttccaaaggggcatcacgagtaattttcggaagaacctatgtagttaattttaagaactggaaaattttatttttaggatgatgattatcaatacattcaataaattctgctaaattaacttgccatgtaactgagttaataaatgcctgcttaatgtgacttttatttattggaactataatcttattgggctcagtgccataaagtttaacaatttgcatatgagcctgtccaattaaaattgtgatctgatctacatagactgtaagtgttttcatggtattatatggcaaaaaagaccattcaaccaaatcattattttgaacaataaccctcattgaggagtgtgaagtagggaacacaatgaattgaaaaggcaagactgagtcaatcctactaacctgggcttgctgaatttttttttttcaattactcttaactcattcatggccttgggtgttaattctcttttatggtgtaagttgcaatctcccctcaatatttagaaaatattagacatagcataagtagaaattcctaaggtgggctgaatccaattaatgtctcctaacaatttttgaaaatcatttaaggtttttaaagaatcttttctgatttgaaccttttgaggcttaatgrctctatcttgtacttgtatccccaaatattgaaaaggaagagttgtttgaattttgtcaggtgttataagcaatccagcatttgtaattgccttttgcaaagatgaataacattgaataagttggtctctattttttgttgcacatagtatgtcatccatataatgaatgatgtaacaatctggaaattgatctctaactagctggatagctttgcctacaaaagtttgacaaactgtggaactgtttaacataccttggggtaaaaccttccaatgatatctggctgcaggttctttgttattaatggcagggatagtaaaggcaaatttttcaaaatctgtctctgccaaaggaattgtaaagaagcagtcttttaaatctataataacaagcagccagtctttagggagcatggtgggggatgggagccctggttgtaaagctcccattggttgcattacagcgttgacctcttgcaartyggtcagcatgcaccatctaccatactttttttaaaattacatatactggggaattccaaggagagaaagtgggtgaaatatatcctttttctagtagttttttaactatttcatggaacgcccccaagtttttctgagggagcggccactgttcgacccagacaggatgctgcagggygagcctgaattgcttcttcaccatagtgaactgcaggttgggcagtaatgggtgcggcaagctgagtttcaggctccctccccctgcactcactcagctgaggaggaggtggccattccggacatttctctgaagaagctgcgggctgaacaattttctgtgtaggtttagggagaccggggggattggtagaaatcacctccggtatcgggggaaccagcccccaatatttcaacataggttctattttccgtaagtgtgccagtctgagaaataaagagaaagagtgcaaaagagaaattctacagctgggtctccgggggtgacatcacatttcagcaggttccatgatgcccctgagccgcaaaaccagcaagtttttattatggatttcaaaaggggaggggtgtacgaatagggagtgggtcacagaggtcacatgcttcagaggcagtaaaatatcacaaaggcagagaggcagagcgagatcacaaggccagggcgaaactagaattactgatgaaggtccatgtcccgctgggcacattggacgttgatattgataaacatcttaacaggaaacagggttcgagagcagacaaccgatctgactagaattcgccaggctggaatttcctaatcctagcaagcctgagggtgctgcaggagaccagggcatatttcatcccttatctccaactgcataagacagacactcccagagcagcgattttacagatgtctccctgggaatgcattcgttttcccagggttattccttgctgagaaaagaattcagcgatatttctcctattcgctttctgaaagaagagaaatatgactctgttctgcctggccccacaggcagtcagactttatggttatctcccttgttccccgaaaatcgttgttatcctgttcttttcaaggtgcccagatttcacattattcaaacacaaatgctttacaaacaatttgtrcaggtaatgcaatcatcacagggtcctcaggcgatatacatccccagcttaygaagatgaygggattaagagattaaagtaaagacaggcataggaaattataagagtattgattggggargtgataaatgtccatgaaatcttcacaatttatgttcagagattacagtaaagacaggtgtaagaaattataaaagtattaatttagggaactaacaaatgtccatgaaatcttcacaatttatgytcttctgccatggcttcagccggtccctctgtttggggtccctgacttcctgcaacactctggactctccctttttattagtacttggtaggggtggttcagagtcctgatcattaaactcctctctctcctctgactcagcctcatcatctatctgaaaagcctccagtgctgtacacaccaatgaccaaactgaccaaacaggcaaaggaatttcctttccctttctttgtgctcttttaaggtcctttccaattctttcccaatctttcaattccaaagttctctgttccgggaaccaagggcaaaattgttccacagcataaaacaaatccataagattttttgtatcaacttttacaccactacgcttcaagagctgccatagcaagctcaaatacatggcgtacttactttcagtttgtcccatttgtgtccctagctttctccaagtgccccgctcacctgcggagcttaaaactttttcgtctttgggagtcctttgtctgtcggtcctccatttcacacgcttgagcatgccttcactggattctttcgggcctcatgttgggcaccagaatgtaggggaccagcctcaacaccatccgtagggtacctgaagtccggtggcgacaaaggaatgagaagagacaggttaagagttcataaaggtgggagccagggggccakttgcaaaatggaggctgcaaaaggcccagagttctggtctctacactatttattgagtataatcacttagatctaagaagcagatgttcagggcaaaactgtgaaagggaggcagtacgtcatacacgtaatgtgtagcagaggcggtttaagtgaatctcctttgtgctcaagcagcatatctttagttagctggtgggagtgggcttaactaggagcctgcatatctagccacattccaatgcttcagaggagcgtctttcttcttgagcacagtgtttatagataagagagcaggttgtgctcagagcatgggaacataatggtgatcagaagactttcctcctcagagtcctcttgtggctttccacaacttattgtcccatatttttatggccagtttatgcaggcaccccatgagcctttttcccaacgcttaatgactagtaatgttaaacatcttttcaggtgcttatgggccatttgtataactactctggagaaatgcctactcaaatatttttccttttcatttttttaatttgaggcagggtcttactctgttacctgggctggagtgcagtggtgtgatcatagctcactgcagcctcaagctcccaggcccaggtgatcctcccactttagcctcccaagtagctaggaccacaggctcacaccaccacacctggctaattttttaaatttttggtagagracaaggtctcattatgttgcccaggctggtctcaaactcctggaattaagcagtcctcccgtctcagcctcccgaagtgtgagaattacaggtgtgagccactgcacctgacccttttgcctatttttaaattgagttgcctttcttttttttgagatggagtctcgctctgtcgccaggctggagtgcagtggcatgatcttggctcactgcagcctccacctcctgggttcaagtgattctcctgcctcagcctcccctctagctgggactataggcgtgcaccaccacgcccagttaattttggtatttttggtagagacagggtttcaccatgttggccaggatggtctcaatctcttgacttcatgatctgcccgccttggcctcccaaagtgctgggattacaggcatgagccactgcacccagccttgagttgactttattgttaagttgtaagagttctttatatattatggatataagttaagttctatgtgatttgcaaatattttctcccattctgtgggctgtctttcacttacttgatggtatcccttgaagtacaagtgtctgatttggataaaattcaattctccatttttagtttttttgcttgtgcttttgatgttatagttaagaaaccattgcataacacatgataatgaagatttactttctctgtagaaaattagaaaacttgagggaggtggggggggcggtcaccgtcccgtgccagccgccccatccgggagggaggtggggggtcagccccccgcccggccagccgccccgtccggaggtgagggggcctcggccggccgcccctactgggaagtgaggagcccctcagcccggccagccacaccgtccgggagggagatgggggggtcagccccccaacccgccagccgccccgtccgggagagaggtgggggggtcagccctccgcccagccagccgcgccgtctgggaggtgaggggtgcctctgcccggccgccctactgggaagtgaggagcccctctgcccggccagccgccccgtccgggagggaggtgggggggtcagccctccgccccggccagccgccccctccgggagggaggtgggggggggtcagcccccctgcctggccagccgccccgtccgggaggtgaggggcgcctctgcccggccgcccctactgggaagtgagtagcccctctgcccggccaccaccccgtctgggaggtgtgcccaacagctcattgagaacgggccaggatgacaatggcggctttgtggaatagaaaggcgggaaaggtggggaaaagattgagaaatcggatggttgccgtgtctgtgtagaaagaagtagacatgggagacttttcattttgttctgcactaagaaaaattcctctgccttgggatcctgttgatctgtgaccttaccctcaaccctgtgctctctgaaacatgtgctgtgtccactcagggttaaatggattaagggcggtgcaagatgtgctttgttaaacagatgcttgaaggcagcatgctcgttaagagtcatcaccaatccctaatctcaagtaatcagggacacaaacactgcggaaggccgcagggtcctctgcctaggaaaaccagagacctttgttcacttgtttatctgctgaccttccctccactattgtcccatgaccctgccaaatccccctctgtgagaaacacccaagaattatcaataaaaaaataaattaaaaaaaaaaaaaaaagaaaatgatcaaaacaaatgacagggctcagggcaaggggcaaaactgttcccctgccaggctgtttgatagaaaaaggaatggttttcttagttctaaagcttcaaccacactggatccttgtgttttcacaacccttaaggttagagccaactttcaaaaagaataattaaatcgggaaakaagtggggtcagcaggtttcgtagtgcttttaaacaggaagtctcagaactcatggagggaagtagctgacagcaaaactgctttcctactcatcaacccaaagaactgcttaattccagaagaagatagaggagcacatctcaccaaagacaagttgaccctaactcttaaatcatctacagccaaaaaactgattctgtacctggttgatcatgcctgtaaaaaaaaaaaaattaaaaattaaaaaaattgattctgcctataaaaaaaaaaaaaaaaaaagaaaattagaaaacttgggccaggccccgtggctcacacctgtaatcccagcactttgggaggccgaggcaggtggatcatgaggtcaggagatcgagatcatcctggctaacacagggaaaccccgtctctactaaaaaaaatacaaaaaaattagctgggcatggtggcgggtgcctgtagtcccagctactcgggaggctgaggcaggagagtggcgtgaacccgggaggcagaggttgccgtgagccaatgagctgagatcacaccagtgcactccagcttgggggacagagcgagactctggctcaaagaaaattagaaaacttgcccctgcaagttttattcttggagctcttatgagtacgtctatgatctattttgagtatgatatgaggtaggggtccattttcattcttttgtgggtgaatttcaggttgtcccaacagcatttgttgaagacactattctttcctcattgaattgtcttggcatccatgttgaaaatcagttgaccaggccgggcacgatggctcacgcctgtaatcccagcattttgggaggctgaggctggtggatcatgaggtcaggaggtgaagaccagcctggccaagatggcgaaactccgtctttactaaaaatacaaaaaattagccaggcgtggtggtgggcacctgtaatcccagctactcaggaggctgaggcagagaattgcttgaacctgggaggcagaggttgcagtgagctgagatggtgccactgcattccagcctgggtgacagagtgagactccgtttcaagaaaaaaagaaaaagaaaaagaaaaatcagttgaccgtgatgtaaatgtatgccaataccacactatcttgattactgtagttttgtagtaagtgttggaatcaggacatatgaggcctccaaatttgttccttttcaagaatacttgggctattctaggtctgttgcatttccaaatgaattttgagattagcctgtatattagtccattttcacgctgctgataaagacacacccaagactgcgtaatttattaagaaaaagaggtttaatggactcacaattccacgtggctacggaggtcttacaatcatggcagaaggcaacaaggagcaagtcatatcttacatggtggcaggcaagagagcatgagagccaagtgaaaggggaaacaccttattaaattattagatcttgtgagatgtattcactgtcacatgaacggtatggggaaaccgcccccatgattcaattatctaccatggggtccctcctacaacacatgggaattatgggagctgaaattcaagatgagatttgggtgaggacacagccaaaccaaatcagcttgacaagttttttcttaagacagggtcttgctctgtcgcccagactggagtgcagtggcatgaacttggctcacggcaacctctgcctcccgggctcaagcaattctcctgcctcagcctcctgagtatctgggactacaggcgcccgccaccacacccagctaattttttgtatttttagtagagatggggtttcaccgtgttagccaggatggtctcgatcttctgacctcgtgatccacccacgttggcatcccagagtgctgggattacaggtgtgagccactgcgcctgacctagacttttttaacttgaaaactagtgagggccaggcatagtggctcgcgcctgcaatctcagcactttgcgaggctagggcaggaagattacttgaggccaggagttagagatcagcccaggcaacatagccagaccccatctctgtaaaaataaaaaattagccaccaggtggttgcacatgcctgtagtcccagttacttaggaggctgagaaaggaggattacttgatcctaggagttaggggctgcagtgagcctagattgtgccactgcactccagcctgggcaacagactgagacccgatctcacaaaataatcaagtagtgaggaaatactgaagaattttaagcaaggcttcagtggagaaaatgtttaagtctggatgctggtagatcatttattttaatttgggttcaagatgatagtgtcctrgaacrgaagctgattacacgttctgaccgtcatttctcatagtgtctataacataggcaaaataatagctccagtgtccacaggcacgcctatggaaagaagkgcatctggaccatgtcacacactccttcctctccagtacccagcctgcttcctagtccacagctcttccagtagtggttgtgccggggagcattgagaagatctggggagcacagtggggcaggtcaaatactattggagtgacattgcactctagaaaaggagccctgaaatcccacaagtgaaaaggcaggcaggccagtagagaccaycccagtcttattcaccactatagactctgtgtagtgtgggcgtgtggaagcatgtcatatgcttcttgaatgactgagtttaggagtgctttggcgtcttcattaaatagtatggctgggcaggtggcttatgcttgtaatcccaatactttggggggctgaggcgggaggatcacttaaggtcaaaattttgagaacagcctagccaacatggcgaaaccctgtatctactaaaaatacaaaaataagctggcgtggtggcrggcgcctgtagtcccaggtacttgggaggctgaggcaggagaactgtttgaactcgggaagtggatgttgcagtgagccgagatcatgccactgcactccagcctgggcgacagagcaatattccatctcagaaataaacaaacgaatccagtatatttaaggccaagtgcgatggctcatacctgtaatcccagcacttcgagaggctgaggtgggaggatcacttgagtccaggagttcaagaccatcgctggcaacataatgagactctgtctctacaaaataaaaaagccaggcacagtggcacgtgcctgtaattccagctacttgggaggctgaggtgggaagatcacttaagcaggggagttcgaggctgcagtgagctgtgattgtgccactgtattccagcttggatgacagagcaagaccctgtctcaagaaaaataacaaatgtgataaagttgaagcagagcatggtggctcacacctgtaatcccagcactttgggaggctgaggcaggaggatcacttgagcccaggagttcaagaccatcctgggcaccatagcaagggttatgtctacccaaaaaaaaaaaaattttttttttaatatgccaggcaatggcacctatattcccagctacttgaaaggctgaggcaggcggatcacttgaacccaagagtttgaggctacagtgtgctgtgatcttgccattgcaccccatcctgggcaatggagcgagaccctgtctcaaaaaaaaaaagaaagaaaaaaaaaacagaaaggaaataaaatgaaaggaatttatgttattctctctctctttttatttatttttaaatattatttatttatttatttattttttgagatggagtcttgctctgtcacccaggctggcatgcaatggcgcaatctcagctcactgcaacctctgcctcctgggttcaagcgattctcccgcctcagcctcctgagtagctgggaaaacagacatgcaccaccatgccaggcttattttttatattttagtagagatagggtttcaccatattgtccaggctggtcttgaactcctgagctcaggcagtccatccatctcggcctcccaaaatactaggatcacaggtatgaaccactgcacctggcctcttttcatttatttatctatttatttagaccagatctgagtgtatcatgcaggctggagtacagtggcatgatcatagctctttaacacctggcctcaagtgagccttttgcctcagcctcctaagtagctacgactacagtcctgcaccaccctggcaaactaattaatttttttcttttgtttgtggaattggcggtcttactatgtacccaagctggtctcaaactcctgggctcaagcagtcttctcatccccgcctcccaaagggccgatattacaggcatgagtcaccatgcccagcctatgtgattctcttgactgtactataaattccttgactataagatcagggactataatagtttgttcaccattccattcacagagcctgacacacagtaggtgctcagtaactgttgggttaattggttgcaactctatggttgttattattgttgctttaaagatttgggttgtgaaaggtgtgtctgggtgcggtggctcacgcctgtaatccctttgggaggctgaggtgggaggatcacctgaggtcaggagttcaagaccagcctggccaacatggtgaaaccccgtttctactacaagtacaaaaattagctggacatggtggtgtatgcctgtagtcccagctatttaggcagctgaggcaggagaatcgcttgagcccggggaggcaaggttccagtgaactccagcttgggtgacagagcaagacttcatcgcaaaataaataaataaataaataaataaaataaaataaagaaaggtgaaaatgatagccaagggggccgggtgtggtaattcacacctgtaatcccagcgctttgagaggcctaggcaggtggatcacctgaggtcaggagttcgagaccagcctggccaacatggtgaaaccctgtctctactaaaaatacaaaaattagctgggcgtggtagctggcatctctaacttcagttactcaggaggctgagaggagaatcgctttaacccgggaggtggaggttgcagtgagccgggatcatgccattgcactccagcctgggcaacaagagcgaaactccatctcaaaaaaaccaaaacaaaacaaacaaaaaaaatttataataggccaggcrcggtggctcacgcctgtaatcccagcactttgggaggctgaggcgggaggatcacaaggtcaggagatcgagaccatcctggctaacatggtgaaaccccgtcattactaaaaatacaaaaaattagcggggcgtggtggtgggcgcctgtagtcccagctactcgggaggctgaggcaggagaatggcgtgaacccgggaggcggagcttgcagtgagccaagatcgcgccactgcactccagcctgggtgacagagcaagactccgtctcaaaaaaaaaaaaaaaatttatagccaaaatgaactaattaattacatagacatttaattcagttattccataactactggatattgagagttacatttaagtattttaaacctcttagctccaaaagattcgggcttttaaattagatatttcctgtatacaaaaaaatgaatataatacacatgatatgaaaataataaattctcatgtatccattatccagtgttagtttattatcagtttccttgtgtgccctgccccaatcttcttcccttttcttctccccaggagtaaccattattctaaatgttgtttttatcattctcttgcttttttgtttcagttttcctatttatatcccccaaataattaatgaagctttttggttttgaattttatatgttatgtcatgccagatgtaatagcgttcactcagtattcatttttgagatccatgttgatgcatgcaatggtaattttttcatttaattgctttctaatattccattttatgactgtctctatctactgttctactaagggacattagttttttctacagtttttttataattcatactctgctagtatgaacctccttatatatatttcccagtgtacatgtagaagttttggttttggtttttgttttgagacagagtttcactcttgttgcccagtctggaatgcaatggcacgatctcggctcactgcaacctctgcctcccaggttcaaggaatcctcctgcctctgcctcccgagtagctgggattaccggtgtgtaccaccacgcccagctaattttttgtatttttagtagagattgggtttcaccatgttggccaggctgctcttgaactcctgacctcaggtgatccacctgccttggcctcccaaagtactgggattacaggcttgagccaccacactttcaactttttgtttgtacattttcaactttgcaaagatagtgtattttcaactttgttttgtgcattttcaactttgcaaagatagtgtatttatactttcattgacatgtatgaaagttgaatacaatgtaatgtttcgcagcctatttaacatttgctattgtctgactttttaattttctttttctgtttttgtttttttttttttttttttgagacagagtctcactctgtcacctgggctagcgtacagtggtgtgatatcagctcactgcaacctctggatgcaagcaatcctcctgccttagcctccagagtagctgggactacaggtgcatatcaccactcctgactaatttttttttttttttttttttgagacacagtcttgctctgtcgcccaggctggagtgcagtggcatgatctcagctcactgtaagctccgcctcccagtttcatgccattctcctgcctcagcctcccaagtagctgggactacaggcgcccaccaccacacctagctatttttttgcatttttagtagagacgggttttcaccgtgttagccaggaccgtctcgatctgacctcgtgatctgcccrcctcggcctcccaaagtgctgggattacaggcgtgagccactgcgcgtggcctccgactaattttttaaaatattttttggtagagatgaagttttaccatgttggccaggctggtctcgaattcctgacctcaagtgatctgcccaccttgacctcccaaagtgctgggattacaggtatgagccattacacctggcctattttcttttttttttttgaggtggtctcactctgtcatccatgctggaatgtagtgcatctcagctcactgtgacctccacctcctcccaagctcaagtgatcctcctgcctcggccttccgaggagctgggactacaggcatgcactaccatgccctgctaatttttatattttttgtaaagacagggtctcactttgttgctgaggccagtcttgaactcctgggctcaagcaatccacccacctcagccccgagaagtgttcctcccaaagtgtggggattgtacatgtgagccactgtgtcccgcctgacttttttattttcccagtatgatgattgtgaatggtatctggttttcatcattttaattagcatttccctgatttgtaatgaggttcaaaaatcttttcatgggttcactagccttttgtgtttcgttttctgtgaaatgcctgttcatgccttttgctcatttttttaatgaagctgtaggcattctttatatattctagatattaatatagattattaatccctattaatctattgtcagttttccatgttgcacacatcttttcccatttgtggtttaccttttcactttttttttttttgtaacagtgcaaggatgatgctgaaaggaataacaaggcttatctctaggatccataaggtgagtcctgactgacctgaacactctgtgcatactgcctttaggttcccagattcttgttttcagatggattcattgtatctagagtgaaatgctctggaaaacttcatatgtaacaggtttcagtagaataattgtgcttgagaatttaccatggaataggagaattaatatttttccagaaaacataagtaagtttgactgtaattatctttattaactttatttctctagccaactagagaatggttatcatcccttaatgaagtatttaaaagaaaaacaagttgccaatttacagctttagcatctaaaatagaataaaaaataaaattgtacatgaaaaagaccattctgctggtttacttcattttttcacatatttaccaaatagtttttcagtacttttttttttttttttttgagacagagtctcgctctgttgcccaggctggagtgtgcagtggcgcaatctcggctcactgcaacctctgcctcctgggttcaagctattcttctgcctcagcctccmgaatagctgggactacaggcgcttgccaccatgcccggctaatttttgtatttttagtagaaacggtgtttcatcatattagctaggctggtctcgaactcctgacttcgtgatctgcccacctaggcctcccaaagtgctgggattacaggcgtgagccactgtgcccggccttcagtaccttctatatggcaggtactcagaattctaagatgcctcatttcactaataatagttattatttgttgggtattattatgtgccaggtactacactaagtgmtttatttttttaatcctcatgatcaacycatgarcgagataatatccttgtttcacagatggagaaactaaagatgagactggctaggtaacttacctgaggaaatagcctgtgaggttgcaaagcccrcacgagatgccaggtctgtctgacttcaaagcctgtggcctaamcactgtgctctattgcattttatggtccatgttctccagaagcttacagtccagtagaatcatgaaaaaatgactatttcagtatggtgctcttacagcaccaaagaggagcacctgagcgggattagtcgagtcagcaggagatcctgaaaggctcagaactgagccagaaagacttggtcattttcagctgattatttaattacagattagatttcctagaaaaggagcccttcctcctatatggctcyccctgcatgtgcccccttccctcaggcctatatattaatacataaaataacccattattataaaatgaaacgaaagcaaggatcagcagagggatggattctggactcaactgatcrtattacaaggctaaaataaatttcctctctcggccgggcacagtagctcatgcctgtaatcccagcactttgggaggccgaggcaggcagatcacctgaggtcagcagtttgagaccagcctggccaacatagtgaaaccccgtctctactaaaaatacaaaaattagctgcgtgtggtggcacacgcctgtaatcccagctacttgggaggctgaggtaagagaatcgcttgaacccaagaggtagaggttgcagtgagccaagatcacgccactgcactctagcctgggcaatagagcgagactccatctcaaaagaaaaaaaaaaatttcctctttcttaataacagacaacaaagacctgaggctagactgtagagtgctgttggtgagagaaagttttgttttttttttttttaytagtttggttcagggtgactgtattagtcagggttctctacagggacagcactaataggatagaagtatatatgaaggagagtttgttaaggagtattgagtcacaccatctggcgaagtcccacagtaggccgtgagcaagctgaggagcaagtaagccagtccaagtcccaaaacttcaaaagtagggaagctgacagtgcagycttcagtctgtggctaaaggcctgagagcccctggcaaatcactgttgtaagtccaagggtccaaaagctgaagaacttggagtccagtgttcgagggcgggaagcatctagctcaggagaaagatgaaggctggaagacccagcaagtcggctcatcctaccttcttctgcctgctttattctagctgccctggcaggtgattagatggtgtccacccacactgagggtgggtctgcgtctcccagtccactgactcaaatgttaatctcctttggcaacaccctcacagacacacccaggaacaatactttacagcctttaatccaatcaagttgacgcttaatattaaccatcacggtgatcttctagattggctcacaaatgctctttcagaaactgcaggatgttcattctggaactgtacagaggcaattgtacagatggttgttttctctggaaacaacagtctacttgagtgataacatatataaaactttaagaactaaagattccattttgctgtaggccaggcatggtggcttacacctgtaatcccagcactttgggaggccaaggcaggcagatcacctgaggtcgggagttcgagaccagccagaccaacatggagaaactccgtcactactaaaaatacaaaattagccaggcgcggtggcgcatgcctgtaatcccagctactcgggaggctgaggcagcagaatcgcttgaacctgggagrcagaggttgcagtgagccaagatcacaccattgcactccagcctgggcaacaagagtgaaactccgtctcaaaaaaaaaaaaaaaaaaaaaaaagattccattttgctagcttttaatttgcttcaaaaagtacctgtagtttcagctacttgggaggctgaggcaggaggatcatgygggcccaggaatttgagactgtccggggcaatatagcaagacccyaccctatgtcaaaaaaaaaagtrtaacaaaaatktcatcacattactgtagaaatagsaccaccttgtgrcccttgaatagtttgttttccactctgctttctctccagctaaagaggcatggtgctttctctccggtagataaaattgagtagcgtttaagtagtactagkgtgtgttattcagattgctaysctgaagtaacaagccttgtattctcagtggcctaacacaaaggatattgtttgtgttgtgtgyatgtgttttgctttgtttttgctgttcctgtctttcaaaamggctttgcaagcaagaytgaagtctggatggagggacaaaagtttaccttcttgggatacatcgcaacatatagcttttaaggtggggagggagagataatttatacctcacacttaattggctctgattagaaaggacacaatgacacaagttattttcattcataggtctttagccaaaggaatcacatgacccctcctgtttctgcaagggaggctgagaagtgtagagaacgatttggatatttggatatttcccaagcattgctgcttcagctgtaatttacagtcatacattctcagacaaagctggagcaactctagtacttgacagttactttatattaaaatctacaagtaatggttcagaagtttctgtgtatacttcactaagtttcctatagagcatttactttccttcgtggatgctttacgtactctctcattgcatgttttcagtttcagattctttattccagggcaaactaaatacctgtagtgtgttaagtactcagagagggagatatgaaaatgaataaaatctgaccccttttcttccgagcgtgtagcctaggagacaagcatgtgtaagataacatgatacagtttttttaaaatagagacaaacttggatgtcaattctagttcaccacctaaaactctgtgaccttaatcaaaattactcagcttccctgaaccttatcttccccatcataacacagggttgataatattctgcctatcttctaggatttctaggtttaaaactagtacatgtacaatactgtattgcctaacatctaatagatactcagttaacagtaggcatgagtacaactcaaggcagtgtaataaaattgctgtgcaatacaaagagtgctattagcagaaaggaaagagaattacttttgactggaggtgtctggcaaattttcactgaggatgtgacattcgagttgaggcttgatgaatgggaaagatttaaatggggagaragggaagttgaagtagaatgagcagaagtatagaggcataaaagtgacatgtttcagcatggtcatatggttataaatgaaattacaaaggtaggctgaagtcatcacagtggtctagattgttatgctaaggaatttgagacttattttgacatcgttctggaaccttctaagctttttaaaatttttttattgtcggggtctcactgtgcttccctggctgatgtggaactcctgccctcaagcagtccttccactttagttcccaactagctgggactacaggagtggaccaccacacctggctccatccaagcttttagattagtcgaaggttaaacctattttcgggaaggttaaggactatgaacgatgaaaaaatcaaagatttagagataaagatacaagttaaaatgttatgtgttggctgggcatagtggctcacacccataatcccagcactttgggaggctaaggcgggcagatcacctgaggtcaggagttccagaccagcatgaccaacrtggtgaaacccagtctccactaaaaatacaaaaattagtcaggcgtgatggcgggcgcctgtaatcccagctactgaggcaggagaaccacttgaacctgggggcagaggttgtagtgagctgagatcatgccattgcatcccagcctgggcgacaagagtgagactccgtctcaaaaaaaaagaaaaacaaaagtgatgggtacaatactgtctctcaacctgtgtagtgggaatgttagacacataatttaggatcatgtcataaaatgggtgtaagtgtgaggagggatggtacagagataacatatattttctgcactcaaaaagctgcttggtaggctgggcacggtggctcacgcctgtaatcccagcactttgggagcctggggtgggaggaccacctgaggtcaggagtttgagaccagcctggccaacatggcaaaatcctgtctctactaaaaatagaaaaattagctgggcatggtggcacactcctataatcccagctgctcaggaggctgtgtcaggagaatcacttgaacccaggaggcggaggttgcagagagccaagattgtgccactgcaccccagcctgggcaacagagcaagactccatctcaaaaaaaaaaaaaaaacccacaaaaagctgcttggtgagccaggtacagtggctcacacctatcatcccagcactttgggaggctgaggcaggaggatcgcgtgagtgcagcaagttggagagcagcctgggcaacatagcaagaccctgtctacaaaaaattaaaaaaattagctgggcatagtggcatgcacctgtagtcccagctacttgggagcctgagatgggagcatggcttgggcctgggagtttgagactacagtgtgccgtgatcgtgccactgcactccagcctgggtgacagagcaagaccctgtcttaaaaaaaagagagagagagagagaagctgcttggtgagactataaaatactggtagctttcatatgataacctatttattaagcaactcccttattacactatccattatatttctgttctcttgcttctcctggctgcattccctaatcttttcctcataacacatcttttcactttctacataaggtttgttatccttaagctcagttttggggtttttcacttaccattttgttagatttgtctaccgaaatccgcccccttcccctccctgttggttcagaggtttcggtgtacagttcactgagttacctatagagcagtttgctttcacttagctgtgtatttgacatactcccttattacatgtctctaatgaaagatcctttattccagggcacaattagcaggaaaattgttacagggcatgtaattatagctgtcacatagtgaggagcattgcactgatcccctgataactgaggtgactgacagagaatgagaattacacagttttgacaaccattcatcgctgtgcaagcgcattaaaagagctttcctgcttcaagtttgctaatggctatgctatgtatgctcctgaataatctctgacagaattgtttgtttccgtataggacagacccctgataaggcaatacacagactggaacagatacagaatatgaataatgtcattggacttagtgaattttaaataataacagggatcctttttacatagaagaaaaatgttgccgggcgcggtggctcacgcctgtaatcccagcactttgggaggcagaggcgggcggatcatgaggtcatgagatcgagaccatcctggctaacacagtgaaacccctactaaaaatacacctctactaaaaatacaaaaaattagccaggcgtggtggcgggtgcctgtagtcccagctactcgggaggctgaggcaggagaatggcgtaaacccaggaggcggagcttgcagtgagccgagatcgcgccactgcactccagcctgggcgacagagtgagactccatctcaaaaaaaaaaagaaaaatgtatgttagtgacatccctattgcagacatggctcaccttctcagtgttttggcaagcataaaaagtttgattagccaggtgtggtggctcaagcctgtaatcccagcattttgggaggcagaggcgggcagatcacctgagttcaggagttcaagaccagcctggcccatatggtgaaatcttgtttctactaaaaatataaaaaatcagccgggtgtggtggcgcacgcctgtaatcccagttactcaggaagctgaggcaggagaatcacttgaacctggaaggcggaggttgtagtgagcctgagatcacgccattgcactccagcttgggcaacaagagagaaactccatctcaaaaaaaaaaaaaaaaagtttgataaccccgtaacactgaaatggtttctcttatagttggaccctgggcgttttttacacatggggacccaggctcgccaaagcattgctgctcacctagataaccaggttccagttgagagtccgagagctatttcccgcaccaatgagaatgacccggtgagttactaatatgtatatggggtttctcagggcttatgatttgtgttcctgtcctcattttgcataggaaaactgaaactgaaagaagcttagtagatttgcatttactcagatagtgcacctgagatagcactctggaacccagattctccctgtccctgtctgatactgtggtaacatacactggccagctcggtctgtatcagttcccatgtaatctctactagtgaattcacctagttccacggattttgctgagcatagagttgtcgaatactcaatacttactaagtttaatttcttactgggyaagtttaccaattattattgcttatattatgtgttgggtgacagrctttttcttaaaggaccatgtagtgaatatttcaggccgatggactgagatgatctgtcacaagtactcaactctgccataaacaaatgggtgtgaacatgttccagtaaaactctatttacaaaacaggtgcccagccataacttaacaaactctggtatggagagtactaaagaaattaaactacttgcccacaattttctaccagggcaggttcagaacccaatttttctaataaccaatctggtgctattttgcagttttgtaagtggatttcctagggtctggagagggaactaacttggtttgttgtgagaagagcagcatttaaagtgaattttgtctgcagaagccaggattccagcagtatctagtgttgcattttctagtccagttccccattagactggatattgatttctttttgttgctgcctctcataaatgaaattaatttgtggtgtgtgctgtaatgttaggaaccaatagctttctttccctgcccctaccctctgagtcttcccatcttaatatagtctgtgtggaaagaaaaagtaaacacccattacccaaaacatgatctcagcagggtgtgttttaaatatatctctaggcttcggccatgcggggtggctcacgactgtcatcctagcattttgggaggccgaggcaggaggatcacttgaggtcaggagttctagaccagcctagccaacatggcgaaagcctgtctctactaaaaatactaaaattagctgggtgtggtggcgggcacctgtaatcccagctactcaggaggctgaggcaggagaattgcttgaacccaggaggcagaagttgcagtgagccaagatcgygccactgcactccaggctgggcaagagagcaagactctgtcttaaaaagtatatatatatggctgagtgaggtggctcacgcctgtaatcccagcattttgggaagccaaggcaggcggatcatgaggtcaggagactgagaccatcctggctaacacagtgagaccccatctctactaaaaatacaaaaaaaaattagttgagcatggtggcgggcgcctgtagtcctagctactcgggagactgaggcaggagaatggtatgaacctggaggtggagcttgcagtgagctgagatcgtgctactgcactccagcctgggcgacagtgcaagactctgtctcaaaaaaaaaaaaagaaagaaagatagatagatagatagatagatagatagatagatagatagatatagatatagatgaagatatatatatataccattcacctmttttcacaaacacaaaatgaagtagaataaatgaatcaagccactgaagtgtcttttcagctttctttgtaattgcagtccttttatctgccaattcctctggggtttctatggaaacagcagcatgcagatgatcttgtcacatgactggagcatctctatacacagcacagaagaatccagatggcaagaattgtctttgctacccctacatctacggtttactttgatgagcaattggcttcattatttgggccaccacttttatatacatactgggtttgagggcagcaaccagcattcttggctaagataaatgaggctgggcacagtagcttatgcctgtaatcccaggactttgggaggcctaggtgggaggatcacttgagcttaggagttctagactagcctaggcaacatagcaagaccctaactctaaaacaatttttttttttttttttttgagacagagtttcactcttcttgcccaggctggagtgcaatggcgcagtctcgtctcactgcaacctccacctcctgggtttaaatgattttcctgtctcagcctcccaagtagctgtgattacaggcatccaccaccatgcctggctaagttttgtatttttagtacagatggggttttaccatgttggccaggctggtcttgaattcctgacctcaggcaatccgctcaccttggcctcctaaagtgctgggattacaggcatgagccactgtgcccagccaaaaaaattttctttttctttttcttttttttagacggagccttgctctgtcacccaggctggagtgcagtggcgtgatcttggctccctgcatcctccacctcccgggttcaagcagttctctgcctcagcctcccgaatagctgggattacaggcgcctgccaccgtgcctggctaattttttgtattttttgtagagacaggctttcaccctcttggccaggctggtcttgaactcctgacctcataatccacccaccttggcctcccatagtgctgggatgacaggcatgagccactgcactcggccaaaagtttttcaattagcagtgcatagtggcatgcgcctgtagtcccagctactcgagaggtttaggtacaaggatcacttgagcccaggaggtcaaggctatagtcagctgagatcaggccactgcactccagtctgggcaacaggctttctcaaaacaatgggagatatcttttccagctttaagagatgagtggtccaggtgcagtggctcacgcctgtaatcccaacactgagaggccaaagtgggaggatcacttgagctcaggagttcaagaccaacctgggcaacatagcaagacctcatctctaccaaaaaagtaaaaaaatgagccaggtgtagtggtgcacacctgtggtcccagctacttgtgaggctgaggcgggaggatctcttgagcctgggaattggaggcctcagtgagccgtgattgtaccactgcattccagcctggtaaaccgagcaagatcttgtctcaaaaaaaaaaaaaaaaaaaaaaaaaaaagacataaaggccgggtgcagtggctcacgcctgtaatcccagcactttgggaagctgaggcaggtggatcacttgaggtcgggagttcaagaccagcctgtctctactaaacatggagaaaccctgtctctactaaaaatacaaaattagccaggcatggtggcacatgcctgtgatcctagctacttgggagggtgaggcaggagaattggttgaacccgggaggcggaggttgtggtgagccaagatcgcgccattacacttcggcctgggcaacaagagtgaaactccatctcaaaaaaaaaacaaaacaaacaaaccaaaaaaaacacataaagacatgagtgaatagcaggccttatccaattttcaaagtcttggtcacagataaaaagacaaggctgggctaggcgctgtggctcacgcctgtaatcccagcactttgggaggtcgaggtgagcggatcacgaggtcaagagatcaagaccatcctggtcaacatggtgaaatcccatctctactaaaaatacaaaaattagctgggcgtggtggcgcgtgcctgtagtcccagatgctcgggaggctgaggcaggagaatctcttgaacctgggaggcgggggttgcagtgagccgagattacaccattgcactccagcctgggtgacagagcgagactctgtctcaaaaaaaaaagaagacaaggctgggcaagatggctcaccctgtaatcgcagcattttgggaggctgaggcaggcagatcacctgaggtcaggagtttaagaccagcctggccaacatggtgaaaccccgtctctactagaaatacaaaaattagccgggtgcggtggcagattgtaatgccagctactgggaggctgaggtaggagaattgcttgtacccaggaggcggaggttgcagtgagctaagatcgcaccattgcactcctgcctgggtgacaaaagtaaaactccattttaaaaataatatatatatatgtatgtgtatatatatatgtatgtatgtgtatatatatatgtatgtatgtatatatatatatatatacacatagacatacatatatacacacacatagataagacaaaaaagaaagtcttggtcactttgtcaccattatacctgtttgcactcttatttcctaggccaagcatggggatcagcacgagggtcagcactacaacatctccccccaggatttggagactgtatttccccatggcyttcctcctcgctttgtgatgcaggtgctcaagacagggaatggaattgragggagcccagaatacaagctgctgctagcaaaggggtggggctaaatgagaagaaaatttaaaaagatgaaatttaatctgaaaaacagaaattcatgtgttgattaccttttgtgactagtacaattactttaagctcatgtttaaacaatattgatgttttcctccttgtatagcccaagaagattccagtaatttcagcatcaaataactgttttaaatgaacttaaaatttgccttggcaaaatatcatgaaaatagttaatatgctgcacaaaagcaaaatcatagtacactcctgagctaaatagaagcaatattttgattagatgcattggtttttattctcttgtggattttgtgaaaatgttatcaaacttgcctgtgcaggtgagttttagcatgcgagccagaggatctcatttctttagtgtggtttatttcgggaaattagatgaataataagggcataacaggccgggcgctatggctcacgcctgtaatcccagctgcactttgggaggccaaggtggaaggatcacttgggcccaggagttcgagaccagtctaggcaacatagggagacctgtctctacaaaaattaaaaattaaaaattagctgggcatgatgcacacctgtagtcacagctactcaggtggctgaggttggaggatcgcttgagctcaggaggtgagggcttcagtgagccatgattgcaccactgtaccccagcctgggcaacagagcaagaccttatctcaagcataaaataaaataaggtataacaggccaggcaaggtagtttatgcctgtagtctcagcactttgggaggtgaaggtgggaggattgtttgagcgcaggagttcaagaccagctgggcaatataatgagactgtatctttatttagaaaagaaaaacatgggcaaccctctcgggtccccttccacactgtggaagctttgttcttttgctcttctcaataaatcttgctgctgctcactcaaaaaaaaagaaaaacatttagtcatgtgtggtagctgcttcggaggctgaggcaggaggatggcttgagcccaggagttcaggctgcagtgagctacgatagtgccacggcactccaactcagacaacagagtgagaccctgtctccaaaaaacaattttaattaaaaaaaattttgttgaagaaatcatctgcagtggcactttaaactgttccaagacatacacagtacaatgtttattcagcttcagagctgtgaggttctatctttaattaactatttgaagttgttttcagactggcttaaccaacaatgctctgtaagaacttacaggttcttttcataattttcatttacatgaaggcctacttcctcaccattgtttgtggatattagcattgtcatactgcctaatatgacttttttttttttaaatactgctccttttggagcagacctaactcacggacagtgtgcccagggtagctgactttattttattactattattttaattatagagacagggtctcactctgacaaccaggctggagtacagtggcgtgaccacagcccacagcacactctacatctctgacctcctgggctcaagcgatcctcctgtattggcatctcaaagtgctgggattacaggtgtgagccacagctcccagccctgatgtgacttttttttgaaatggagtttcacttttgtcgcccaggctggaatgcagtgatgcgatctcagctcactgcaacctacgcctcctgggttcaagtgattctcctgcctcagcctcccaaagagctgggattacaggtgctcgccaccacgcctggctaatttttatatttttagtagacatggggatttgccatattggccaggctggtctccaactcctaacctcaggtgatccacctgtcttggcctcccaaagtgctgggattacagggatgagccaccacgcccagccaacatttgttttaatacctttatcatgtttttttgaacattgagccttccattaagtttggaattgcctgtcaaatcctacaccaattcaattgttttgttaggatttcttttaaaaatatcaacactggctgggtacaatggctcacgcctgtaattccagcactttgggaagctgaggtgggcagattacttaaggccaggagttcaagatgagcctggccaacatggtgaaactccatctctactaaaaatacaaaaattagctgggcgtggtggcacacgcctgtagtcacagctacttgtgaggctgaagcaggagaatcgcttgaacccgggaggcggaggttgcagtgagctgagatcgtgtcactgcactccagcctgtgcgacagagcgagactctgtctcaaaaaaaaaaaaaaaaaattaacactattttagttatacttacaaacagtatttgttagatattcttattagtagacatattttaatattttctttgcaaatcagtttcacacacattagtacttcccaaatttcccaccaaagtattctggtagcaaaaggggaattaaactctgaaaggttagtatgctggaggtatgaggtatggatggccttagagttgtgaggcagctggtcacacctgctcctgagccgccatgtatttagttctagagaaaaaagtctaaatggttaaagtaataaaaataaattttaggccaggtgcggtggctcacgcctataatcccagcaccttgggaggctgagacgggtggatcatgaggtcaggagttcgagaccagcctgaccaacatggtgaaagcctgtctctactaaaattacaaaaatcagcctggcatggtggtggcacctgtaatcccagctactgaggagactgaggcagaagaattgcttgaaccccggaggcggaggttgcagtgagccgagatcacaccactgcactctagcctgggtgacagagtgagactctgtctcaaaaaaagaaaaaaaaaaaaaatcaactaaaaataaattttaggccaggtgcagtggctcacgcctgtaatccctgcactttgggaggccaagacgggggtgtcacctgaggtcgggagtttgagaccagcctgaccaacatggagaaactccttctgtactaaaaatacaaaatagccgggcatggtggtgggtgcctgtaatcccagctactcgggaggctgaggcaggagaatcacttgaactgggaggcagaggttgtggtgagccgagatcgtgccattgcactccagcctgggcaacaagagtgaaactccgtctcaaaaaaaaaaaaagaaaaaaaatttaaagagttaatgtttattgaattattaacttgtgtcagaaattttaagcatttttctatatgctttccatatttacagtggccctaagtggtatacataattttgttatgagatatatcaattatttatagatttcagctgagatagaatatatgcttcagtaataggaataatcaaaagctgactatcatgttacttagtgcggaataatgtatttcagtttttagctaagttatatggatagattttcaaactcagtaccaacccagcttctcctaactgagtaaattagaggcatgcaatctgatggtcttggttgccactttaggcagagtatatataccaccccccacccactccttccacacccacccactctttccttctttcctactttatcaggtgaagacattcagtgaagcttgcctgatggtaaggaaaccagccctagaacttctgcattacctgaaaaacaccagttttgcttatccagctatacgatatcttctgtgtatcctttcctgcytgcgtggaccctcatgaaccaatgctttctcccctcaaataaggcaacagaagaaatgaaaaaaagtactgttgaggccgggcatggtagctcacacctataatcccaggagtttgggaagccgaggcaggcgtatcgcctgaagtcaggagttcaagacctgcctggccaacrtggcgaaaccccgcatttactaaaaatgcaatatattagccgggtgtggtagcgtgcacctgtaatcccagctacttgggaagctgaggcaggagaatcgcttgaacccgggaagcggaggttgctgtgagctgatatcaagccactgcactccaaccccatctcaaaaaaacaaaacaaagcataactactgttcacatacaagtgatccttccagtcatgttttctttaacaacatatactttagatggagagaagggaacaggaaaaaccctaagtctttgccatgttattcatttctgtgcaaaacaggactggctgatactacatattccagatggtaagaacttcctgttgtttcttctgtctgttaggtttagttatcctgttactgtggtagccttgcagctttaattttcttttcttttcttttctttttttttttttttttgagatggagtttcgctcttgtcggccagtctggagtgcagaggcgcaatctcaggtcaccgcaacctccgcctcccaggctcaagagattctcctgcctcagcctcccaagtagctgggattacaggcgcccaccacaccaccacgcccagctaatttttttttttttttttttttgagacggagtcttgctctgtcgcccaggctggagtgcagtggcacgatctcagctcactgcaagctccgcctcccgggttcacaccattcttctgcctcagcctcctgagtagctgggactacaggcgcccgccaccatgcccggctaattttttttgtatttttagtagagacagggtttcaccatgttggccaggctggtctcgaactcctgacttcaggtgatccacctgccttggcctcccaaagtgctgggattacaggcatgagccattgcacccggcctcagctttactttcctaacagggatctgatagctaaaggaaaagcctttgccagtcacgatggctcaaacctataatcccagcactttgggaggctgaggctggaatattgcttagagcccaggaggaggctgcagtgagctgtgatcgcaccactacactctagcgtgggcaacaaagcaagaccctgtctcaaaaaaaaaaaaaaaaaagaagaagaagaaaagcctttactccagatgtagagcagactgagctcatccatcatgatttcttcgtgatattactgccaagcagattataaggtgaagtcaatgtgacaaaaggaaattcggctaaaagcttcctgaagccttttgatgctaagcagtccttcttttgatatttaatacccatggacataaacttctgccttagaggtcgccatggagttttgttttgttttgttttgttttgtttttgccatctgttaacagtcctgagtacccatagagccttttactatttatcagcattctagagtcgtcagtatggattgtcaaaacttgcakttgtctcttttttgttcagtgttgtgtgcatccacattttctttcttttttaaacaaccctgcttatgtaacatccacattttctgacttacctttcaaacctgccagaaagcagaagtgatatttaatacacttggtatgttttatatattgattctaatgataatgtttagtctaagatggacctgacaaggccaggcatagyggttcaacagcactttgagaggctgaggcaggatgattgcctgagcctaggagttcaaggttacagtgaactgtgatcacatcctgccttctagcctgggtgacagagcaagaccctgtctcaaaaaaaaaaaaaaaaaagaaaagaaatatatatatgagaaactaaagtcatttcccataacttaaaagaggcatagaatatttcgagttgaatacagtttctgcctggcttgttttcttctgcctcttttttttaaagctcatctttgggtgaaaaattgtcgggatcttctgcagtccagctacaacaaacagcgctttgatcaacctttagaggcttcaacctggctgaagaatttcaaaactacaaatgagcgcttcctgaaccaggtgactagactcccagaagttgagtgctaggtagtccttacatggattctttgtgccctgrgtaccaayagactatggagaactgatactggagttggaataactgtatcatttttaatttctttcatacgttttgctcacagtggactcataacttgaaactcatttatccatgtgaaataaataggcaacagtaagttgttcccattttgtgggtagcaaagtgaaatccagttgattcattgacttttcaaggtacagcctccaatccctcgcaagcrcatttccaactacatgattttctccagacaatatctttttagggaaccagaaatgtattggaaaaattcttctttaccctggtgattcttagataccctgtctagaccaggggccttcaactctggatataaagcagagtcacctaagagcttgttaaaaatgcagatgccagagtctcattctggacattttcatcagaatcccttatgtatgtttattcaaggctccaagcagaaatggattagaaagcattcactttggtcaggcacaggggctcacacctgtaatgtcagcactttgggaggccaaggcaggcagatcacctgaggtcaggagttcaagatgagcctggccaacatggtgaaatcccatctctactaaaaatacaaatattagccgggtgtggtggtgcacgcctgtaggcccatctattcaggaggctgaggcaggggaatctcttgaacctgggaatcagaggtttcagtgagccgagatagcgccattgtactccagcctgggtaacagagcgagatatggtctcaaaaaaaagataaaagaggtcaggcgtgtggctcagacatgtaattccagcattttgggaggccgaggtgggyagatcacctgaggtcaggaattctagaccagcctggccaacatggcgaaaccccatctctactaaaaatacaaaaattagccaggcgtggtgacacacgcctgaaatcccagctacttgggaggctgaggcaagagaatcccttaaacctgggaggtggatgttgcagcgagctgagatcatgccactgcacttcagcctgggttacagagaaagaagcwgtctcaaaaaaaaaaaaaaagaaagaaaagaaagcattcacttctacattgaggtctcttacagaacctgaacaatagattaaaatgaactcctgttaaccttagcctccaaccttttcaagggatggtttcacccttaggccaagtagccttttttttggtttttattttctttgcttgcttttagataaaagttcaagagaagtatgtctggaataagagagaaagcactgagaaagggagtcctctgggagaagtggttgaacaggtataagaaaaaacactgaatgtgtaacatgcgataacaagagaaggcctctggtagcactacaatccactgtctctcccaatagggcataacacgggtgaggaacgccacagatgcagttggaattgtgctgaaagagctaaagaggcaaagttctttsggtatgtttcacctcctagtggccgtggatggaatcaatgctctytggggaagaaccactctgaaaagagaagataaaagcccggtaggaaaactgggtgtctctatcttgtttctctgatttctgattccatcagtatggaggctgggtcttagccttgtagaccatgcaatatgttttcttgccctaggaatatttgaagataaacagtaaagagctgggtgcagtggctcacgcctgtaatcccattggctcacgaggctgaggtgggaggatcgcttgaggccaggagttcaagactaggatgggcactatagcaaggcccctgcctctaaaaaaataagaaattagccggtagctggcatggtggcacacacctgtagtcactgctactggaaggctgaggccagaggatcacttgagccctggagttcaaggttgtagtgtggcatgattgcaacactgcacaccaacctgggtgacagagtgaaatcctgtctcttaaaaaatatatatatggctgggcacagtggctcatgcctgtaatcccagcacttggggaggctgaggcgggcggatcacctgagcttggagttcgagaccagcctgaccaacatggagaaacccatctctactaaaaatacaaaattagccgggcatggtggtgcatgactgtaatcccagttackcgggaggctgaggcaggagaatcgcttgaacccaggaggcggaggttgcagtgagccgagatcgccatatatatatattcatatatatgtatatatacacacatatatattcatatatgtatatatacacacatatattcatatatatttatatatacatatattcatatgttttcataatatacgaatatacctatatgttcatatatgtatatataatattcatatatgtatatatgtatatataatattcatatatgtatatatgtatatatacgtatatatgcacacatacatattcgtatatgcatatgcacacatacatattcgtatatatatgtgaagataaacagcaaggcctggtgtgatggctgataaatcccagcacttttaggaggccaagaggtgatttgcttgagtccaggagtttggagtttgaggtcagcctgggcagcacagtgaaaccctgtccctacaaaaaatataaaaaactagctgggcatggtggtttgcacctgtatgtagctccagctacttggaaggctaagatgggaggatggcttgagcccaagaggcagagcccgcaatgagtggagatcgtgccactgcattccaggctgggcaacagaatgagactctgtctcaaaaaaataaaaaaaaagaaaagataaacagtaaaatggaatcagaggaggaggtaatgccaagagttccactattcattgaaaactaagggagtatgttgtggaaagagaatgacagcagaagctatgttttctttcttaatttttatctgtcttttgattcttttttcaaaatgagtctagatggtctaagcagaggagatcagaagcatcaaaatggggctggtttggggcagtgggtgtttttctcagtgactgttaatctccagaagcatggcagttctagggccagaggctacgtggcttatcctagagggagtaccttcaggtatacaattatgtcttagttgagggttttaaaaaaattgttgtcaccaggtgcagtggctcatgcttgtaatcccagcactttggtaggccgaggtgggtggatcacaaggtcaggagtttgagaccgtcctggctaacacggggaaaccctgtctctactaaaaatacaaaaaaattaggctctggtggcgcgcgcctatagtcccagctactcaggaggctgaggcaggagaatcgcttgaacccaggaggtggaggttgcagtgagcccaaatcgcgccactgcactccagcctgggcgacagagcgagactctgtcaaaaaaaaaaaaaaattgttgtcaattgtttcgggagaacatctaggaaaggcacgtgatgatctcttctctctttctgtccgatatrcagattgcccccgaggaattagcacttgttcacaacttgaggaaaatgatgaaaaatgattgggtaagtgcatatgatacctcacacatttcagaaagaaatgtattatcattttaaacatgttctactatttcattgctaatactttacagtctctaattttatggacagtaagttattatgtcttatttaattcctgtatctgtaccaagttagaaataaagtctgaattaaaatctatatatatgtggtttataatctttccaaagtaagtttattcaaaaccattttatttaaatattggcctaattttattttgcttgcagacatttaaagtgtttttgtatctccttaccgtctttggaaaagagtttgagacccacaaatatgtcatggtaaatttaaaatcaggtagcagtttattgtcagagccaaatctggaataaccaatttagttgccatttaactgtgctagaccacacttttgtaacactgtatgcccaagaaagaaaaaaaaaatctacagatgattaatgcagttttccatcctttttaactttttccagttcagccttttctcttttctttcagcatggaggcgccattgtgtcggctttgagccagactgggtctctctttaagccccggaaagcctatctgccccaggagttgctgggaaaggtcaagtcaaaggaaaatttgtttctacttagattgttatcctgtttaaagaaaaatatttttattaatctatgtattttgacataatttcagacttagagaaaaatcatattcctgtatgcccttcccctggattcctaaaatattaacttgatcatcattgctttatccgtctccgtctttctccagagtttcttttcttttttttttttttgagacggagtcttgctctgtcamccaggcttgagtgcaatggcgcaatttcggctcactgcaacctccgccttccgggttcaagtgattctcctgtctcggcctcctaagtagctgggattacaggcgtccactaccacgcccagctaattttttgtatttttagtagagacgaggtttcaccatgttggccaggctggtttcaagctcctgacctcaagtgatccgcctacctcagcctcccaaagtgctaggattataggcgtgagccacggcgcctggccttgatgcttctttgtctccaaataatgtctcattcctaagaacaaagatactctaatataccctgagcataattatcaaagtcagaaaattgacattgatatcatacttttacctaattggtgggatttattctgatgtagccagttatcccagtatcttttatagaaaaataaatcccagataatgtgttacattaagttgtcatgtctctggctgggtgcggtggctcatgcctgtaatcccagcactttgggaggccgaggcaggcggatcatgaggtcaggagatcgagaccatcctggctaacatggtgaaaccccgtctctactaaaaatacaaaaaattagccaggcgtcgtggcgcgtggctgtaatcccagctactcaggaggccgaggtaggagaatcgcttgaacccgggaggtggaggttgcagtgagccgagattgcgccactgcactacagcgtgggtgacagagcgagactccgtctcaaaaaaaagaaaaagttgtcatgtctctttggtctcctttaatctgtgacagtctgtcagtctttgtcatttgaaatctttatgtttttggcatgtgcatgccagctattttgtaggtcactttttggggttgtctgaggtttcctcctgaatagaagtgatgttagaagtgatgacatgtctgagtgagtgcatcctatcaggaggcacatttctcccattactggtaatgattttggaactgttagctgaggtgttgtccatctggtttctcttcagtaaagttattattttgctttggaattaatatgtatgttgtagagatatactttgagactaggtaaagatcctgttacttctcaaacttccacctactggttttagtatccattactttagttatacctggcatggagcctccgcagctggtatggtcttgtggatttttatttaatagaatctaaatcattactgtcactttttattttggtgctcaaatcatcttagatttggccattaaaaattccttcattggccgggtgtgatggctcacgtctgtaatcccagcactttgggaggccaaggcgggtggatcacgaggtcaggagttcaagaccagcctggccaatatggtgaaatcctgtctctactaaaaatgtaaaaattagccaggtgtggtggtgcgtgcctatagtcccagttactctggaggctgaggcagaagaatcggttgaacccaggaggcggaggttgcagtgaaccaagattgtgccattacactccagcctgagccacaaagcaagactccgtctcaagaaaaacaaaaaacaaaaaaacaattccttcatggccaggcttggtagctcacagctgtaatcacagcactttgggaggccaaggcagaaggatcccttgagctcaggagtttgagaccagcctgggcaacaaagtgagaccccatctctacaaaaaaaaattttaaaactagctgggcatggtggcattcacctgtagtcacagctactctggagactgaggtgggaggatcgcttgagcccgggaggtcaaggctgtagtgggccctgattttgccagtgtactccagcctgggcaatagagtgcggccctatctcaacaggaaaaaaagctccttcaagctaacttctatatccttttaaaatgtccccatcattatttttttggagatagggtctcactctgtcacccaggctgtagtgcagtagcaccatcatagctcactgtagccttgagcacatgccaccacacccagcactgaatgttgtctttttcttttctttcctttttttttttagaggcatggtcttaactatgttgttgcctagggtggtcttgaactgctassctcaggcaatcctcccacctcggcctcctaaagtgctgggattactggcgtgagccaccatatccagctcctatcattctttgaccacttctttattttctgtcatgagaatatgttccagacccctcttatacttcccatgcccagccctggaatctccatttctccaaagagcattggcttattttagaggagactggtatttagcaaccaaggcctgagtcctaggtatactcactgctactgaggtgtcctttctcctaggccctcacagcaaagttcataaatagatgtacatacatacatgtatgtatgtatatgtgtgaaccatatgcatatacatgtttatacacatccacacacatctgcgtttgtttctctaatcatattaaaaaactatgagttcctactagtagccaattccatgctaccatcacagcagtcattataccctttccatatctgtaactctaatctaaaataatgagaaatctgctgccagtagccatagtatatttacttattagctcaatactagaatatatgaaaagtagtttcagatttgatagctctcaggctgggcgtggtggctcatgcctataatcccagcactttgggaggccgaggcgggcagatcacgaggtcaggagatctagaccggcctggccaacatggtgaaaccccgtctctaccaaaaaatgaaaaaaaaaaaaaaagaaaaaaaaattagccgggcgtggtggggcgcctatagtcccagatactccgaaggctgaggtgggagaatcgcttgaccctgggaggcagaggttgcagtgagctaagatgtgccaatgcactccagcctgggagacagtgaaaaagaaagaaaaaaataagttccttgggccgggcgcagtggctcacgcctataatccctgcactttgggaggccagggcgggcggatcacctgaggtcaggagttcaagaccagcctggccaacatgatgaaatcctgtctctactaaaaatacaaaaaattagctgggcatggtggtgcaggcatgtaatgccagctactcgtgaggctgagacaggagaatcgcttgaacccaggaggcagaggttgcagtgagccgagatcgtgccattgcactctagcctgggcaacaggagcaaaactcagtctcaagaaaatgaaaaaaaaaaaagaaatacagtttgattacttcatttgtttccatttgttttccatctagcgtattttttcccattatttttattttttattttattttatttgagatgaagtcttgctctgtcacccacgctggagtgcagtggtgcaatctcagctcactgcaacctccacctcccaggttcaagtgattctcctgcctcagcctcccaagtagctgggattacaggcacgcatcaccacgcctggctaattttttttttttttttttttttgagatggagtcttgctctgtcaccaggctggagtgcagtggcttaatctcggctcactgcaacatccacctcccgagtttaagcaattcttctgcctcagtctcccgagtagctgggacgacaggtgcatgccaccacgcccagctaatttttgtaatttagtagagatggggtttcaccatattggccaggcaggtcttgaactcctgaccttgtgatctgcccgcctcagcctcccaaagtgctgggattacaggcatgagccaccgtgcccggctaatttttgtatttttagtagagacagtaattttgtatttttagtattttcaccatgttggccaggctgatctcgaactcctgacctcaggcgatctgccctccttggccacccaaagtgctgggattaccagcatgagccaccatattcctttgaaaatatgaaacattaactttgtttcaaaagccaaaactgtccaaaatacatacacacaatatgtgtgtgtgcgtgtgtatgtgtgtgtattcacacaagtagcatccgcctcctcaagcattgcctttttttktgtgtgtgtagacatggtcttactctgtcacccatactgtgacagtatgtgtagtggagcaatcgcagctcactgcaatctcaacctcctggtctcaagcaatcctcagcctcccgagtacctggggctagaggcacgcagcaccactcctggctaatttttgtattttctgtcgagacagggttttaccacatggcccaggctcgtctggaactcctgggctcaagcaatatgcccatctcagcctcccaaggtgctgggattacaggtgtgagtcactgtgcccagccacctctttttaatatatagcatttgtggccacgtagagcacgagtagccagccaccatatgtggagtccatatgtggagtcctgtatcaggcaatgttgccagagaatgagaagtagagttacatagaagaaaaacaaataccttaccttcaaagtgcttaagtagagtctgtctgtctggtgctttgttccttaactaacatgtttcctgatcctttttcttccccaggaaggatttgatgccctggatccctttattcccatcctgrtttccaactataacccaaaggaatttgaaagttgtattcagtattatytggaaaacaattggcttcaacatgagaaaggtccatcatttagttttttcctatcagggctttgtgatcacagtagaatcccactcagtcagagccttgatctcttcttcccttaacaacagcctctaatttgtacttcatcctttatcttgacttctttctggctgataaatggtacagaaaagcgggtgggaggcagttaaggtttaatttacaaaagagattttatccctaaattttccatgataaagaagggaacaaaggcaactccatccactgggcagaatttccaggtaattgggttcctgccacattctccttattgaatttatttattcaatagacttcactggagagactcatgctgggacacccacagaaaaattcatactgtgcaagggctactccagcacctaagtaaatctttgccacacctgtcctagtatatgtacagaaattaactttcagcactatatttcatctactctgactgaaagcattccaactgttcatttacttgcccttgacctcacatttgagtatgaagaggggatatagaagaaaagctaaggctgctctatcactagataatagagttaatagtaatcggaggcctggtgcagtggctcacacctgtaatctacactttgggagggcaaggtgggaagaccacttgatgtcgggagtttgagaccaggctaggcaatatagtgagaccccatctctatygaaaaaagcaaaaaaaaaaaaatactatttagaatagcttattaaaggagtacagtgaagagtgtaagactaactgtagcatgttaagttgggatgcacaatagacagatttctaagagttgggagatgtcacaaaatcctgaagtccagaagacactcttggagtggagagagagctccatgctggtttggaggagtagacacagaaaaggaagtaatgcatacaaaagaagagtagcttgttggggtgagggtctagaagtamgatytcttgggagatgataattacctcagaacgtaatttggatatggtagcctctgactacacgatattctggggaacacagtgcagcaggaggaaactgccacttacctgtgtttgtctccattttagctcctacagaagaagggaaaaaagagctgctgttcctaagtaacgcgaacmcctcgctgctggagcggcactgtgcctacctctaagccaagatcacagcatgtgaggaagacagtggacatctgctttatgctggacccagtaagatgaggaagtcgggcagtacacaggaagaggagccaggcccttgtacctatgggattggacaggactgcagttgkctctggacctgcattaaaatgggtttcactgtgaatgcgtgacaataagatattcccttgttcctaaaactttatatcagtttattggatgtggtttttmacatttaagataattatggctcttttcctaaaaaataaaatatctttctaaagtgttgtgttagattaataatatggaaggagtctttagattggccaaattgcatttctctgatattcctcttgttgcaggtcagaagagatcaattctacagaaatttccagtggttctgttgaggctttatggaattcagcatgtcaaaattcacagctggctgggcacagtggctcatgcctgtaatcccagcactttggaagcccaaggcgggcagactgcttgagttcaggagtttgcaaccagcctgggcaacatggtgaaaacctgtctctactaaaaatacaaaaattagccgggcacggtggcatgcgcctgtaatccaagctacttgggaggctgaggcaggagaattgcttcaacttgggaggcggatgttgcagtgagccaaaattgcascactgcactccagcctgggcagcagagcaagactccgtctcaaaataaataaataaataaataaataaataaataataaatgtatactgtactgttttacatgaccgacttcagcatctaaggatgttgctacctggaggaagtgggatcctggaacgaatcccacataggtatgaggaataacaataatggaaaatcaggtatcttccctttctcccagtgcttttctaaaaggaatttctgttaccaaatcctagagatgatacaattctacacaaatatatatatggccgggcgtggtggctcatgcatgtaatcccagcactttgggaggccgaggcgggcagatcacttgaggtcaggagtttaagaccagcctggccaacatggtgaaaccccgtctctactaaaaatacaaaaagtagccgggggtggtggcacatgcctctaatcccatctactcgggagggtgaggcaggagaattgcttgaacccaggaggtagaggttgcagtgagccgagatcatgccattgcactccagcctgggtgactgatagagactctgtctcaaaaaaaaatatatatatgtgtgtgtgtgtgtgtgtgtgtgtgtgtatatatgtatatacacacacgatatgcatatcatatgtatatattatgtctgttatacgtatatatatgttatgtttatattagtattactattaatatgttagatacatattaaaaatatgtttactttgacagtaatatataactatcaaagtagtatactaataggttgtatattatatattgtatatgacaatatatagtatattactcataatattgggtcctatatattatgtatatgtattatatatgttatatgtatttgtatatattttatatatatgttatatatatatttttaatttatatttatatatttttaagagacagtcttgccctgtctcccaggctggagtgcagtggcatgatcacagctcactgcagccccaactcctgggttcaatcagtccttttgcctgagcctccctagtaacttgggaccacaggtgtgtgctaccacacctggctaattttttagtgttcagtagagacagaatgtagcttggtttcccaggctaggcaatatggcaaaacctcagagtgagagagaccgaatctctaataaataacttgaacaaaataactgctaaatgtacactagaaaccatattcctttttctttttttttttgagacggagtcttggtctgtcacccaggctggagtgcagtggtgcgatctcggctcactgcaagctccgcctcctgggttcacaccattctcctgccgcagcctcccgagtagttgggactacaggcacccgccaccgtgcccggctaattttttgaaattttagtagagacagggtttcaccgtgttagccaggatggtctcgatctcctgaccttgtgatccacccacctcggcctcccaaagtgctgggattacaggtgtgagccaccgcgcccagcctagaaaccatattcctgatgataatttaaaagatcttactaaatggaaagattctccatgttcattgattggagtactcagtaataagatggcagttattcccatattgacctatagattcaatgcaatcattatcaaaatttcagaaggttttttgcaaaactggaaaactgaccaagcacggtggtccatgcctgtaatctcagcatgctgggaggctgaggtgggcagatcacttgagcctaggagtttgagaccagcctgggcaacatggagaagcctaggctctacaacaaatacaaaaattagccaggtatggtggcatgcgcctgtagttccagctacttgggaggctgaggcaggaggatcacttgaaccccagaggttgaggtttcagtgagccgtgatcatgccactgctcatcctcagctgcagagtaagaccctgtctcaaaaaacaaaaaggaaataaaaaagggaaactgacctaaagtttatgtttttattaatattattttgagacagggtctcactctctgttacccaggctggagtgtaaggccacactacagcctcgaccttctggactcaatcctcctacctcagctccacgagtggttaggactacaggcacacaccaccacacgtggctaattttgatttttttttttaataaagatgggatctcactatattgcccaggctggtctcaagcttctggactcaagtgatccacctgtctcagcctcccaaattgctgggcgtataggcttgaatgactttggccaggctataaccccatcgtctgtttctgggaagacctaatgcacccaaacgcaatgctacccttcaagagacaaatctaaaattgcaagtaaaaattcaaaagagggccgggtgtggtggtgcacgcctataatcccagcactttgggaggccgaggcgggtggatcacctgaagtcaggagtttgagaccagcctgagtaatacagtgaaaccccgtctctactaaatacaaaaacatcaaccgggcatagtggcgggcacctgtaatcccagctacttgggaggctgaggcaggagaattgcttgaacctgggaggcggaggctgcagtgagccgagatcgcgccactgcagtccagcccggtgacagtgtgagactctgtctcaaaaaaaaaaagtaaggatataaaagattgagtagcatgattaacacttgtcctaatggaagtatttttaaaaattgaatccccaaacaacttttttttggtagaagctcttttacattcacatactttatttttaatagcctaactacagttatccttttctttaacccaggaaggcagagagaaaagagagcaaattaagttgcctaaagctgaacttggacatcaccaaacttctagaaaggcagattatgaaataatgctttaataaacatattattaatttaataagcatctgttgttctaaaaagtagaaaatacatcaggtcattattgttgacccttaaacaataacgtttttggactgcatgggtccacttattcacatatatattttttttaaagggtcttgctctgttgcccaggcgggagtacagtggcatgatctcggctcactgtaacctctgcaaccttggttcaagctatcctcctgactcagcctccctagtagctgggcttacaggtgcacaccaccacgtccggctgttttgtatttatagcagagacggggtgtcaccatactggccaggctgttctcaaactcctgacctcaggtgatccgctcacttcggccttccaaagtgctgggattacaggtgtgagccaccgagcccggcctcacagatctttttcaatagaagttatacggagtggacctgcctttctggcctcaccttccacctatcaaatcccaaaacttctgaatgtactttcttttgaagcacataaagaacctgttcaaaattgactgacaatggaccataaaccagctcaatatatttcaaagaatttaaatcatacagccgtgtactctgattctaatgcaatttaaactagaaaccagtaacaaaaagagaaatagaaactcctcatgtgtctggaaattaaaacatacttttctgatgtgcccattggtcagggagaaagatcagaatggaaatgagaaagtaattcaaattaaatgattgtgaaattactaaacacaaaacttaaaaattttgtacgttgaaaatactggctggcagggcacagtgactcaggcctgtaattccagcactttgggatgccgaggcgggaggattgcttgagcccaggacttcaagaccagcctgggcaccatggtgaaacctcatctctaccaaaaatgcaaaaattgaccaggcgcagtggctcacgtctgtaatctcagcactttgggaggccaaagcgggcagatcacctgaggtcaggagttcaagaccagcctgaccaacatggcaaactcctgtctctgctaaaaaaatacaaaaattagttgggcgtggtggcaggcgcctgtaatcccagctactcgggaggctgaggcagggaaattgcttgaacccaggaggcagaggttacagtgagctgagatcacgccactgcactccagcctgggtgacagaatgagactcagtctcaaaaaaaaaaaaaaaaaaaaaaaaattagctggattcgtgatggcacatgcctgtagtcccagctacttgcgggagctgaggtgggaggatggcttgagcccaagaggttgaagttgcagtgagctgtttgtaccactgcactccagcttgagtaacaaagtgagatcctatctcaaaaaaaaataaaaaattaaattaaaaattaaatattttaaaatattaaaattggccaggtgcggtggctcacacctgtaatcccagcactttgggaggctgaggctggcagatcacgaggtcaggaatttgagaccagcctggccaacatagtgaaacccttactaagaatacaaaaattagccgggtgtggtggcgcatacctgtaatcccagctactcaggagtctgaggcaggagaatcgcttgaacccgggaagtggaggttgcagtgagctgagatcgtgccgttgcactccagcctgggcgacaggacgagactccggctaatttttgtattcttagtagagagggggttttgtcatgttggccaggctggtctcgaactcctgacctcaggtgatcyrcccacstcrgcctcccaaagtgctgggattacaggcatgagctactacgccaaacccagatccagtattttaaaaggataatcaacataaatgagtttgggataattttaggaatgcaagatagtattacatgaaaatcagatgtattcattagtgcaacaaaggaatgataaaataatgtaattatcttagtgcggagaaagctgtaaaaaacattcaaatctattcatgaccaaaattcttagcaaaacaggaatacagaatttccttaagctgtcagagtacctacagaaacttttcagcccacatcatacttagaagtgaaatggtagctgcgcacagtgcctcacacctgtaatcccaacacttttggaggccgaggtgggcagatcacttgagctcaggagctcaggagtttgagaccagcctgggcaagacggtgaaaccccatatgtacaaaaaataaaaaaaattagccaggtggtggtggtccatgcctgtaattgcagctatgcaggaggctgaggtgggaggatcgcttcagcccaagaggttgaggctgcggtcagccgagattgcaccactgcacaccagcctgggcaagagagtgagaccctgtctcaaaataaataaataagactaaataaatatggaattacaaggagctcagaatagacaagagaggctaagattttattttttattttcagacggagtcttgatctgtcgcccagtttggagtgcagtggtgctatctcagctcactgcaatctccacctccggggttcaagtgattctcctacctcagcctccggagtagctgggattacaagcgcccaacaccatgcccagctaatttttgtatttttagtagagacgggtttcactatgttggccaagttggtctacaactcttgacctcagtggtccgccgacctcggtctcccagactgctgggattacaggcttgagccaccgcgcctggccacttttttttttttattttttgttttatctgtatttttttgagacagggtctcactctgtcgcccagacaggagtgcagtggtgcgatcatgggtcactgtagcctcgaattcttgggcccaagcaatcctcccatctcagcctccagttgggacgacagatgtgagtcgcctggctaactttttgaaatattattttatagggagttgggggctggtgtctcactaggttgcccagtttggaatttctggattcaagcgatcctcctgcctcagcctcccaaaacctgggaa

SEQ ID NO: 12200 - DNA, 37687 bp, Homo sapiens
attggtacatttgtgttctgggtgagcattccagagctcagagatgtatcctccataccaagctgatttcctgcatcctgcaaagactgtacttcgaagccagctactctgccatgacttggatcccaggatagtgacaccgaactcaagtccttaacctggtcagattctggtttaacggctgattctaggtctacgttgttttcctcttgattgcctttatgctgtagggactctgtcactgtagttcttctcttcttacagggcaacattttaaaagtcccacttttgttccattctgaaagaataaaaagttcttactgccttcatattaattaaaagtaataacatttactcaattatcttttcatttattcatgttcgatcatgaacacaatacttcacaccaaatgcacaatttccctttaggtggaagttgagagacagtggttaagtgactgagttcaaatctcaactctactgattactactgatggactactgttacctaggccaagtgatttaacctcgcaagtcttcagtaccctcaacagtaaaaaataattgctcttacttcatagaattgttacaattaaagagtaagtgattaataaacactgtgggtttatttttgtgtttttttgtttttgtttttgtttttgagacagagtctcactctgtctcccaggctggagtgcagtggcgcaatctcggttcactgcaacctccgcctctcgcgttttacgccattctcctgcctcagcctcctgaatagctgggactacaggcgtgcaccacctacgcctggctaattttttttgtatttttagtagagatggggtttcaccgtgttagccaggatggtctcgaactcctgaccttgagatccacccgcctcggcctcccaaagtgctgggattacaggcgtgagccaccgcgtccagcaaacattgttattattaccatcagggtggtagactagcatgatgctgagagtaaactgtggaatcagactgtctggatgtttcccaagtcaccttctctccagctttatgaccttgtggaagttactcaacctgaatctcagtgtcttcagctataaaatggaatataatagcatctacttcattagatggtaaatgatcaatacatgtttgctattgctgttttcataaacaggtatttccattaatagaaacaaatcaaaagcaaagtgtgattgtttaaaaggttaggctatgttggctgggcacgagatggctcacgtccgtaatcccaacactttgggaggccaaggtgggcagattacctgaggtcaggagttcgagaccagcctgatcaacatggagaaaccctgtctctactaaaaatacaaaattagccgggcgtggtggcacacgcctgtgatcccagctactccagaggctgaggcaggacaatcacttgaacccggagacagaggttgcagtgagccgagatcactcgccattgcactccagcctgggcaacaagagcgaaactccatctcaaaaaaaaaaaaaaaggttaggctacattaacaacaaactttgtgtcgaaacaaggaagataagagtcctactatcctctgcgctatgttacttcttggctttttgcttcaattctagttatcacattttaagggcattactgacctaaaccagagggtatcctctatgttcttttagtatctgtttgtaaacctcttttacggtacttatcagttttgtaatggtctctcatctttctctttctcatctccttcctccaaaactatcagcttttcgagaaatgggattatttcaactcatatccctaatatccagcagtatctgggtttttttttttgaaacaaggtcttgctctgtcacccaggctgcactgcagtggcacgaacatagttcgctgcagcctcgacctcctgggctcaagcaatgctcccacctcagcctcccaagtcattgggattacggtcccatccaagccactgcaccagttcagtatttgggtattgtagatactcaatgtatcactgagtattgatactcaatgtgtcactgaatattgtagatactcaatgaatgctccctgaataataaatgaaacagaggttaaacaacttattctgtgcagcatttgggccaaatgttaagcattatataaaaactgatagtggcttggtgcagtggctcacgcctgtaatcccaacactctgggaggccaaggcgggcggataacaaggtcaggagttcgagaccagcctggtcaatatggtgaaacgctgtctctactaaaaaatacaaaaattagccgggcatggtggtgggcacctgtagtcccagcttcttgggaggctgaggcaggagaatcgcttgaacctgggaggtggaggttgcagtgggccaagatcatgccactgcactccaccctgggcaacagagggagactctgtcaaaaaaaaaaaaaaaaaaaaaaaaaaaaggcatcttattacccaggaaaactttactgtcataaatagatccaataatagaataggccgccttgtgttagatcactggcaatgttcaagcgaagcctgaatgtccacttatcagagtactagatgaaagcctgaactagagaactgaaaaataaaagttctttgtaactctaagcgtctaaggttagatttctctttcttcttttctttctttctctctctctctctttctttccagagacaaggtctcgctctgttgcccagaccggagtgcagtggcaagatcctagttcactgcagcctcagactcctgggctccagtgaccctctggcctcggcctcccgagtagctaggactacaaggcacttgccaccaccctcaacgactttttttctttttttttttttgtagagacggggtctcgatttgttacccaggctggtctcaaactcctggcctcaagcgatcctcccgccccagcctcccaaagtgctaggattagaggcgtgagccaccgcgcccgacctacagttagttttaaacctcccttctgtttctccaagacattaggggagattctccatcccctcaatcaactgatgtaattaaaactcagtaactaaagctcaataaaacatgaagatttcgttgattcctgtgagagatggtggtgaccttataagaaatagaatgggagtagccagggcagctcttttatttcacagataattactgagatcaaaaaaaggggaaaaaaagaaaaagaaagaaagaaaaagaaggaaagaaagacagctacttcagctccaggcacctcaaacacagcagtagctcgacagaatccacttttttgggaacccaagtcggaccagcagggtgaatgaatgccaatgtggaggcagccccggcacggccctctcctaggaaaacattttcaaaaggggtcctaaccgcgcttccacctcggtgcccagggctggctccagtccccattcccaactagacactggacttcacgcccttaacttccgccacgcacccagcgcccaccctcagacccgaccttctcaacctggacatcgttcgtccaggtgtcccagctcccacctgcctcttcccaccccaccacacacaaacctgtaccctcaccagccggcctgattccacggaaacggctttggcaccaccggaagtcagccaacaacagcgaattgcgtgcgcgtccccgagcctcggagcgccgcgccgcagtgcatcaaggagcatgcgcctaacactatgcgccatcccattttagggcagagtgaagccacaacgttagtgcgtcagttattggcaaaaaaatttaaaggcactacttagctttctctgcccatggagttatcctactcaaaactgaggttaagattcagtggtttagattaacagctaatttgggggccaggcgcggtggctcacgcctgtaatcccggcaccttgggagacggaggcgggcggattacctgaggtcgggagttcgagatcaccctggctaacatggtgaaaccccgtctctactaaatatacaaaattagctgggcgtggtggcgcacgcctgtaatcccagctactccggaggctgaggcaggagaatcgcttgaacccgggagacggaggttgcagtgagccggcatcgtgccactgcactccaacctgagcgacagtgagactctgtatcaaaaaaaaaaaagattaacaactaatttttctcactacgagtcacctggaacacaggaccaagggactgaagaagtcataaaatgccagaaaaagaagtctctaaattacaaatagtgcaggctcctgattaaaactaaggcactcttggactcaggctatagtaattattcatatatgtacaatattctgcattttacaaaatgctctcacattttcttaggtgacttggtctccacaatagactgtaagattattatatcatattccagtttgcacaggacaaagttctggctcatctgagtaggtgatttcacaacggtacacagacagctatcaaggagaatcaggtattaagtctcctaactctagctaataatgcattgacccagtgtccaggaggctgcctggggtgtaacagatgttcaataattcaatacgtgctttttgaatgagcgaatgaatgaatgacttctaaaatgatgttatttccacttttctagaaaaacaatgtctggaatccacggagattaaaaaaataataaaaaacagaatgtcaaaaggtggaaaaatactttcaaccccctcattttacaggtaaaccaccaacacaaatttatacatttgaactaatcctatctgtaaacagaatccaacggatgaaattatccacagccaaaatgaaggttgaaatttatgcaaacatggcagtagtctgactaacctgaatcacaccaactctcccaaataccaaggaagactccagaagctcggagtttcatgtgtgttgttctttgacctacagaatacacagatctttcggtttggcctctctcatacgaaaccctaagcacttgaggttcatgaaaaaaattcaacactgattaactttggcacttttcattagttgtttttttttttttttttgaacagctttgcataccacaatatccatctgttttacgtgtacaaccaaatttttttttttttttttttcaaacggagtcttgttctgttgcccaggctggagtgcagtggcgcgatctcggttcactgcaacctccacctcctgggctcaagcgatcctcgtgtctcagcctcccaagtagcgtgtgccaccacgcccggctaatctttgtatttttagtagagatgggggtttcaccatgctggccaggctggtctcgaactcctgacctcaagtgatctgcccgccttggcctcccaaaggtttgggattacaggcatgagccaccgtgcccggctgtttttttaaaattagtaaatgttcagagttgtgcaaccatccccaggtttggtctttcatcagagtttctgaggtttaagacagtttccatccactgtgaaatataagccaaaaaaaaaagttccgtaataacctttagcggtctcagaaatgcataatgatggcagtcgatactgaaatccaggcagtacagaattttattttcccaaaattctggaactcaggaccgagaacattttgctgctgtattaaagcccagaaaactgaaatcagaggatttcatataataatctacctatgcttcttacccttcagtactttctcgttttggaaccacagcgcgtcagtgggcggggcctcattctcgggaaaactcggcggtgggaggagtcccctccgggagagcttcctgaagggggcgagggctgacttccgtaatctttcggaagaggcggagtcttcttccgaggaccattcggaagaggcggagtcttcttccgaggaccattcggaagaaggcggagcctacctctcatcaggaccagtctgactgcacctgcatccttagctcagmgcatccccggagcatcttaagagctgagcgcagctgacaactaggggccggaccgtcgcaggaggcgtccgctggataccttcccccttccctgacctagagctctacagctgctgcstcggtactgaccgagggttcccagagctgtctyaccattgcaaaaacgttatagcaacagcctctgattacgacatggctgagatcaccaatatccgacctagctttggtaagtagactcgggaaaactaagcttgaggtggtcagaatggttgcaaggccaagggggcccagcggcagggcagagaatgcagcccagaccagagccttcaaaatgccagccccactaaaatcgggcctgtggtggtgggtagtgggtagtgggcagttgacagtgcatgaacttgagctatgggctgcagggactggcagggcctgagccacaccgagggtggggaagtccaggatgctaaaaccttgtatggtgcactgtcagcactgctggaggtgagaaacagcaagcgtgcggaggatgtgaacccctccttctgggggaggagaggtggggtaggccaagccctcccccttggggcacacagggcggtgccccttcctccccctcccattcctaagggctgcgggggagggaagtgacaagggggatggggcatcaagatggcagcttggagactgtgggccgtgtggctggcagccaggggaggcggcggcctctggggaaagaggggtgcggggtggggagcaaaaaggaagccactccttaagccggtcagctggatgctggggctaggaggaaacgtgagccctgcaagctccattccgcatcgtaatggtggggtccctccgatgctaccaaatggcgcttggcgctgctgggctgggggatgacgtgatgtctatttctgggcctcctggcagcgccgacgctctccttccggggcctttgttccctgtttccctgggccgccttttcaaaaagggggactgaccagcgttgatgctggcgggggcgcgatccaggccggagggggaggggcgaaagaggcccagcccgggggaggccgctttgtgtaccgcagaaagcattacgtcatttcagagcggctggtccccgacccagccctgtgggctccaagattagttttacactctctggagcagaaagtggagtggaaaatagggaagaaggtggcaaagacaagcttgagaaggaagttttttcctctttggggactcctgcagtatatgctaaaggagcaaacttcctgtgttatgctttcctgatcaaataaataaaatataattgccctgcttctccttgattcagtttagatgggggaagccagtgagagttgctgccaaagaaccttcttattccttcagggattctatccctcagacaatccagtaggtttgagcatcgggactccagtttttagggtggagacacaatccagctaggaaatggcttttctcattcctgaataagaggtacagtgaaatgagcagaatccagtgtgctctatcccctcagaataaggaagaagaaatcaaatcagatgtgttcagataactgatcttcacactcattaactacttgttctcacttattccacaaggctaaatcttgatggtattttttcttccacttcaccttccgcatctttattctttgagttctaagtttccaaaacaaaagtccctttcatgatcacatgagcaatccatgatttcttcctgttctttttcttcttattcccttccaacagattcctttctctaactgcagttccagaatccttgaaaaaaggagatggtgtggaacataatatagtgatttctcttagagggactattattgggaaagggaaaataaattatatcagcctgttacatactacattttatttaatcctaacaaataccctcgagtgtatgtattattatatatacttgccagacaaggaaaccaaagctcagaaataaaataacttggctaaagccaaacaaatgactaaaggtagcactagtttgtttttgtttttgtttttgagacggagtttcgatcttgttgcccaggttggagtgcaatggcgtgatcttggcccaccacaacctctgcctcctgggttcaagcgattatcctgcctcagcctcccaagtagctgggattacagacaagtgccaccacacccagctaattttgtatttttagtagagatggggtttctccatgttggtcaggctggtcttgaactcccgacctcaggtgatctgcctaccttggcctcccaaagtcctgggattacaggtgtgagccactgcacctggccaatgctaggatttaaaccaatgtctggctgaagccaaaatttattctcattccattgtattatatttgtctacttgactgcgaaaagctatgtttaggaaagggggtgtcaataaaagcagttctggtcagaagctgaaggagctggccaatagcccagatgtgtcttgcaggtctttaaaccattacagaggatctcctacatagagaactaccacttccaactttttcacatctcatagagtacttcatttcaaatgccacagcacttgggtgatacaccaagccaacactcaattatccatgaccatgaaggacaaaaggagcgagaagcacaggtcactgcaatttatagctactttaaaacactcacttcagccattagtttcaacttccatttcccaccaagctttggactaaagcaagacagagagctctaggttttaatatctttgatgattctagctcattgtcttggtttcagggagagaggcaaragttaacaaatactaaaatgaagaaagaacagcaaaaataggaaacaaggccagggggaacaactagataattcaaagatgcgttcatctgtttctcttcttttccttctctatcctcctggaatatgagaattcttcatcttctctcttttctaccctatctccattttctaacaataaaagttgatgcattgtaaatatgtaagcagcagtgggttgccccccgctcctccaccgcactgctgcagggaataaatctatgatagagccaaaagaattgcccaggtgtctcctaatctaagccttcagatctctctttatgatcattccaaaaaatatgcctgtcttggtagtttgctgtgttcctcttctcatagagacagtgttcagtttcactaatgagtagcaaacaatttgcaggaaagcacctgattgatgaatggagagccacttccttaggctgtgcccattcttaatggcaactgaatccaattagttgttcaaccaaatatttactgaactcctattagaagcaagagactcttgagggattcaaagatccataggatattgttcctgcctgccttcaagtagcttactaccaaggctgtctccattttgtgaaaactttccctaaaagctatttcatttaatactttgagactaaacactattattattcggtatggatatagacatggtcaccttgatttattttgttaataatgttttgctccttatctatattattttaaaatgtacccgggtacagtgggtcgtgcttataattccagcgactcaagagactgaggcaagaggatcttgaggccaggaattcaaaaccagactgggcaacatagcaccttgtctctaaaaaaaattttttttaattagccaggcatagtggcatggtcctgtagtcccagctattcaggagtctagggtagtaagattgcttgagcccaggagttcaaggctgcagtgagctgtgattgcaccactgcactccagcctgggccacagagtgagaccacgtctctaaaaaaataataacaataaatatatattttaaataaaatgtaactcttccttggttaggcatggtggcttgcacctgtaatcccagcaatttggtggagactaaagcagaattgcttgagcccaggagttcaagaccacctgggcaatatagtgaagactcatctctaaaaaaaatttaaaaattagctgggcatggtggctcatgcctgtaatcctagcactttggggggccaaggctggcagatcacttgaggtcaggagttcgagaccagcgtggccaatatggtgaaaccccgtctctactaaaaatacaaaaactggccaggtgtagtggcacgtgctggtaatcccagctactcaggaagctgaggcaggagaatcacttgaaccagggaggcagaggttgcagtgagccgagatcgcgccattgcactcaagtctgggcaaagcaagactccatctcaaaaaaaaaaaaaattaaccaggcatgatggcacatgcctgtagtcctagttcctcaggaggctgaggcaagaagatcatttgaactggggaggtcaaagcttcagtaagctgcgatcatgcatgccactgcactccagcctgagtgacatggtgaaattccatctctgcaaaaaatacgaaaattagccaggtgtgatggcatgtgcctgtagtcccagctactcaggaggctgaggcaggaggatcacttgagcccaggtggtggaggttgcagtgggccaagcttgtgccactgcactccagcctaggcaataaaatgagacgctgtctcaaaagaaataaaaaaagtaagctctaccacaatgcctggcagggacatataaatttacacaaaaaatagcaattttattattgtcactgctatacacaatattacatgtatattatgaccagtgcagatgaaattatacctgcctctcatgtaatctggacattatgctcatagtattgtgctcatgatgctcataggctttctagagaagataaacscttcatctaggtttggagggaagaaaaagccatggattggttggagaggataggagaggatacctctaatagaagggaaaacagtaggcattatactaattatagtccaagattgtggttgcctaaattcctaagtcatttttgactcatcaagtgaggttattgactataaataggtttttgagtccaaatagaaatttacatttatccctgatatatgtaatcatcttgactcaatccttttttttttttttttttttgagatggagtctcactctgtcacccagaatggagtgcagtagcacaatctcagctcactgcagcctccgcctccgaggttcaagctattctcctgcctcagcctcccaggtagctgggattacaggcacctgccaccatgccaggctaagttttgaatttttagtagagacagggtttcaccatgttggccaggctggtctcgaactcctgacctcaggtgatctgcctacctcagcctcccaaagtgctgggattacaggcatgagccaccgcaccaggcctcaatcctctctttctaatctgtggaggctgttttgaattcactgactcttttgttcactgaacgcttactacatgccgcatagttctaggacgtggaactatagcagtgaacaaaacagacaaagttgctgttttattaagcttgtctagtgatcaaagaaagataataaatatatgtcaggataataagctccatgaagaaaattaaggaagggtgatggggacattatcttacttggggcagacaggaaatatttccctcatccagtgaggttcggggctcacgataagtgaagcagtgagctgcacagatgcctgatacaagaatgctttaggccgggcgcggtggctcatgcctgtaatcccagcactttgggaggccgaggcaattggatcacttgcggttaggagttcgagaccagcctgaccaacgtggagaaaccctgtctctactaaaaatacaaaaattagccggacatggtggcgcatgcctgtaatcccagctactcgggaggctgaggcaggagaattgcttgaactctggaggcggaggttgcggtgagccgtgatcgtgccattgtactttagcctgggcaacaagagcaaaactctgtctcaaaaaaaaaaaaaaagaatattccagaaagaatcggggaaatgctggaattatgtctatttccttttcttttttttcctcgctctgttgcccaggctggagtgcagtggcacgattttaactcactgcaacctccacctcctgggctcaagtgatcctcttaccttggcctcccaaatagctgggactacaggcatgtgccaccatgccctgctaatttttgtaatttttttgtgtagagatggggttttgccatgttgcccaggctacatttatttccttagttctccctcccttccaagtggtcccctaaaaagtaaagtggaaaaaactataggcctaatctggacctttaaagcctaaacccaatttagcctcaatgaacttgagggagcgaagaaacttgagggtccaatttttgtgggaaaagataagactagggtaagggaaacaaaaaaaaaatctatttctctttctcttttttttttctttttttttttttttgagatggggtctcggtcttttgcccaggctggagtgcagtggcacgatctcwgctcactataacctccacctcccggcttcaagtgattctcctgcctcagcctcctgagtagctgggattacaggtgtgtgtcaccacacctggctaatttttgtattttattttagcagagacagggtttcgccatgttggccaggctggttttgaactcctgacytcaggtaatctgcctgcctcagcctcccaaagtgctgggataacaggcgtgagccgccacacccggcctatttctgtttagttatttgttcatccaacacatagtgcctgctatgtgttttaagtgctgagggtacagccgtgaacaaaacagacataaatttttgtcctcatgagacttatattctagtgaagataaataataaattgtaaaataatatgcgtgtgggtgtttattcttacatatttgtgtatgtattttatatatttttttcttacatgtgtaggggtgtgtgtatcagagagcgagaatgacggcatgttgaaaaaaattaagcaaggctaggaagagtgggtggtgaggatggagaagattgcacttttaaataggtgagtcaggaaaggcctaagaaggtgacatttgagcagagatctgacattttccactaatagggaagaaaacccctatttcttccagtgaaggatttattaaggtaataataatgaaaagagaaagtctctatttcttcctatttagaataatatatgtatacataaatacatatatatacacacacacatatatacatatatacacacacatatacatatatacacatacacacacacacacacacacayatatatatatacatacatacacacacctatttttttgcctacaatggatatattcatcctggaggaataccttttttttttttgagacgaagtcttgctccatcacccaggctggaatgcagtggcacgatctcagctcactgcaacctctgcctcccaggttcaagcgattctcctgcatcagcctcccaagtagctgggattataggcacatgccaccacgcccagctaattttttatatttttagtagagacggggtttcaccatgttggtcagtctggtcttgaactcctgacctcaaatgatccacctgcctcagcctcccaaagtgccrggattacaggtgtgagccactgcacccagccttgtattttatatacctgggagctaaaattttggaacatattttaaaagtacataaacccagaattcttccttttggcacccatccatttttactaccctgaacaccctaccaagaccatctaaactcatctccacacccttccaccctagcctgacagcgagtcagtcagtgcaggccctgttctggatgctatggaatatcctgaaaccaaacatcttgtgtaacagttgaagtgaacaggtgctcatgtaaaaaggtgatcttagaacacgtacagagcagctttatgtgaagcacaaatcagtatgagcaaaccaagtctataagtgctgagagaaggtctaggaaagaacatagagtcaagtggggtgcttcagagaaggctttctatagaaggctgggaggaaaagccgtggagtggttggagaggttgggagagggtgcctctaatagaagggaaaaattctgaagcccagatgagcacattttgctttagaggctagattgaagattagcttggctccagcagtggcaatgagcaggggagatctagacaggaggtgaagtccacccgccctgacacatctctgatctccgccttcagatgtgtcaccggtggtggccggcctcatcggggcctctgtgctggtggtgtgtgtctcggtgaccgtctttgtctggtcatgctgccaccagcaggcagagaagaagcasaagaacccaccatacaagtttattcacatgctcaaaggcatcagcatatacccagagaccctcagcaacaagaagaaaatcatcaaagtgcggagagacaaagatggtcctgggagggaaggtggacgtaggaacctgttggtggacgcagcagaggctggcctgctaagccgagacaaagatcccagggggcctagctctggatcttgtatagaccaattacccatcaaaatggactatggggaagaactaaggagccctattacaagcctgacccctggggagagcaaaaccacctctccatcatctccagaggaggatgtcatgctaggatccctcaccttctcagtggactataacttcccgaaaaaagccctggtggtgacaatccaggaggcccaygggctgccagtgatggatgaccagacccagggatctgacccctacatcaaaatgaccatccttcctgacaaacggcatcgggtgaagaccagagtgctgcggaagaccctggaccctgtgtttgacgagaccttcaccttctatggcatcccctacagccagctgcaggacctggtgctgcacttccttgtcctcagctttgaccgcttctctcgggatgatgtcattggcgaggtcatggtgccactggcaggggtggaccccagcacaggcaaggtacaactgaccagggacatcatcaaaaggaatatccaggtgagtaggaagtgtgtgttggggagcaatggtaggttgggggagaaaatatctcaggggataaatggaagtgggaggggagtgggttgggtggcaaagaagggctgtagagaggaagctcttggatgtcaaggataagcagtggtcagagtaagacagagggcctggcagatgaggtctcctctaagaagcaacttcctggtgagagaaggtycaatagctttcaccatttcacttagtggttggcatcctgatgctgtccagcttacttggaacaggctggcctaccatttgtagatccttcattatatcagggatatgggagctaatttcctctccaaaatgatgtgatcttcctccagtgaatttatttttcacagctgagaagctatgacaataattcagtaatttttccctcagcttccctttcccaaccctaacctaggggtgtaaatgataccatgtacatgtctttttttttttttttttttttttttgagacagagtttcactcttgtcgcccaggctggagtgcaatggcgcaatctcagctcattgcaacccccaccgcccaggttcaagctattctcctgcctcagcctcccgagtagctgggattgcaagcacccatcaccacgcctggctaattttttgtatttttagtagaaacggggattcaccatgttagcctggctagtcttgaacttctatcctcaggtgatccacctgcctcggactccaaaagtactgggattacaggcatgagccactgcacccagccgtcatgcacatgtcttcttatgaccattttacaatgcaattcaatgaattgcttcacccttctaggcccaaacctttgccatagacacttcccctctctccatttctcctgtcctccctctttgtattagaagagggacgagggccctccatcctgccttctctctccctcttcccactggaccgacattggctcttgagttgtaatttcaggagcacagtaagtgtagccccacccaaccccattagttcatttatttcttccacaactggggaggcagtgaaatgctgcagttaaacacttgggctccagaattggactgcacgactttactctccagcttaccacttgccagccgtgtgacacgggtgagttactcgacccctctaagcctctattttstcatttgtaaaatggagctgataatattgycttccttacagagaatcaaatgagataatatgcctggcatatgattgcccttgaagaggtttcactttattgaaggagaaagacaaatattttttgtaattactgtatagtgagtatggtaggtgctatgaaagaagttgttgaaattttaaacttagagtttcatgtctttttcagggtataacataagtggttaaaatagcaaggactttgaagtcagacctgagtttaaatccaaattccaccagctaaatgaccttgggcaagctgcttcactttcgctaagtctcagtttcttatgggaatagagtaggatgatgattttatatagctactaggacacagtgagccttcaataaattgtgaccgttactattattgttattcctattattagtcaagtttgatacctgggtgatgcatgtggtttgtaaatatttatattttgttttgacacagtgaaggaagacaagggaggaattggtgaaggaggttaggaaagaatttcgaggccactagaaacaactgcacatctcccagaaagagctctgcctgtgggcagatcatacttatttcttgataccttttttacctgcaagtcctcactggactcagtgggtagacaggaggctcaggactggatagaagaggctcctaagttagcaggtgcagagtgtgcagtgagtacccaggaacaaggtttgcctgctgaagaagggtactgtgccaagtctgggtgggggacagcagggagcacactttgtgtgtgtgtattcttgccttctctgctctgtagtaggcacctgtccccctgcagccagcccggtcctgcctttcattgcctgaaggaactgctactgccacctggcacactcagatccatgtcacgggccagggaagtccaagaatyttgaagaatattagacacatttgtgattgtgatttagggtagaggtggccctcaggacatctggccccaagaagggtttattgaggttatgttcatccacctaatacaagggctccttggctagaaaatcactctgaaagaggttctgctaattataggaaaacttggtgaacgtcagagcataaacaagacactgccacaacatcttgtggttctcaatgccaggatacaatgagacatcccagagtccagccctgaaggggttttcgcatcctctgagactggaatcagaaggtgtgaatagaaatggaagcagtggcctgtttcatccccttctctcccctcccctgtcccatcttttttcctcagggctctgccgacccattctgctgtttccgtattcccttcacagcagctcccatcctctactccttcccttgtctacctctccttgaaggaggagcctttccaatacacccttccctgtgactccaaccttggtaaagtcaccaaccagctggactcctccagacagctatacacttgcagcccaaggctgggagtagaacatggctctgtgccaagctgcagctgggaagagactggcaatgaaagggactgatttgggctgggaacaaaacagcctcaaatcaagggcactggacacagcacagacaatggcatttgctaagctgccaggggctcttggcaagagccacatttctttccactttattaactcccttgaggagggataagccagggctaggatcctgagcaacacatgccctggagaaggcccgagataggwtacccagagcctgtgcagccccaccctagagccttccagcctcccaggcttcctaaacccattttcccaaccagtgcccgtaggcaggactatgttccatctgagccatggctgtcatctccctagtcactcatccactaggttccctagaagtgcaggctgcaaatgtctatcccaaatcctccctaccatagcaaagtaggatctcyccttggtgaacgtcagctagagctgccctggaccatgccacactggctgtaaagggctttttcctggtctggattacatagaccaggaaaaagctactgcactctagcctggatgacagaaggagaccctgtctcaaaataaaaaataaaaaataaaaaataaaaaaataaaagaaaatatggccaggcacagtggctcacccctgtaatactagcactttggaaggccaaggygggaagcccaggagtttgaggttgcagtgagctattaccacaaactgcactccagactgggcaacagatcatgtatgtgtattgcagggaggaaaagggggatgggattgaatgttaaggttttgttttcccatggttgtgatttaggctagaggtggccctcaggacatctggcctcaagaagggtttattgagcttatgatggtccacctaatacaagggctccttggctagaaaatcactctgaaagaggttctgctaattataggaaaacagactatcccttgcctaagtattatttcttctgagtgtattctttaggaccactgttcctgttcctctgttccactgaaggagcaaggagattgccctcagagagccgagccccgcagctctgtcaggcatgagaaaatcctttctcccccttgtccttctgcttgcctgccccccaacagggcctttgcctcactaggccaaggggctgggaaacagagcttgctcacagccttcaatggctctttcaaaagaaagagccattgacatagctacttggaatgggaattgggtagaaagagaaagggagggagcttgagggaatgacattaaaytgccttcaatgcagaatggagtggcattcaggtggtgttgtggctacagacttgggcatcacaaagcggcgctgagtggggatgggcatgctgcccgtgtgagatggcacaaggtgaaggagggatcagatggaggacagttgcctgaggagtgattttaagggagaaaaaaatgaaaagggtaaccagaagttgtcaactttcccaaaaaactaggaaagaggcatggggattttgattaggaagattttcctagaatggatgatttaggatacagaattttaaataagtaatcgggaaacctaagctataatcttgtcattcgtgttattcttgcaaataaaactgtgcttttaaaatcagatgtcggctaggcgcggtgtctcaggcctgtaatcccagccctttgggaggccgaggcaggcggatcacaaggtcaaaagattgagaccatcctggccaacatggtgaaaccccgtttctactaaaaatacaaaaattagctgggcgtggtggcacgtgcctgtagtcccagctactcaggaggctgaggcaggagaattgcttgaacccgggagacagaggttgcagtgagccaagatcacgccactgcactccagcctggcgacagagcaagactccgtctcaaaaaaaagaaataatgaaacgttgcttttcccccacctatccttcctctgtatataaagttagaatcatatttaaagactgcatatttagtatttagatactcagtattgaaggatggccccagaaatggatatatcaaacctagctaacattttattattattcatggaaacagacgggagcagtagccaaaacaatgcaaaagtcctttctagatcagtgccgtctaatgatgatagaaatgttctatatttgcaccatgcagtgtggtagctactagctacatgtcgctattgagcacttgaaatgtggctagtgtaactgaggaactataattttaattttatttaatttaaattaaaatgtaaataggcacgtgtagctagtggctactgtattggatagctcagttctgaatgttttggaatccattcaattttcttttccatatgggattacttttcatttgatgtggctaatagtaaaaatgagtttatattcactgattacattctgatttctggcaaaaggaaaaagcccagaagtatactggttggcaagrgcaaccagactgtaattcaaaactggctgagggccaggcatggtggctcacgcctataattccagcacttaaggaggctgaggtgggcggatggcttccactcaggagatcaagaccagcctggccaacgtggcggaaaccccagacatggtgattsacgccggtaatcccagctactcaggaggctgagacaccagaatcgcttgaacccaggaggtgggggttaccgtgagctgagatcgtgccactgcactccaacctgggtgacagagcaagaccctgtctcraggggaaaaacaaacaaaacaaacaaaaacacattggctgagggaccaagcatggtggctcacacctgtattcccagcactttgggaggctgagacggatagatcacttgagcccaggagtttgagaccagcctgggcaacatagcaaaaccccatctttaccaagaatacaaaaattagctgagcctggtagcacatgcctgtagtcccatctactcaggatgctgagttgggaggatcacttgagccctggatgtcaaggctgcagtgaatgcacaccactgcactccagcctgggcaagagagtgagaccctatctcaaaaataaaaataaggccgggcgcggtggctgacgcctgtaatcccagcactttgggaggccgaggcaggcggatcacgaggtcaggagatagagaccatcctggctaacacggtgaaaccccgtctctactaaaaatacaaaaaattagccgggcatggtggcaggcgcctgtagtcccagctactcaggaggctgagccaggagaatggcctgaacccgggaggcagaggttgcagtgagccgagatcgcgccactgcactccagcctgggtgacagagcaagactccgtctcaaaaaaataaaaataaaaataataaaaataaaataaaactggctgaggatactttccatggatacgattaagagctgacaataggccgggcatggtgactcacgcctgtaatccccgcactttgggaggctgaggcaggcagatcatgaggtcaggagtttgagactagcctggccaatgtagcgaaaccccgtctttactaaaaatacaaaaattacccgggcatggtgacatgtgcctgtagtcccagctactcgggaggctgaggcaggagaattgcttgaacccaggaggtggaggttgcagtaagccatcgcaccactgcactccagcctgtgtgacagagcgagacttcatctcaaaaaaaaaaaaaaaaaagctgacaatacatatgttatgggtaaggacaaaatgtggggcttctctctagcagagaaaaaacatgaaaatatttttaaagttgatccccttttgtatttcaatttcaaaagctaaggagtgggtttaaaccttggttagattttttttttttctgagacagtctcactctgtcgcccaggctggagtgcagtggcacaatttcagctcactgcaaactccacctcctgggttcaagcgattctcctgcctcagcctcctgagtagctgggattacaggtgtgcaccatcatgccccactaattttttgtatttttagtagacggggttttaccgtgttggccaggctggttttgaactcctgacctcaagtgatccgccctcctcggcctccaaagtgttagcattacaggcgtgagccaccatacccagcctagttagttattttttatgccctgtgagagacatttccatatgctcctaggacgaaacatagactcaataaatttttaaaatcatgtgaaatatcacagtttcattcctggagatgacttaaggcctacaatcaaagcacaaactattaggcttatttcttgttttttattgatgagttaattggcatatttgctgccgctgttctttcctgcaccagacatacctgagtagatagtgaactagcctgggagcttcttaagggtaggattcctcagtatccatcttttcagccctagcttctagcagagagtgcctggcacttaataagtgcctaacaagtcatttttgtgggtgtgtggtgtatataaggttggtgatgagcatagtctatttttgctcaatttaagaattcctggagtagatgacatttctttggggctttgaagaatacaaggaataagggtgattgtgggggtatgattttgtcccaaatttaacttattatgttctacattcctcaaaactcacctcccttttttttttttttttttttttttcttttgagacggagtctcgctccgtctcccaggctggagtgcagtggcgcgatctcggctcaatgcaagctccgcctcccaggttcacgccattctcctgcctcagcctccccagtagctgggaccacaggcgcccgccaccacgcccggctaatttttttgtatttttagtagagatggggtttcaccgtgttagccaggatggtcccgatctcctgacctcgtgatccgtccgcctcggcctcccaaagtgctgtgattacaggcgtgagccactgcacccggccaaaactcacctccttttgttttctttatcccagcctcatccccactttctaaagctaaaaacacaagaaatagtccaccctttcctccctcttccctacgcttcacagccaattaactgcccaagcctaaaaacccctgacaattcttcctgagacatattttacctccatgtccatctcctctgccacagycctagttccagtcccaatcatttcttctgtagcacgttgctacagaacaacgaagtctgcttttttgagatggagtctcactctgtcgcccaggctggagtgcagtggcgtgatcaaggttcacctcaacctccacctccttggttcaagcgattctcctgcctcagcctcctgagtagctggggttacaggcgcccgccaccacacccggctaatttttctatttcttttttttttttttttcctgagacggagtcttgctctgttgcccaagctggagtgcagtgactrcaatctcggctcactgcaagctctgcctcccgggttcacgccattctcctgcctcagcctcctaagtagctgggactacaggcacccgccaccatgcttggctaatttttttgtatttttagtagagacagggtttcaccttgttagccaggatggtctcaatctcctgacctcgtgatccgcccacctcagcctcccaaattgctgggattacaggtgtgagccactgcgcccggcctaatttttctatttctagtagagatgaggtttcaccatgttggccaggctggtctcgaactcctgacctcaggtgatccacctgccttgacctctcaaagtgctgggaatagagtcgtgagccactgcgcccagccacagcagcttctttttgacagggtctcactctgtcaccaaggctgaagtgcagtggctcaaacacagctcactgcagcttcgatctccggggctcaatcagtcctcccaagtagctggctctataggcacacgccactgcgcccagctaattttttttttttttttttgagacagagtctcgctctgttgcccaggccggagtgcagtggcgcaatctcggctcactgcaagctccgcctcccgggttcacgccattctcctgccgcagcctccccagttgctgggactacaggcgccagtcaccacgcccggckaatttttttgtatttttttagtagataccaggtttcaccgtgttagccaggatggtctcgatctcctgaactcgtgatccgcctgcctcggcctcccaaartgctaggattacaggcatgagccactgctcccggctatagcggcctcttaactgagctttctgatgttggtcttcctcgactttagctcattttccacctttctctgaaataataataattttaataaaatgatgacaactggccaggcatggtggcttacacctgcaatcccagcagtttgggaggccaaggtgggcggattgcttgaccccaggaatttgagatcagcctgggcaacatagtgagaccctgtctttacaaaaaatacaaaatgtagcctggcatgttggtgcacacctgtagtcccagctacctgggatgctgaggtgggaggatctcctgagcccaggaggtggaggttgcagaaagccgagatctcaccactgtccttcagcctgggcaacagagtgagaccctgactcaaaaaaatgacagctttgccactcctatactcaccaacctcctcttgtatgggtgctgctgactctgctctttggtagtgtcccaacagccctttactctagccttgcccacctttccaggttcctgacctacccctcctatcagccacccccacttcaggcatattcacctctcaaccattctctgaacacagcttaccttttcaggcccaactcctttgtaccagccatttctgtcaatctgcctgatatgatcatccctctgcccattgcttcatggttttgtacccccatcaactcagtccaggcatcagctggtaaagccttccctgaatctccatggccgggcgcggtggctcacgcctgtaatcccagcactttgggaggccgagacgggcggatcatgaggtcaggagatcaagaccatcctggctaacatggtgaagccccgtctctactaaaaatacaaaaaaaattagccgggcgtggtggcgggcgcctgtagtcccagctactcaggaggatgaggcaggagaatggcatgaacctgggaggcggaggttgcagtgagccgaggtctcgccactacactccagcctgggtgacagagcgagagactctgtctcaaaaaataaaattaaaaaataaataaataaatwaatwaatwaattaattaaaaaagcctcccctgaatctcccagctctaggtgcccagagcacttagacaggcttctcatttctctgacaagtcccgcacaggtttatttacttctctgactcttctactaagtggtaagctccttgggagcaacaactgagtcccatcagctctggatcctcaaaacctggcatgcagtgcctatgaaaatgttctttaaaatgttcttggaggggccaggcacggtggctcacgcttgtaatcccagcactttgggaggccgaggtagacagatcacttgaggtcaggagttcgagaccagcctggccaacatggtgaaatcctgtctttactaagaatacaaaaattagccgggcatggtggcgggcacctgtaatcccagctactctggaggctgagacaggagaatcacttgaacctgggaggcagaggttgcagtgagccgagatcacgccactgcactccagcctgggcgacaagagcgagcctctgtctcaaaaaaaaagttattggaggactagaggttttttcaagctcaaaatggagcctagcatcacatttaaagatggagaaacaaagatcagggtgctggggaggaagctgacttggctggagaagatacactggagtgcacattggggtgggcagagcaggtgtggatattcaccctgtgaaatgcagggacaggttcagggacttgcccaaggacatgtggtgagtaagtggcaaggttaagattcaaacccagttctcctacctcccactgtacagtcttcagaactttttaaaggataagaaccaaatgagaggatgcacttctatagtgcgcactatgtgctgggcaccattgcagtttacaaattttaacttatttaatccttctgataatgctatgtggtaggtacaacctttcacccacattttataggtgaggaaactgaagtacagagatgttgagtaacttgtccaaggtcacagataagaaatagcaactgggcatggtggctyatgcctgtaatcccagcattttgggaggctgaggcgggaggatcacttgagaccaggaattcaagaccagcctgggctacacagtgagactctgtgtatagaaaaaagaaaaattagccagatgtggtggcacacacctgtagtcctagctactcaggaggctgaggtgggaggattgctagagtccaggagatggaggctgcagtgagccaagatcacgtcactgaattccaatctgggcaacagagtgagaacctgtctcaaaaaaaaagagaaatagtcaggatttgaatccaggctaatctggctccagaggtcatgctcataaatccaaggctatgtgggctctccatgcaaattatttaatatcagaattatggttataatgtttcctttctccctccttgttaaataaaatcataacacctttccaggggatgagcatctttccaaaaaacttatcatccctgcacttgtcctcccccagactcttcccactgctctgcacactttttgtgctctgccctgcaccctctgccaggattctcacctgccattttttcctcacagaagtgcatcagcagaggggagctccaggtgtctctgtcatatcagcctgtggcacagagaatgacagtggtggtcctcaaagccagacacttgccgaagatggatatcaccggtctctcaggtagcagctatttacttcaacctatttcttactgtctgaaccatccccgactccttgcctgtggcccagatagacctccacacttcaagatccttgcctctttcacttttaatctgctcctctttctgtagacattctcttcctgaygagtatctacgtccaatagatttccctggctaggaagattcttcagttgaacaaatggggtctttacatttggcaaggtatcctaaataatattcatgccaggtgctaagagagacttctcaaaaaggctgcaggcatttgtctctgtgccctttaatatacttcttggtatcatgggatttcttcagacctaacctgagaaagttgttctgttctattcctgcttggtttccttggcccctcatccaggcargcagactsacatatagtcagtgtgtgtttattgtgcaatcactaaagaacacatgggatggccatcaaagatacgaacaacagagccccccctttcccaacatgaaattaccattacataggagaggactgtgtcataggtctgtctccctttttcttatctctttgggggccccagatccttatgtcaaggtgaacgtctactacggcagaaagcgcattgccaagaagaaaacccatgtgaagaagtgcactttgaaccccatcttcaatgaatctttcatctacgacatccccactgacctcctgcctgatatcagcatcgagttcctcgttatcgacttcgatcgcaccaccaagaatgaggtggtggggaggctgatcctgggggcacacagtgtcacagccagtggtgctgaacactggagagaggtctgcgagagcccccgcaagcctgtggccaagtggcacagtctgagcgagtactaatcctgttcttctctcctctaatccccgggggccaagctggggagggatgtggaggggaaaaagatgacagagaagtggactccaaacctcattttagttgtagaagaaaatttcttacaaaacaaattccacaaagaacaccctatatgaccacagctgcagatcagttcttagcaatgatgtttttttttctgctttgcaaggcgctagaatcttttattttactttattttttttgaggtggagtttcgctcttgttgcccgggctggagtgcaatggtgagatctcaactcactgcaacctctgccctccaggttcaagtgattctcctccctcagcctcccaagtagctgggattacaggcacccacgagcatgcccggctaattttttgtattttcagtagagatgggtttcaccatgttggccaggctggtctcgaattccagacctcaggtgatccacccgcctcggcctcccaaagtgctgggattacaggtgcgagccaccgtgcccggcctctggttttgttttgttttttttttttaatgggggacaaaagagagggaaagacccctataaatctatatataacaatgtaaccatatacttgcatgtctaatacaaactgaagaaattagcctaactgccaatatcaagttgcagattttaatccatggaaattgtgttttgtgctgaattgtatttkctgattacctgaaattggcttctttttattgggcttctctggagaatttctcccactccccacctctgcagaagaaaattttgctcttataaaacctcatgttttcatcattccyatcttttctttttattgcctcttatatctctgctctttgacctcaaggtctagaggtctgcagtaagccaagaaacaaaggtggggtggatgaggcaaggtttgcaggagaaagaggaattgagaaatggggtatttttgctatcagctcttctgctatgaagtagtaaaaggcagtctataattaactgacagacctaactgaagcacagagaatacatcagacttatgcatccaagacatcagaacttggattttatcaaacttgatgacttctctaaaaggagctttggaaacttcaaattcagctataggatagtaccaatgaacacatccagctgatcccaaaagctgttttcaggtataaggacaaggagaggagacaagtgacgacagccattcccctttgcagctatctactgtagtgacagccatttcttggttgatgggttggaagtcatcagaggtttgaagaattacactggcctttgtttttctggaaatgccgaccatggagatgctttagagtcttctcaaatagcttagatgttgtaatgaggttagctttgcttcataaaacaggggccctcagaagttctccttaaatttttcaataaaaatttagctcttaaaaaaataacagtgtgactgagtgaatgaagataagttggattctttcagagcattcttttcctcaaaacgagctgcataattcttggaatttatgtcttaccacatggtggagggatggaggaactacaggatgcaattcttcttctaccaatgggcaatagaggttgagagagattcagcatctttctgggattagaattcaagtctctttactcctacagcagctgtgtctccaacgttgagactttgcagatggcacagactccatggataataggtaaacttggggccgggcgcagtggctcacgcctgtaatcccagtattttgggaggccgaggtggaaagatcgcttgagcccaggagttcaagaccagcctgggctacatgacgaaactccatctctatcaaaaatacaaaaaattaactaggtgtggtgctgcacgcctgtggtcccagctattcaggaggctgaggtgggaggatcatttgagcccagaggtagaggctgcagtgagccatgatcatgccactgcactctgggctgggtaacagagtgagatcctgtctcaaaaattaattaattaattaattaaaataaactaggtaaacttggataggcagtagatatttttgcccacctgaggaggaactcagtcaagctgttgcttaacagcttgatccagggcgtgaaaggttagttgagactgaagtgttcacttccatagaagaacatcacttttaaccttgctttggcgaagggagtcggaaagctgagtctctatggacgggggggtgatcttgctttcagtgttccctcagcttttgtggatttaaaaccattctgctccccctaaaccttttgtttgatttcagcccatgttcttgacaatgcagagcaattctgagcagtcacaaagcctactctctgttcttgtccctgccaacccccaccccccataatctgactcacaacttcaccatcagttggggtcataccactagtctctgtcctataccccatgaaatgtaaatactgtatcataagtagaagaaaataatttttgttttctaaaaatgcattttgagatagtttaatgtaaatctgacaggagcattctgaagccccattaggaaaaaatttaaatggttcctcttcatcgccttaatgtctaaagatcagaaatcgctgagcaaacccgcttttgtttccttcccagaaacaatgcaaaacaacaggtggagatagtctggtctttgccctgctgtgtgtgcctctgtagctcctcctgacaaacgtctgggaaaacagcctcaccccactctcctctctcttccccatttccttgtagctttattccttgcatctttgggtctactgagcagtgggtgctgaggtgacaggggaggaaccagttgttctgtagcctaggaactgcctcagtgtctttgccagaaaaaggcaaagaggcggacagtgcagggctcctccctcctacctcaggcctgatccatcgtgcccttgactttgccgtctcaaagtttcttagctgactttggctttcacatttgttctttccagagctaactgataagagtggaggaggaatgccttctcctaagagtcagttgaaagaaagacaagagagtcacatcttagcttttgcacaaggcattcgtggtcaggaataggttagggaatggtcacttctgattttccaacagttgctccttctctgaagagatcttgattcctttgggaagacaagaatttttcttaataacaaaggtccctttatgagttattccttctttcagttcatctcactggagcacagccaagatggacatgtttatggacagtgctctagatgtgaaaacagatagaactggtttgtgggacaggggcagcttgctcaggagagggaataacgcaggtcccttttcttggaaggcttgtactatggccatgacagtgacattgccctcaccatgatccctctccaaagtggttgtctttytttaccttgtgtcttctcttgtaaaaatgaaactcaaaaataaaataaatgtgtcaaattttgaaaaaaaaagaaaactgaaaaagctaacatgaattgtgtgaaattgcataatgctgtaatgctaatctacaatatgtaatgctatcttgtatsttgaatttgttaatgcmccacacaagtgcaaaataaagactgattcacattacataggcacagtgatgtcagcctgattctctggaaagctggaggactctcagtgaggttaacactcagactccaaaaggatgttctagggtgtgttttccaaactgtggtccccagaccacttgattcagaatcatctgaggcacttgtttaaaaatgcagattccaggctcccatcctagatactctcatttgacaagtgagttggtttgctgcttgctgtagttaggacttctggtctttctgttttcctcttgaaatgtaatttctgagaccatcactaccagagggagagatgatggttcgtagtgctgagaatcaatctgcccctttaattggaaatatttatcccaaaaagcaatcctgagacaggccaattctgttccctcattcattcatttacttttttttttttttttttttttttttagacagtctcgctctgttgcccaggctggagtgcagtggctcaatctcggctcactgtaacatccgcctcctgggttccagcgacctcaagcagctgggactacaggtgcgtgccaccaagtttggctaatatttgtatttttagtagagatgggggtctcaccatattggccaggctggcctgaaactcccggcctcaagttatccttctgccttagcctcccaaagtgctgggattacaggcgtgagccaccgcacccggcctcaaggcctgtcaggagctatgaaggatctccctagacctgaacatgggaggatgtggggctgaggcttctgtagtcactgtgccccagagaggagagagcctgagaatggagcctgcacagaagtacagctaaaacagggggagagagaaatcagactccatgacatctttgacctcagatgaagccgtgtcttcagacagatctgagccttctcagttccaaggcttaataaattacctttttcttttcttttttttttttttttgagatggagtctggctttgtcgccgaggctggagtacagtggcgcaatcttggctcactgcaagctctgcctcccgggttcaccccattctcctgcctcagcctcctgagtagctgggactacaggcgcccgccactacgcccggctaatgttttgtatttttagtagagacggagtttcactgtgttagccaagatggtcttgatctcctgaccttgtgatccacccacctcggcctcccaaagtgctgggattataggcgtgagccactgcgcccagtcaaattatctttttctttatgcagcttgcactgggttatgaaagtttaatttctgagtgaaacattaaatggcaaaagttaatgtttgatgtttggcttgaataattttctttctttctttctttcttttttttttttttgagacagagtcttgctctgttgcccaggctggagtgcagtggcgtgatctcggctcactacaaactccaccttccaggttcaagcgattctcctgcatcagcctcctgagtagctgggactacaggagggcgccaccatgcccggctaatttttatatttttagtagagacaggatttcaacatgttggtcaggctggtctcaaactcctgacttcgtgatccacccgcctcagcctcccaaagtgttgggattataggtgtgagccaccacacccagccataattttttttttcaactttcattttagattcaggggggacacatgtgcaggtttttgttatctggctttattgagtgatgctgggatttgggatcctaatgatcctgtcacctagatacttagcatagtacccagttgttcgtttgtttgttttaaaacagtcactctattgcccaggctggaatagagtggcgcaatcatggctcactacagtctcgacctcctgagttaaattgatcctcctacctcagcctcccacataactgagactggtgcacaccaccatacctggctaatttttttttttttttttcttgagacagagtctcactctattgcccaggctggagtgcagtggcacgatctcggctcactataaactctgcctcccaggttcaagcaattcttgtgcctcaacctcctgagtagctgggattacaggcacgcaccaccttgcccggctaatttttgtatttttagtagagatgagggtctcaccatattggccaggatggtcttgaactcctgacctcaggtgacacacctgcctcggcctcccaaagtgctgagattacaggcttgagccactgtgcccggccacctggctaatttttaaattttgttttgtagggatgtggccctcactatcttgggaaggctggtcttttttttttttccgggagacagagtcttgctctgttgcccaggctggagtgcagtggcatgatcttggctcacagcaacctccgcctcctgggttcaagtgattcttgtgcctcagcctcctgagtagctgggattgcaggcatgcatcaccacaccccgctaatttttttttttttttttttttgagatggagtttcacaattgtttcccaggctggagcgcaatggcacaatctcggctcaccgcaacctccgcctccaggttcaagcaattctccctgcctcagcctcccaagtagctgggattacaggcccgcaccactacgcccggctaatttttgtatttttagtagagacggggtttctctggtcttgaactcctgacctcaggtgatccacccaccttggcctcccaaagtgtaggccgatagtttttaaaccctcccccttctggtagtccccagtctctattgttgccgtttctgtgtccataagtactcaatgtttagctccctcttactagtaagaacatgcagtacttggttttctgttcctgtgcttaggataatggcctctcattcatttattagtcaacaaatatttatttgagtgtctactatgtgccaggcactacagatacaatacattggtgaacaagagtgctgttcttgtagagtgtagcagaggacaatattaatcaaataattacactaataaatatatgattacaaattaggaaatgctctaaaagaaaagaaacacaggccgggtgcggcggctcattcctgtaatcccaggactttgggaggccaaggcgggcggatcacctgaggttgggagttggagaccagcctgaccaacacggagaaaccctgtctctactagaaatacaaaattagctgggcgtggtggcacatgcctgtaatcccagctacttgggaggctgaggcaggagaatcgcttgtacctgggaggcaaaggttgcggtgagccgagattgcgccattgcactccagcctgggcaacaagatcaaaactccatctcaaaaaaaaaaaagaaagaaagaaagaaaagaaacacaggaaaatgcaacactctagggtaatatactgggggtaatatgacccttgcaactgctctttgtggatttctctacatgccttaaagtctggagtgattcacttttcatattttctgttctgtgtaatttatcctccctgtgagaggaagagagaatggaaggagaatcaattcctgctctttaaaagtttcagtgaaggaactacaaaatattttcaaattataaactaatataagcacattataagaaaactggagcagggcgcagtggctcacgcctgtaatcccagcacttcgggagtccgaggcaggcggatcacaaggtcaggagatcgagactatcatggctaacatggtgaaacactgtctctactaaaaatacaaaaaaattagccaggcatggtggcatgcacctgtagttccagctacttgggaggctgagacaggagaatcacttgaacccgggaggtggaggttgcagtgagctgagattgtgccaccgcactccagcctgggcaacagagcgagactccatttaaaaaaaaaaaaagaaaactggaaccagatgcagtagctcacagctgtcatcccagcaccttgggaggctggggcaggaggattgcttgagcccaggagttcaagaccagcctgggcaacagggagaccttgtctctacaaaagtcaaaaacttagctaggcatggtggcgtgtacctgaagtcctggctacctgggaggctgaggtgggacatcccttgagcccaagagttcaagccttctgtaagccatcatagtgccactgcactccagcctgggtgacagagtaagaccttgtctcaagaaaaaagaaaaaattggaaaatagagaaaagaaaaaaatagtcaagattccaaaatcttaataattactttgtctctttatttttttattttttatatttatttacttatttttataaatagagacagggtgttgctctattgaccatggtctcgaactcctggtctcaagctatcctcctgcctcagcttcccaaaatactgggattacaggcatgagccaccgtgcctgggcccattttgtcttctgagcttatctcttgtgcatatttttcttgatacatcactcagaatcaatgtagaaaatatgtaaaataaagttcaagtcatagaaatagggggaaatccactcagaggcaagcattgctaattttggcacatcttccaatttgttttaacttatgattgcaatcatggtatgtatatcattttgtatattacttttttctagatgactgtcttaaaaataacaacatcatcatatcacaatgatggtaagattatcttggcactcagcatacttttggctacaattaacaggaaacccatttcaagttggcttaaacattaagaaaatgcatcagctaacctaactggaagtccaaaggtggggtagccttccaagttgacttctgcaaaaggtcactaatactgtcaaggactcagattctttccgtgggtcccccctgacattcaatgtcagcttcatcctgtggctttcatctgatgaaccactcccaaggtttcttgcttcctcattcaccgccaggtggaaagaggagatggctcaggacctttcccagaaaaataagagagccttattcccagaataaattctgaaaagcctctagcaatcctctcatctgtttttcctgatccaaaatgtaacatggtcatttctgaaccaaacattgacaaggaggatggaattttctttagatcacttaggactgtcctggagctgggcacgggaaaaaggtgaattcttgaatgaaatgtcagtttttctggaaggaggaatagatgctgggcgggcagccaaccaagagcactgcagtagtccaccctaccctaatcctgggttttgttttctgcagtttcacttacccacagtacaacacaataaaatactctattttgagagagaccacagtcatgtaacttttattacagtgtatttttataattgttctattttattagactgttgataatctcttactgaatctaatttataaatttaacgttattatagatacatgtgtataggaaaaagtatacatagggttcgatactatccatgatttcaggcatcctctggggatctatgaatgtatcccttgtggataaccgggagctactgtgccttgtatttttgtttgtttgtttttttgttttcgtttttgtttttgagatggagttttgctcttgctgcccaggcgggtgtgcaatggcgtgatctcagctcactcccaggtttaagcaattcttctgcctcagcctcccgagtagctgggaatacaggcattgcaccaccacgcccagctaattttgtatttttggtagagaaggggtttcaccagggtcaggctggtctcgaactcctgacctcgtgatccacccacctcggcctcccaaagtgctgggattacaagcgtgagccaccgcgcccagccactgtaccttgttttctatagacctctcactccaaggtgctttttcatgtgatctccttataacaaactcccagaaaagagttgccca

SEQ ID NO: 12201 - DNA, 15818 bp, Homo sapiens
tgtaaactaattcaagccttgtggaagtcagtgtggcaattcctcagggatctagaactagaaatatcatttaacccagccatcccattactgggtatatacccaaaggattataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgtaattggaaatcatcattctcagtaaactatcgcaaggacaaaaaaccaaacactgcacgttctcactcataggtgggaattgaacaatgagaacacatggacacaggaaggggaacatcacactctggggactgttgtggggtggggggatgggggagggatagcattaggagatatacctaatgctaaatgacgagttaatgggttcagcacaccagcatggcacatgtatacatatgtaactaacctgcacattgtgcacatgtaccctaaaacttaaagtataataataataataataataataaaaagaagtgataaaaatgttttggaattatatagtggtgatagctgcacaacttcatgaatatactaaatatatttttaaaacggtgcatttcatatgtaaattatatctcagtttaaaaaaacaattaaaagaagaataatttcagttgtgtgatcagtataaaatataaccaataaaaaataggagtgttactgctgaaacaacatgcaataaattaattgtaaagaaagctgtcaacttctagatacccaagtatgagctagtttctttgtgggtgtattgcaaattatttaccgtaaaaattctgctttcccgttgtacattttacaaatccttattgaaaaccacgaattcaaatatctgtagggtaaatatctaaaagctcaagcactctcataattcctagtgataaacttcctgttttcatttccttggagtaaaaacctcaagatccacccagaacaccaccccaaacttcctgtcatcttgttctatcttctttttttttcaaattttattattattatactttaagtttcaggatacatgtgcacaacgttgttttgcagctcaaaagcaaaaatatccaaaattgtacaactcttttttgtttttgtatccttttaggagcttgaaaagtggttggggtaaatgactcccttaaacaaagctaaataaccatttgctctgaattgatggtcagttttggagagatgattattttgcctctttccctgtctctttggtgagggattgttctctctaatctccagctttgagaatttgtccaatcaatcaaagcagatcttgaattacttctaggccacctggacagggacttaattatagcttcatcaataatagtaatatttcaaataatgtatcaacagaatggggtgactaccagaaaaacagggttcagagaggcaaaactgttgagagaatgacttggagggctcatcaatctggcaacccgagtgataatccctgacagaaatttcccgaaactaaagcaaaataggttcccagttaccagctttcctgatctgattgcaaagttaccaagccagatttaccttgtttcctaatattgggatggagatgaagagggtgcttcagataaggaacgcaatctttgtggtcactggaaagtagtatatctctattgcaaagtaataaattaacaatcaaagtactatatcagttttgagataatttgattgacatgagccatcactgagagcctgggtattctgagaaagttcaatatctagacctaaagctcaaggaccaaactctagcttaacaatttgttgatccactgccctatgagagttctaacctgacaacatctccccaaaacatccccccaaaacatccccatcgcctaagagtggtgtttaaatatttccaagacagcttgttggtttggccaatttagtcaattggcaattttggataatttagtcaagctatttaatttagtcatatcagtgggagaaatgtcaaatcatttagctgatatttggaatgtaaacaaaaatatagataattttcatttaaaatttttttccaccagttggtttatatagcatttgaggatagaactagggtgccttttgcaagattctagtctgaacatggtgctcaggcctgaagctgtctttggggcaaagggaaattagaactctcccttctccttatgttcttgggaccagattcagctggaagcagctggtctcaagaatgtactgagtctgacatccattcatctcactacatcagtttcaccttaacttacttaatagtcctctgtgtcacttttcatgtgatgcgtagacaaagaggtagtttgatgaaaataatcactcatgttgggcatttcactgaattttaagctggtttctacaaaatggccaatctgattgttatttctgaataaaagaccttatttttttttccatttgctttaattgtgacatttcacagacaggcacaaaaataatatgcaaagattcatcaataatgggcaatcttcttaactaccctccttttagagacccccaggttaggaaaagtccagtgacaattaaagcaaggctactctatgggtaagtgaattaaagaaaagttggtataaagtatgtacgtgggtacatgggtatgaatggtgtgtgtgtgtgtgtgtgtgtgtgtgtgttgaagttgagagaagtggcaatgatattggcactcagtgtggtggctggggttggggaaagttaaaatgactctgagagacctagattaaaaaggaagacccatatatattaaaatcattccgtaatctgtacctctaatctttacctctataaccagggcactatgtctagaatttttacgcatttttgcatttatgtatttcttttctcctttgaagtttcatctgtgtgtgtgggtggaggtgaggcggcaaataaaatttgttctgaactctgtaaccttctagcagaggaagaatttctctcaagaacatttacttttttagcttagtcctttaaaatttactgttaagtaatctcacaataaacaacaggtattcattagaaaaaaattaatttaatgtgatttactatttaattctgctagctcagctacacttgtcctgcagagctgcataatttattcaaatggcctgaaactttttaagtaagtctaccagcagaaaaattattccctactcccaggagaatgaactttttgtgttgtactgcttcccaggactgacacttatttgactctcaagtgtatttacattgttggcttaactgggagttctttgctgaatcaataatatacagtatttcttcaagtggtgtcaatattattgctattctttttataaactttttgttaattctctgcagttacaaaatttttctttgacttgtgaaaaaawttactcctaagattatgaagacgcagagtaaatggccctttaatcttctgggaaatatgtacctctttaaactttatttatgtcagaacttactgtaatgaaggacaaaagctctagacaaggtcccctgttccttgtgggtgttcaaggctaggtcttccggagacaagcctgtagtttgttctcataattttatagctcacctcctggctgtttctttgcaaggggcctaagagggtacaagaaaaagagcagggtgagaatctgacccattgtgaccactcgggaggccctggcctggaaacttcccctttatgtggcaaaaacaaacatttgaaatggagggagaaaccaggtttaaacaatgagtgaaaacagtttccatctcagctttcctgctgataaacatatgtgccccctcatttgtttcygaaacataagttttccatcattttaacagagcctcagcctcaactgaatctgtccagagcataggaaacaaatattttgagatttagtaaaatggtgcatacatatattaggggcattttgacaatgttcaaactgtttaccaaacaaactttatgatggcctatgcaaacctttgaatcctactgtatttttcacgtaacgatgacttctcactgatctcatctgcctgtgtgctacagtattgactttaatattaatggagaaacagacagatatcaaaagccatgtgatttgtctcatgccatttgcaattttgtcttctgtcatcaacactgacttctccttccttgttctgctgaactccatacttaggtgcccagctacttcctcagagcctgccctcattctttacctgtggcctgcagcatggacaggtgcattcttgctgcttatctgaaaaatatgatccacagaaataacttgaatctttttgcccatttaaaatgtgctctaggttctctggttctctgtactaactatagaaagccatctagtcacaagtttctccttcctgtggtctccatttgggcaatacaattaagaaaaatacgtttccccacataacaattcttccaattcttttccccttctttgatgcttttatgatagattatgaatggtcatcagtgattttctgtaaatgccacgtttcctttttgccaagacaaagagtgagactaagggaccatctagtgcttcctcttgtggtatagaggctaaacagcgtgagttctgatattagtttcctttgatttaaatgcaagtgtcttcatttaatagctgtatgatctcagaaaagttattaaactctatgagtcctagtttcctgatttgtaaagtgggggctaatatgaatagcttgtaatagcacctaccatatgctaggcatgattttaggcactttaaacatattagctcatttaattttccattagcttatttaaaattcctactctacgatgtaggtaatttatatcattctcctttctcagatgagaaactgagacatgaagaagtaaagtaacttggccaaggtcagaattagtaagtggtagagctgggtttgtaaagccaggtagttggatcccagaggctatttactaaccagtgtgctatattgcctctctattaaattattgatgataaataactcatcacagtgttcggcacataacatttattgtcagctagtattatcactaccatcacctgttcttatctttcttcattttgtcactcttgcttctgctggattggttgtgtagtttattgcccccactgccacaagagacagcagcaacagtgatctaggttgaaatagctagctaatccctcttcactttatgtgctttgtatttaaaccacaaatatgacagagacctatgaaaggagactaaacctctttttggtcgtgtaaaaattatattcctgcaatctccaaccctccagcaacaagccaacaaaaactgcgcaaagcaagggagaaattttagaagtrgtagacttcaagtaaaattcctaccattctttaataaacaggggtaaaaatttcagaaagtaatgaaggttgtgaaagctgatgaacaaagactttgctactataataaatttcctagtctctactcactaatttctattagaatgccaatatcaggaaaaaaggaagagaaaattctgtaaataattactatatttttctcctaccaagtaagccactgacttcaaaattctctagcacatttgtggaaacttcattttttttgtttgagatttatttgaatgagctgttatgattggagacagygagaatttcagattaatgttttgcagacaaaaaaaaacctctctggaaagctggcaagggttcataagtcagccctagaattatgtaggttgaaggctcccagtggacagaccaaacatataagaaggaaaccagagatctggtgctattacgtcccagcgtctgagagaacgagtaagcacagaattcaaagcattctgcagcctgaattttgaaggtaagtatgaacaatttatatawaatttacttggaaagtagaacatacattaaatgaaaatattttttatggatgaacttctgtttttcctgtgttttaacactgtattttgcaaaactcctraattatttagctgctgtttctcttacaggagtgtgtttaggcactaagcaagctgatttatgataactgctttaaacttcaacaaccagtaagtcttcaagtggaatttattattgattcttttatgttaatttgttaggtcwaaagaaaaayctttagagcaaaataaaagttttgctctttattaggaggttctttagatattacacttttaattgggtagcttatttgcatgtattttgaaactatctaaagtaaatagtgtttcctttktatgcttatctttagctaatgtgtttttttttttggttttaaaataatgcttctagtgaaaaaaatcacaaaaacctcaacactgtaacgtttgagagcaacggctattcagttcggttaaaccgaaaagagagaaaaagaaaaatgataagactatatcatgattaatcattgatgttcatttctcatttcactgagcaatctaaactacttctacttgaacctaacataggtttggctgtttttttctttatctgatttaattgaaaatggattgtttagatattaaatagaccaaaattagatatctatatctaaaactaatattctctattaaaaggagaagacttagaaatataaatatatttcataacttcttcttaactatattattattgtgaaaacaatagaaaagtaaaactaaaggaattatttttaattattaaagacaaaccatgattccccatcacaatatgttcctttggcatattctcttttagttttttatatacttattttttccattgcttatgttacttatattttccacagctgtagtgatttgtatgtaattagttacttaaatagagcatttctctatgcaatagcaagcagcagtgtggtttctagaaagtatacaaacagagatatatgctcaagtgttttttgaaagattaacttttcttacctctgggtttcttatttgtttcacacatttcctgccctgactaatcttttgaaatattaattttctttaaatctttcaaaaacatcatagaaaagatggssaaaaggtagttttattcagaactttgaatctctgaaatgtcttttttctactatcaggaaaattatttctcctttttcaagaggtaaaatgaattcttgttttacaagccatggctctgtttcttaatgttttctataatcactcactttttttttgcttttgacaaacattcaaaatgctaatgattcaaggatgtcctcagctctgtatgtgttctaagagttctatgttttttctccacagaaggcataagaactaggagctgctgacatttcaatatgaagggcaactccacccttgccactactagcaaaaacattaccagcggtcttcacttcgkgcttgtgaacatctctggcaacaatgagtctaccttgaactgttcacagaaaccatcagataagcatttagatgcaattcctattctttactacattatatttgtaattggatttctggtcaatattgtcgtggttacactgttttgttgtcaaaagggtcctaaaaaggtttctagcatatacatcttcaacctcgctgtggctgatttactccttttggctactcttcctctatgggcaacctattattcttatagatatgactggctctttggacctgtgatgtgcaaagtttttggttcttttcttaccctgaacatgtttgcaagcattttttttatcacctgcatgagtgttgataggtaccaatctgtcatctacccctttctgtctcaaagaagaaatccctggcaagcatcttatatagttcccctygtttggtgtatggcctgtttgtcctcattgccaacattttattttcgagacgtcagaaccattgaatacttaggagtgaatgcttgcattatggctttcccacctgagaaatatgcccaatggtcagctgggattgccttaatgaaaaatatccttggttttattatccctttaatattcatagcaacatgcyattttggaattagaaaacacttactgaagacgaatagctatgggaagaacargataacccgtgaccaagtcctgaagatggcagctgcygttgttctggccttcatcatttgstggcttcycttccatgttctgaccttcctggatgctctggcctggatgggtgtcattaatagctgcgaagttatagcagtcattgacctggcacttccttttgccatcctcttgggattcaccaacagctgcgttaatccgtttctgtattgttttgttggaaaccrgttccaacagaagctccgcagtgtgtttagggttccarttacttggctccaagggaaaagagagagtatgtcttgccggaaaagcagttctcttagagaaatggagacctttgtgtcttaaacgtgagagcaaaatgcatgtaatcaacatggctacttgctttgaggctcaccagaattatttttaagtggttttaataaaataataaaatttcccctaatcttttctgaatcttctgaaaccaaatgtaactatgttttatcgtccagtgactttcaggaattgcccattgtttttctgatatgtttgtacaagattktcattrgtgagacatatttacaacctagaagtaactggtgatatatctcaaattgtaattaataatagattgtgaataatgatttggggattcagatttctctttgaaacatgcttgtgtttcttagtggggttttatatccatttttatcaggatttcctcttgaaccagaaccagtctttcaactcattgcatcatttacaagacaacattgtaagagagatgagcacttctaagttgagtatattataatagattagtactggattattcaggctttaggcatatgcttctttaaaaamgctataaattatattcctcttgcatttcacttgagtggaggtttatagttaatctataactacatattgaatagggctaggaatatagattaaatcatactcctatgctttagcttatttttacagttatagaaagcaagatgtactataacatagaattgcaatctataatatttgtgtgttcactaaactctgaataagcactttttaaaaaactttctactcattttaatgattgtttaaaggtttctattttctctgatacttttttgaaatcagtaaacactgtgtattgttgtaaaatgtaaaggtcacttttcacatccttgactttttagatgtgctgctttgatatataggacattgatttgatttttattattaatgctttggttctgggttgtttcctaaaatatctgggtggcttaaaaaaaactctttaacttgtaataaacccttaactggcataggaaatggtatccagaatggaattttgctacatggggtctgggtgggggcaaagagacccagtcaattacatgtttggtaccaagaaaggaacctgtcagggcagtacaatgtgactttgaaaatatataccstgggggtagttttaccctatatctataaacactgtttgttccagaatctgtatgattctatggagctattttaaaccaattgcaggtctagatacctccttctcagcactattaaagctcctaagttagaggagtgcctaaaactgagttacctaaagtttacttacattaaagtatgaatattaattttagaaatttgagactttattctgtaccagccctgtataataacaggttatctaggaccttcctctgaggtaggtctaaatactgatctctgaggcggaactaacgttttggggactcagcatctctgccaggttccaggattatagacagaagagtcctgtcataccactttctggaaaagtcctaatttcatgtaatccttttattttcaataaaaacaaatagctaaatgtataaccaactatgatgttatgttttcaataattttgtaaaacagctcatataaataaaatttttaattggaagaacattcgtgcttttaaaaattttttttaactacttctaagtatatattctacttctaagtattcttaccttctcttgtatctgtatcctccattttatctccactgatactacttagtttcagctcggattattactcacctggcctcttgctatactgttcaagtcttcctctcttgagtattgagccataatttcccattagctatgaaagcaaaatccaactttcttcgagtctgcaagaccttgggagatgtgactcttcctagtctttctggactttttctctctgtcacacctcttcaaaccctgtgtttaagcatcaaaaaatgacttaatgctttttaaagcctaatgccctttcgtgcctctctgctgttgttcacacagctccatcttactaaacacccctccaatcattctcacctcctcagggcctcacattcaagtgatgaaaatctgctcaactttcgacattcagctcatgctatttcctctaccataataataattattatactaattataatactacacccctagaatttcctttaatgaacagaattgcttctctagtttttgggatgttaagcctgatgtctgcttttatagaagcccaatgttgaaccctgagtagtagcctccaagtggtttttcttgggactaagaagaaatgccagttgagaggatggtacaagaatgtgtgaactcttgctttaggaatgtatgtacaaaagtgtacttgtccgcttttctctttgaaaatgcaaatttcaggtaagcttctcagataacaaatgaaaatgtttttattctcattcggccacttttcaaggtattatgtaatatcctttctttttcatgaccccaccttttctcaagtcacccaacacaatgcctgggaagtacataacataacaacaggtattattagatgagcattatgtgctaagcaatattaaatatgcattgttccattttattctaaaaattactcaatgattattattttacaaataaggaaactgaggcacagatgattcctgactaatctttaaatttggctctgacagatgaatcaggtagtatcaattatgtgatttagtacttcaaatataaatcctaggccaccaagcaggtatttcagacagtcttacacactccttcaaccttcaccttaaagttagtacttcagtatccataaccttggtaatacaagtgcttctgtaggaaaagataggaggcagactgatgaggctttctccctttttcttcactgccctttctttgtactccatactgtatggaactacataaagtcaccactatcccctgctgccccctctaccctgtacacaaagcaagacagatatcttaaatgtttcctttaaggaacaaacatgttgatatgaactttagctctttgaaatgagattatatagggttaccagagaaactcatctcttgcatcttgcagaagtaatgtgtatttttattatggaaaagtaaatattaattatttccacattttatagccctaaatcagacctactaaatagattattttgcaaaatatcctttcttctgattctttgaggcatgcatcaaaatcagaagaaaatctgaaagtaagcaaattctgttttgactttttttctcttttgttcccccacaggaatctgaggatgggaaactgtctggtgtcctcacatatcaacaagagaaaactccaaacttgacaagatgagttaacacatgagatgtctcaagcaagaaagggttgagggttgacgcaataaggataatagaacacttattttgttaattctcacataaactataacagcagtgataatttatacaaaataacagaaattcataaattatcactaaaaataattatttcacctgcagaagaccagtggcccagagattagttagctcactccatacacacacctacaaagggttagcaccctcaaaaataaattctttctttttgaacattttttggaataagataattctttctaaatttaaaaataactgatatatatttcttattatagaatcaatacttattcttgaaaaatttaactatagggacaaaaattagctacagagacgatcaccactaatagcatggggtaaaattattatatatacatacacacacccacacagagtacatataaatggatagatacaatttatttttatctctatatctttattcctatttctttctcttttttgtttattatctatcagatatgttccttatcactgtgttgtacatttatttaaatatttaaaatattttgaccctaaactcccatctggtgtactagacatttttctttctttactcatttggtcctcctttcctatgataagccccaaatcccgagagctttaagcagtccaagagatcacacctggttataattttccagtgaaagaaagtactggaaattctgataagtctgctagcccattctctgcaactgttgttgctacattatttatcagttggtctgcataagaacagatgtctgagtagtctcatgcagacttctgtccacttaagtagttttgaagtgatgtatgcacaagccacctgataacgatataagaggggaaaaaaggagggctcttccctttctccagtgctacactcacctatatctgatgtgtgtcaaagtagacctgggctcaaacacgtatttctgttttgccacctccatggagccaggagcgatcagcagaaacccagctagcggaacatgccatacaaggaaccagtcttttctttcctcaagtaaacatctcctgtgcagctggagtcacatttcaaaattttcctcaataaaaaggagtatccctgattgggagaggaagtgggtagttgagctgttgttgcttctccatgacatcagtagaggccatgttagtgcataagatatactgaaataactttgaacttctttttaaaaaggagtctaattcttaattcctttcctctccaaaaggaaacctaagttcaacacaccagtgtgtacagaacacagttggcacaaacccatttgcctgaaaaattggaaccatcaaactgttgccaagccctgatatttccagctatagccttccttcacctatttacattcatataacaaaaatgtacatggaagtgattacaaaaaattacaaaaaatcttctactccaactatttgtgatgtcctaacagcttgaaacatttgtgaataacagatttgaaatgacactttttctatctcctagaaaaaagcaaaagtatgcctcattgtatatgctgttatctattcttatggactgaattgcaaccttccctcacaccaaaaattcatatattgaattcccaacccccaatgtaatgatatttggaatctttttggaggtaattaaggttaaaggaagtcataaaggtgaagtcttaatttgataggacagtagtcttgtaagaaaaaaagatacctctgtctctctcttcacacactcacaataagaaaaggctatgtgagtatatagcaagaaggaagccatctggaagacagaaagagaaccctccaacatgctggcatactaattttaaactttcagcctccaaaactgtgagaaaatacattctgttgtttaagtgactcagtctatggtattttgttatagcaccctgatatggtttggctctgtgtccccacccaaatctcatcttgaattgtactcccataattcccttgtgttgtggaagggaccaggtgggagataattgaattaggggggcggttttcctcatactgttcttgatatctgatggtttgacaaggatttcctcttttgcttggctctcattctctcttgccgccatcatgtaagaagtgcatttcactttctgccatgattgtgaggcctccccagtcacatgcaactgtaagtccattaaacctatgtttcttcttagcttgggtatgtctttatcagcagcatgaaaatggactaatacagtaaattggtaccagtagagtagggcactgctgaaaaaaatacccaaaagtggaagtgacttcaaaactgggtaacaggcagaggttggaagagtttgcagggctcagaaaaaggcaggaaaatgtgggaaagttggaacttcctagagacttgttgaatggctttgacaaaaatgctgatagtgatatgaacaataaggtccaggctaaggtggtctcagatggaaatgaagaacttgttgggaactggagcaaaggtgactcttgttgtgttttagcaaagaggctggcagaattttgcctctgccctagagatttgtgaaactttgaacttgagagagatgatttaggttatctggcagaaaaaatttctaagcagcaaagcattcaagaggtgatgtgggtgctgttaaagacatttggttttataagggaagcagaacataaaagttctgaaaatttgcagcctgacaatgtgataaaaataaaatcccattttctgaggagaaactcaagcctgctgcagaaatctgcataagtaacaaggggctgaatattaatccccaaggcaatggaaaaaatgtctccagggcatgtcagaggtcttcatggcagcactcccatcacaggcccggaggcctaggatggaaaaatggttaagagggctaggccttgggtccctgtgctgagtgcagtctagggactttgtgccctgcatcccagcctctccagtcatgactaaaaggggccaaggtacagctcagaccatggcttcagaaggtgcaatccccaagccttagcagcttccacatggtatcaagcctgtgagtgcacataagtcaagaaccggggttttgtaacctccgcctagatttcaaaagatgtattgaagcacctggatgcccaggaagaagtttgctgtaggggtgggtccttcacggacaacctccactagggcagtgtggaagggaaatgtggggtcagagcccccacagagagcacctactagggcactgcctactggagctgtgagaagagggccaccgtcctccagaccccagaatgataagtccactgacagcttgaaccatgctcctagaaaagccacagacattcaatgacagcccatgaaggcagctgggagggagactgtaccctgcaaagccacagtggggagcttcacaagaccatgggaacccaccccttgcatcagcgtgacctggatgtgagacatggggtcaaaggagatcattttggagctttacgatttgactgctccactggattttggacttgcatagggatggtagcccctttgttttggccaatttctcccatttgtaatgaccgtctttacctattcctgtacccccattgtatctaggaagtaaataacttgcttttgattttacaggctcataggtggaaggaacttgccttgtctctgataagactttggattgtggacttttgaattaatgctgaaatgagttaagacttcaggggaatgttggcaaggcatgattggttttgaaatgtgaggacatgagatttg

SEQ ID NO: 12202 - DNA, 303523 bp, Homo sapiens
  misc_feature (1)...(303523): n = A,T,C or G, or insertion/deletion polymorphism (see Tables 1-2)
ttcttttttaccacatggtgtcgctgcaaattttccaaacttttatgttctgtcacttcttgaacactttgctgcttagaaatttcttctgtcagacaccctaatcatctctgtcaagttcaaagtttcacacatctctatggcaggggcaaaatgccactggtctctttgctaaagcatagtaagagtgattttgctccagtttccaataaattcctgatatggtttggctctgtgtctccacccaaatctcatcttgaattataataatccccatgtgttgtgggagggacccagtgggaggtaattgaatcatgggggcaggtttttcctgtgctgttgtggtgatagtgaataaatctcaagagatctgatggttttataaaggggagtttccctgcaggagctttcttttgtctgccaccacgtaagatgtccttttgctcttccttcgtcttctgccatgaatgacgcctcctgagctatgaggaattgtgagttcattaaacatctttactttataaattgcccagtctcaggtatgtctttattagcagcatgagaacagactaatatagttcctcatctccatctgagaccacttcaccctggacttcattgtccacatcactatcggcattttggtcaaaaccattcaacaaatctctaggaagttccaaactttcccatatcttcctgtcttcttctgagccctccaaactgctccaacctctgcctgttacctagtttcaaagtcacttccacattttcagtttgtctttatagcagtaccccactctactggtaccaatttactgtattattttgttttcacactgctacaaagatactaccctagattgggtaatttgtaaagaaaagagatttaattgactcacagttctgcatggctggggaggcctcagggaacttacaatcatggtggaggggaaagaaggcacctgcttcacaaggtggcaggagagagagagaatgaaggggtaagagccccttataaaaccatcagatctcatgagaactcactcactgtcatgagaacagcatgggggaaaccacctccatgatccagtgacctcctaccagatccctcccaagacacttggagattgtggggtttatgggttttaaaatttcagatgagatttgggtggggacacagagccaaaccatattgatacctatttacatatatataataataataagaaaatttacttttatttctggattattaattttttctttaaatcagaagagctgataaaatattatgaaatgatttccaatatctatcattatgtttcttaatgttcaaagattcttttatcatataacaaaacgtattggattattttgtttttcatttagcatttgtttagtattgagatagtttattgttcttttttgtatttaataaaatcagtcctacaaaatgaatttggaagtgctttgtctttttctttgctaagtttaataatagtttaaaataacagaaatagtaaactccttataggcccaatagaactatattagtgtagtccttttttggtggtagacttttggcaacgtttccaattctcttctatagttatttagtttattcaggtttcctgcaactttttgaatcaattttttttttttttttttttttttttttgagacagagtctcgcttcttcgcccaggctggagtgcaatgcaccatctcagctcactgcatcctctgcctcccgggtttgagcaattctcctgcctcagcctccccagtagctgggattacaggcatgtaccactacaccaggctaatttttgtatttttagtagagatggggtttcaccatgttgaccaggctggtctcgaactcctgacctcaagtgatccgcctgccttggcctcccaaagtgctgggattacaggtgtcagccactgtgcccggccttgaatcaatttttataacatattctagataataatgagaaaatgttaacattcagtatctataaagtatgcctacaaatcaataaaagatccacttaaaactaagcaagtgacaaatgtgcataattaatagaagaaaaattcaaatagccgtttgatgtgtgctttaaatctgttatatttagggtaaccatatatgcctatttccctggcagagtcctggtttacatgtatttgtccagtaaaattatgactagtatcactttttgtctcgaaaacttcctatttggggctgggcgctgtggcttacgtctgtaatcccagcactttgggaggccgaggcgagtggatcgcttgaggtcagaagttcgagaccagcctgactaacatggtgaaactccatctctactaaaaatataaaattagctgggcatagtagcgcatgcctgtaatcccagctactcgggaggctgaggcaggagaatcacttgatcccaggagacagaggtttcagtgagctgagatcacgccattattctccagcctgggcaacaagagcaaaactcatctcaaaaaacaaacgaacaaacaaacaaaaaaagaaaacttcctatttggacaatacattttaatgtctctttacttagaataaatgagatgcaagtttaaatgatagtagagattttattattattattaccaatcagattagcaaacattaaaaagatttatgatgtacattgctggaaagggtgtgttgagatggaagaatattggtgaaagtgttggtattctctttttatgttagaaatttggcaatatctattaaaattttaattgcacatatcatctgttctagctattggacttttggaatcttaactaatgggaatagtggtggcgtggtgcaaagacatgcattgacaaagttgttataatagtccaaaactggaaacaatttacatgtgtatcaataggctattgattaaataaataaagatgcacctatgaaatgaaatactatgtagatctttaaaacagtgagatgcagtaagatgcagaatggtattatggttttaactggtatttgcagaaacatgccatatatcatttatttttctatgcttagagaaaaaagcttgaatatatatacacacttaacacctatatcatgagggttagatgaacagaaatggaaacagaaaatttgataaaggttttgttaagtgttagggggaaaatagtttttggaaaaaaaaaaacagcttatttggcagtaataccagacactacgtatactggcaggaaacagaaaaatctggtttggtttggcaacaggtgtcaaagagtaatcttttagttttattaatgtttcttccagttggaagtgtgactttttttcctctgtcagaaaacttcatggctatataaaagatttttcagttctggagatatgggaaagctggaccacagcccatggagttattactttttatctttctgtaagaatatacagtgttagaattctaaggcagtaagggcctcaagtcccttcttgtcaatgctctcatttttttattttttttttagtgataaaaataaagttttacctatttcatccaggaatatatgctttgtatcttatacgtaatattccagagaaaaagaaagttacctatacctcttttttgaagaatagatattcttaatatccacaccattcaaagacaatgtaaaaacaaaacaaacaaaaccccaaaaaacaaacccccaaaacccaaaaccccaatattgtaggtcagtctcctacctgagtctgtatgaaaaaataaaaatattacaaaataaaatcaagcagttaattaaaaataacagactcaatgataaagaactcttcaagtccatcagaaaaactactcagtgtaaaagtggataaataggttcatgtgcaattcccaggaaataaaatgcaaatggagtaacaatcacataaaatattctcaagttcattatggccatgagaatgaaaattaattacaatacaaataatattcatttgtatcatattgatgacaattaaacatttttagaaagctaaacgtttgtgagaatgtgaagaaagaagattatccactgctaaaagtatgctggaaaaaaatttaggatatctggtaaaagtgtacatgctctaaaaccaagaaattctgtaatcaggtatgtgtccgagattttccaggctatgtgtatatcaatgttctcattttacaaataaagtaatcaaagcctagctctttttactattaatatatataaaactacttagaacttttaatatatattaaaagttaactattttaacttaaaagtatttattttaacttaaaataaatttttttatattaaaagttaactactttaactatttatatatataaaactacttagaagttttaatatatataaaactacttatatcctggtatatattaaggattatataataatatatagttatctatgatcatcctcatcctcatcatcaatagtcagttgtaggtgaaattctattaattaatactgacaaataacacattttaggtgctcatcattggctctccggaggagtattctaacagctgaattaaaaacctgccaatatttgaccagacgatcaagtttggaggacgtcccttcctctcccacccagagccacgctcttgcgtgcttccacagtgacagtgtgaccttttgaaatttggagatcatactctcatccttgaaaacgccccaccgccttccctggggcggccggcctccaggttcgcgttctacctggtagaatcccttgacagtttcagtacctggccgccagggctttgggtgttaatgccttccttggacgggaggcactggggagaagagagggaaggcgctgaaacccacctgagaaggcgggctgggggaaggcaccccgggaaagaggttttctcgggtgccagcacccggagagagctactctggggccaggcaagcatcccgcctaggctccctagtgcatattagtgagtaacacgactggcgcgcgaggtggtccattttatttttggtagctagacgccaataggacgcaccacttcagctccaaacgggaactggtggccccaagatgttttcttttctttttcatttttttgagacagggtctcgctctgtcgcccaggctggaatgcagtggagagatctcaactcatcgctaccccctccttctgggttcgagtgatcctcccacctcagcctcagtagctgggaccacagacacgcgccaccacgccggctaatttttatattttttgcagagaaagggtctcgctatgttgcctaggctggtctcgaactcctggcctcaagtgatccacccgcctcggcctcccaaagtgctggaattactggcgtgagccaccgcgcccggtctgcccccaagactttcattgaaaagatggaatggtcgcttctgtgcggatcctccaaaccatcgttgggagaggcctccttaaagtctaggagaaaagttgtttgggaccgatatgaaagtaaggcaaagccggatggaagagagtagccgaaacaagcaagaaaaggaaaagcgatcgtgatgggtttaggaaaggtgatctggcgtgctaaatggcatttccggagaaatctgaaaactattgctttactgaagtatagcaaagagctgtccgggctctggaaactccttaacggatcaaaacggatgcaatgggtatccttctccaaagacacacctcaaacgggccgggagccgggcagttagccacccgctgcctccccttccgcagtccggctcgcagccgctcagctacctctaaagcccggagcaggaaagtccgcgcaggcctggatggcccgggtggtaatctagcaggcctgcacactgcgcatgcgcagggggtggactgccaggtcggctcagggagccgtgacgagtccggaagcgcctgcgcgcgctcctccgtacgagaactagttttgttccgtgccctctggactggaaccttttggagagaacccccggcaggaccaaccccgcacccgccagcaccgcggcaatgtccagcaatagttttccttacaatgagcagtccggaggaggggaggcgacggagctgggtcaggaggcgacctcaaccatttccccctcgggggccttcggcctctttagcagcgatttgaagaagtgaggagaaaggtttgggttgcggggatgggagggaggagctgcggactcggaggagtgggcgccagggtgggcttcctggagaggagcggggtcgccctgaggtctgagcagggcagggcggtaacgtgtcccgcgggtgggtaggtggggttggttggcggtggtgggagttgtgggagtttggggcgaatgtgtgtaggggtctctagtagttttcaaactttagtgaaaaggaaaccacttggtgagcttagatcccacccstgaagacactgattgaattggacttgggctgggctcaggagtctgaattttgagcatcgtcttctagtttatttaccgttcgccggatcagactttaatacattccctgattagggtgaaaggagtgttttggtgaaggtgagagtgcgagtgttgcttgtgggaagttattttgtgaccccggagtgtaggagcagagaggtggatttaggctgtttgaatggacaaactggtttacaccagtattaatgttcttggattatgtcctttgcactacagacaaaaacaccaatccaaaataagcatatgaatagaaaatattttaaaagagtgttactgtgaacaaatccaaaacttttacagattaataatgtgaattttaaaaacgaatgttaaacaaggtacacttagttttgtaaaaagtatcaccgagaaatggaaagaaatcccaagttgtttgttttggggggtgggttggtggtagtggttacatttaccagaattatcatttttacatttctcttattttaaatctttcattactaagcaatagggtcacataatagtctgtcactaaattcatgctaaattaaggtagaatagctgtgctagtagctttgcagatctgttagagggtataattaaaatttaaattaaacgttactaacaatattgggtagtctagaaagtgctactacttcaaattgggattacattttggctgtattgaggatcaaaatcatatatatagcatgtaagatacaatcttttcctttttcccaaggttagaaaagtttaaaagtaaggtaactgatttcatttttcattatatgcatttgatgatccattgttctagaacaagtacggagcttgttgcctctactattagcaaaatgtttagactgaattaacctgtatatcggcatcaatctgtttygcaaattaatttacttttatggtttgtgaacatctacgatgttttctcttagatttttgtcagatttggggccaggcactgcggctcacgcctgtaatcccagcactttgggagggtgagktgggcggatcgcttgaggccaggagttcgagaccagcctggccaacatggtgaaaccccgtctctactaaaaatacaaaaattagccgggcgtggtggctcgtgcctgtaatcccagctactcgggaggctgaggcaggagaatcgcttgaacccgggaggcggaagctgcagtgagccgagatcgcgccacagcactcaaacgtgggcgacagagtgagactccgtctcaaaaaaagaaaaaaaagaaaaagatttttgtcaaatttggacctgatttggaaaaaaaaaacaaaaaaaaacttacggctttgactctgtgaccagtgctcttgaggtgacctaacaggttggatttaaaataaaagtagctaattgattagaggtgatatgtaatatatgcaaataaccatggttgaattgtgttccccgaaagatatttattgagtatttgtgcacaccactttacatttattatctcattcagttttcctaaacaaccctgcaggttattaccaggtacttctctgctcccactttacacgtgaggaaattggagcaaggttgttaacttggaaaaggccacaaaggtagaacattgcactgcctgaatttgaactcaggggctctaatattagagcccattctctcaaaagtttagatgtgctacttactacttgatgaaatgtatggtatttttattagtgagtgcatacaactcacaaaaagtttaaaactttaaatagtagctccaagtagtaccaccagagaagcttccagggattagaaacatttggctattgacctgcagtctaatggaattgtacagaaacaaggagacccctgtkctggaagtggtcattaaatctctcttgagtccacattttctcatttataaaaccgtaatattacttgccttttaaaaaatcgaatgacaaagtttatataaaaaacttaaagcttaccctattcctcacctctggtttttaatggtttactctgatgaaatagtttcargtttacaaaaaagttgcaacaatgacacagagagctacccttttgcagatttaccaattaaaaaaaaaatgctacattgcttgcttactctctctgccactcactctccccatgcatattcaggcacatrtacgtattcatgttattatgtcttctgaaccattggagactcagttgtacacatcatgttcttttacaatgaaaatcttaatgtgtaatttttaagaacaaagatattctcttacgcaactacagtgttgatgtattcaggaaattaatctaattttatcctttgttccaataaagtgttttttttcccaagcatttttttcctcaagtacagtttccagtccaagataatatatttaatttagttgccatgtctctttaatcttctttaatctgggatagttccttagccttttttgtctttcatgaatttgacatatctaaggattgcaaagcctattattttattttatgttaatcagtttttgggtttgctggtgtttcctcatgtttagattcaggttatgtatccttggctgggatactaccataggtgatgcatgcttcttgaactattacatttggaggcataggttgtccatcttcatgrtgttaattttcctagtcacagggttgtccagtttctctgtggtgtcatttctgttttttttttttttttttttcaaattatctgtggggagacactgagaccatgcagatgtcttgctcttttttaaatggaccacttctacatttaacaaccattgatcaatctcctgaacctgtcttttccacaatggctgcaaaatggtaatgtttcagctgcaactccctctgctgttctgctctttggcttcttggcctaragctctgtgttcactgatccttcactaaccatctcaatgatgcctaggtacttcctagtcatagtattatcggcaatttttgttttctgaatttaatcttatttatcaatattatttatcttctcctctcttcaaacagaagcagaattagatggctttatgaaagtagatcctatacctaatttattggctaaaaagkcctgtgtattagattattggcttcaagattttcaatttctttatttaaaatgtaaagaacttatttttgtactcttattttttattttttgagacatgtcttactctgttgcctaggctggagtgcagtggtgtgatcatggctcactgcagcctcaaccacctgggctcaagtgatccttcccacctcaggcttccgagtagctgggactacaggtgcatgctaccatgcccagctaatttttgtatttattgtagagatggggtcttgccatgttgcccaggctagtcttgaactcctaggctcaagcaatccgcctgcctcatcctcccaaggtgctggaattggaggcgtgyaccactgtgcttggccccttccttctttttaaaatattctcaacttttattttctgtttttttctaagttgtttttcttcatttaaaaaaaaacttcttttaaccaatttgggtatgtgtgcctataattaaaaataattttaataattctgttactggattaaacatttaattaggaattaatttctagaaacagacaagactaattaatttttcttaattacaatagtaaagctactaaatttgtaaatctcttttcctttgagagcatcttggtgtattagaaggaagactgaggctcggaatggtggccccttgcctgtaatcttagcattttgggaggcccaggcaggaggattgcttgaacccaggagttccagaccagcctgggcaacatagtgagaccttgtctctataaatgaaaatgggaagaaaaaacaaaaaacactgggcccagagtyagaagacctggatttaagttgatgttttccatttgtagtagtgcttccttgttcaagttgctgatctcttcaaacctcagtttcctcatttctagacgggatgtgataatacttgcctcttttgtgaggatctcatgagatggtgtacttcaaagtgatttctaaactaggatattaactaacsctatttgggaaagttggtgaagacttcactgaggtagtgacactttagatcttaaagcctgaggtttttgccagggggaggaaagatggattctttaggcagagtatgtagaaaccagaagatttgcaaaagaaaaagcatgttcaaatgagatggatatttagacatcacaattatgaatagtaggtagtaaagtatgggaatggatgaaatcacccagggaagacttttcttgttagacgagaaggcagtttggacaaaacccaggggacamcaggatataaagtatgaatggaagaactagaaaaagagactgagctcagaagggtgggaaaacacaggaaggtttaaaaaagaagatgctaacaggaaaattaaaagaaggaaatgttcagctatgtcaggagttgtagagtaagggcaaatagaatgaaggctgaaaagaggcccttgggtttaacaactgaaaggtgactttagcagccagtaacttagcaatgcagtacctcctgcacacgttgaaaggtagcatttttactctgtttaaatcggggtgggcttttcatttgtttagattcaaagagctaatttagatccaagcaaagtactgcatgctttcctgtagtcagtaatacaacccagtgtatttggattgcatcawtaaagcctgacttattttttaacttaaatcttattcattgtcaactttacaatatcaaacatgaaaattctattacattcattcttaacctttaatatcagtgattctcaggagagtccagtaggaagattacatgtgtctgtggtttgtacgcaattatagcaactctgactttatctccactactttttgtatctttctgaaaggcatatagaaatgcagctgagtgagattcatttacttagagggatgttattgaatatactttcttaaaaatacaattttattaatagtaacgcattatatttgacmtacctcaaagagtcattgtgtctcactatgggttctaaacttgtttgtgtttaagtccattttttattaatacttaattttatctagtgtctgtaccatatttttgggtgtttttttttttcatttaacattttttcatggtctagttgtttagagcttgctctactttctttttgcttatcctagtatttctcatttaaactttatctcattgtgtattttcagtttatgtagttgctcagtgaatatttcttaaatatttatatagataaatcgttcacacattctgctcatattaaagactrtgatttgtgtgaaggtgcctagcaaagtgtttggctcataattttgcttaataaaatattttcagatccttttactcaattcagtgatttagattccattaacatttgctctctcattagccaatgttgttaaaaaatgaagcatgactgattcygtggaccctatacagaaggaaaccctcatctggtatctccattgtattgtagtacagcatcaccctgaagctaattttgtgtagttcacttgggtctttgctgtggttaggattaactgactcggaattgtcatgtaggtatggaatgaactttacaatcaggatttttagtctttatcccagtcttcaaaggcatctttacctcccagtcttggattattccatatgtatggttcattcctctgtgttttcaccataaaaatgcataacaattatarggtctttatcttgtttttaagaaactcagactttatttggagagattaggctaatgtgaactaaccgtcagtaattcaagtatacaattagtgttaaattgtgtaattcaacttttcagtgtgacatacctattgaaaattatttgttataagcctttgtttgtgtaaacagtgatttactgaagaaaatggaaatgctggaattttgaaatgttaaggacattttagtttgagacgttgaagtgttggtgccctgagtcataagcatgacatgaagaggcacgggctccttcctcattgtgaattcctttctcttgtgctcaggagttcagggttgctgctatgaaaatatgcttcagacatgattttgtyagcatactgttatacatctgatcatctttagttatgaagatttaaatctcttgtgttctaataattccaggtttgataactgatctgtcttgtttattatgtttagctaattgaaatttatggtcattagatctggtactagagctgttaacatatttgcttgctacatatgtaaactggatcctactttttttttttttttttacaaggggtacattaagttattaggaaattttagtattttattgatttttcactaaatttcagcatttgttccaaggtgactaaaaataaaagaagaaactgtatactagcatctgcagtgcattcctagcagctgaactagttgtttttgtcttcataaaaataagatcgtaagttttacaaagggccaactattcaaattaaggattgtcatttcagtggtgcagtagggttccatttatgatttaattcttgaaatatatttcaaattaaataagattttactacattgaatagaaatttgatgaaatactgcctgtaaacagagtsttactttccaacagattataaaaccttttatcttattttgctttgcttgcatatctccttgaaggagagttggttctgacttctacattttgtcttaataaatattcaagaaaatattctttcttgacagtaggatatgttatttttaaaatcactgatctggtaaaatttgaggagaaaaatctgaaaattaaatttcaagccttaccattaaatcataagatgtgagattttatgttatttaaaaaaaatttagtatttggagcaacattaccagagctgaatgattaaagcacatgaaaaaggcagacagatggttggttgaaatgttcttttttgctgcatgaaaagttataaatgctcatagaatgacaaatgtattacagtgaaataatttgacagtattgcacttgtgtatataaatgaactactgacaaaaacaaattgcctgcagtccaaattcaaaatttaaaatgaagagcttaaagtagaataatcaagaaggaaatgattttcctctatttcatattattatgaataacgttggttcgtgtatttagagaaggcttatttagcctatcagctggaaagacttaatagatctacaaaagtgaacagtttatagccaatatctgtttattgatggactgattatttatattgctgataggaamcagcctaattagaagtccactgtctttaattcagctgagtgagttggcatggtagctggacaaatgagagaagaatgaataaggccctgtctcagtttgttttatgctgctataacaaaaaacctgagactgggtaatttctaaakaatataattttatttctcacatttttggaggccaggaagtccaagattgagtcacaggcaggtttagtttcctggtgagggctgctctttgcttctaagatggtccgttgttgccrcatcctctggaggggagtaatgctgtgtccttactgggcagaaggtggaagggcaagagaatggaagactgtgaagcctcttttgcaagggccttaatctcattcatgaarggaggagccctcatgactaaatcttaaaggccccacctcttaatgctatcatattggccattaagtttgaacatctgaattttggagaggacacattgaaaccatagtagggtggttccaaaatcataggttggcagagctaggcatcacccaactttattcttggaatgggttttctgcaagtttttaaagcctaggttgagaatgtggtcaagaaggatgtgggggaaattaattagtaaaatatgagggcagagagataaggggcagagtggaaggcggagacctgattgtgtagggccttgtaaagtcattgttaaggtctttgattttactctgagtgagaagggatgccatttggagagttttgagcagaggggtgaaatgattgtttaccctttaaagggacattttgcctcttgaactaggagtggactgcagatttgaggcaaggaccagcaaggagactattacagtaattcaggcaagagaaggtgatccgattggtggtagtggagagaagtgggtgagttatggatatatttgaaaggtagagccaatgagatttgctgatagtttggatgtgatatgtgtgtgggagaaaagatatcaagggtggatacaaagttttttgcctacacagctcgaagtttggaatagctgtcaactaaaatgaagaatattgtgcaaagaggaattttttttttaaagggggaaagggaccaagagcttgtgcatgttaagtttgagatgcgattaggcatccatgtggagatactaaataggcagttggatatcagagtgtggagcttagaggaggagtcaggctagaagtataaatttgggagtcatcaggtatcatgggattggatgagacactgaggaagtgagtgtagaaaaaggtcagagtcagtcagtcctgggacattcctggagtaattgtgtcaaataatacaaataggtcaagtaagatgattactgagaagggagttttggatttgtcactgggtggactttggtgaccgtgacaagcagtttaggtgcactggtggggctgaaagcctcatgagtgggctcaagagagaaggaagaagaagaattgtggttagtatttttttttttttttgagacagagtcttgctctgtcgcccaggctggagtgcagtggcgtgatctcgactcactgcaagctccgcctcccgggttcacgccattctcctgcctcagcctcccgagtagctgggactacaggcgccctccaccacgcccagctaattttttttgtatttttagtagagacggggtttcaccgtgttagccgggatggtctccatctcctgacctcatgatctgcccacctcggcctcccaaaatgctgggatttacaggcgtgggccaccgcgcctggccattagtatatttttaagtatagaagagcagagaaatggagcagcacttggagaggaatgttatgtcaaggaatttttccttaaggtaggagaaactgtattatcttgtttgctgatggaaccaactgatgtagaggagagaaaatagatgatgcattagagagaaggaaaattgctggagaattgctgatatcccctttttcttctagaaaacttacagatacaggttagctgaaaaataacaaccctaatttcaatatccagaagaaatcggttaatgtagtatatatcttttagccttttttcttttgcatatatatttatatgtatgtatgtgtatatcatgtgtttttagagcaaagctatatgcttttataatatgacattataatttgcttgtttcatttaccaatgcatggagcctgctcatttcttaaaatgatagtccttttaggacaaattgtagttaaattactatctattagctattaggaaagtaaacaactaaggtatacaaatgaggttatgtagctagctccactagaggatttaaatagtatcttatgtagaatggaccttattaattactacctacataaatagaataaccttgcaaaagaatgaatactaatgatgttagatagtagcactgatgaggactttccacacatacctgtgtataccaggcagacagaatagcrtatacctrggtttagagctgtaatgttcaatatagtagcaactagccaaatgtagctatttaaatttaatttaattaaatttaatttctccaccactctagtcacatttcatgtatgtgatgtagctagcagttactataatggataatgcagataagtgattatttctattatcacagaacattctattggatactgctggtttagaggcaaggatttatggcttacatagggaacaggaaacaattcagtgtggcgagagcacatagttaggaggaaatgagggactgactggtgaaagatggttaggaggtaatcagtctgtattatgaagagttttgcataccatgctcagaaattaggattttatcatgaaggtttgcacagtaaggagtgctaaagtataggagcaacataaaatgatttattttttaaaagatcaccttggctacaccagtgtttttggattggacaagtatgtgaatgatgctagaattctgtgatactggaaacacagatggatagagtaagtttggagtgaggagggtaagtgttgaggtccgttttggatctgctgaatttgaattgatagttaggcattcgttgagcagttagatagatagataaggtattcaggacagctacctgggctggtgatgtagatttgggagtcattaattgatgacattgtagttggagccattgagtggaaagtgtgtgtgcggcatgtgaagagaaggccagtgaggaatcttagtaaagtctacattgaagagagtaggagaattggaacttacttasaaaactaagaagggagaattcagtttggggaaaccatgaaagttgattgtacaagtttttgaattgtgtttaaggtataaggaaagggcgaaacttaattcctacttccgtaggaggaagacagccgataaatggtttattgtgtggtttgttgagacagtgtggtatgacggttagacacacccactctggaactattcctgggtgtcaaaatgtggcacagagttaataaatggtacttggacagattattttacaactctctgcccttggttttcttatgtgtaaaatggggatgaggatgataatgtacctacactcattgactagttgtgaggattaaaagatttaacatatgtaaatagtgcctggtacataataaacatagtaattatgattaccattataacaccattaaagtcatttaaagttttgttttcatttttcttttttggttttaagagacacaatctctttctgtgccccaggctggggtgcagtggccctatcatggcttactcctgggctctagtgatccttctgcctcagcctcctgagtagctgggactgcagacatgtatcaccatgcctagctatttttttttttttttttttggtagagacaagtcttactatgttgtccacgctggtcttgaactcctgggctcaagccgtcctcctgccttggcctcccaaagtgctaggagtacaggcatgagccaccatgcctggcctgttttatttttaatatgatgtactttttaagctattataattttagaattattgttaattttaayattaaccattgctttatgtttttaattttcaaattttcatcaaacttcagtttttctgaattatatttcacaagtgtttgaaacaactaaatatrtttacttttaatggcaaaaactgcagttacttttgcaccagcttaatacaaagtacctttaatgtgcaccacataaaaataaatgaaattaataagccctgattcttctgtgtgattatcaaggatttgggaacaatgattatagtacaaaggagtaaaaagtgtatttgttttaaacttttttttttttcaattttcagtcttcttttgtatcctatggctttgaagctgttcttgaagaagcagcctatttctcatttttcctaaaagaaggcaggcttatgtatgttttgctttaacagaaataaaaagaggaggggctaaatggtcagcagtgccagctgctggtgtggaatcaagcaaaatggtaaggcagtttggtgataaggcagttgttggtgaccttggtggtggtgacagcagtgtcaagggatgttgagtgtggaaatcgatggcagtccattggtggatgggtgagaagtgagtaaaagaagatcacttctccgaagaactttggctttcaggtagaggacgaaggatggttattgcagggagacatggagtctaacgagcttttttttcttttagagtagtttctcttttatttttaattatggtaaaatacacctgaataactttatcatcctaaccattttttcccctatttgacaaggtatcaagcaacttaaccattgttaagtgtgcagttcagtggcattaaatatagtcatattgttaggcaatcgttaccaccatccctctccagaactctttttatatgcaccactgaaactctgcacccattaaataaatccctattttctcctctctcctattcctacatacacacagagtcccatctattttgatactttgtatattacttaaataattttggatgatagtgactgcaaatgatttttttcttagcattcttagtattgtaaaacggtttttcattcatgtagcaaaactataaaaaaagtttcaatatagtttggtcaataggatatgtttatgtttcaaaaatgtaaaactacacatggaaataagttagtcagtcttttaaaaataaattataatgggataattaactatagatgagaactgttttttttttttttttttttttgaggcagagttttggtcttgttgcccaggctggagtgcagtggcacgatctyggctcactgcaatctctgcttcctaggttcaagcgattctcctgcctcagcttcttgagtggctgggattacaggyatgcaccaccatgcccggctaattttgtgcttttagtagagatasggttttgccgtattggtcaggatggtctcgagctgctgacctcaggtgatccacctgccttggcctcccraagtgctggaattacaggcgcgagccactgcgcccggccgagaattgtttttaagtgatagcatactttaaaataatcacataaaacttaagtgatttgcacttttagattctattcctgtcaagtacaaatttgtaggactttttttctgtttctggttctacatagccttcatcaggaaacttggtgggaccatgtgactttaaaaaattgtggtaaaaaacacataacrttaaatttactatcttaaccatttttgagtgtacaattcagtagtgttaactatattcacattgttgtgctacagatgtctagaactgtttcatctrcaatactgccctgtgactttttaaaaactaatttttttattgagatttccaagtgcatcagggacaaaggcagacattgcatattggtttcctgaattccctttacagaatgctgatccaaactcatcagatggaaaacttgccttctgtggccttggaaagttgttgttgttgtttttttaaagaatttaaaaattaatctagctttgagttggcatatcttattaacacagttgtagaaaacttatatttcstctactatagtttatgaatttcttggagaaaaatctaatactaatactcaaacttgatgcacaaacggattctttggcatgtttgtgtgtatgcccatctgttactgtggcaccatgcctattattactgtggcatgccaatagcagtgagccatgtgagccaacaaagatgaattgtttggacggaatacactattctgtaatactaattaattttgagctgatgaatctacatgagataatgttaaccaaatacagtcaaagtaatgtcagtgaaaataaaatttattttgacttatacagaagtgtatcacagatgttttagactaccattgagaataattagaatcagtgtttactatgattctagtgatcagttttcttttcatgaaaattttgagtttaaaagaaaagttcttcttgtgattatagattaagtagggagggggatgacactccaggttatggattttataccttttataaggtattactttatagttcttgaaatatattctttttttttttttttttgagacagagtctcaccctgtcgcccaggctggagtgcagtggcacgatctcggctcactgcagcctcaacctcctggtctgatcctcccacttcagcctcctgagtagctgggcccacaggtgtacaccaccatgcctggctaatatatatatatatatatatatatttatatatatatatttaagtcatatatatatatttaagtcatatatatatatatttaagtcctatatatatttaagtcctatatatatatayacacctatatatacatatataggacttaatatataatatatataaattttatataatatgttaaaaaatatatatttttcttttgtagagattaggtctccctatgttgcccaggctgttcttgaactcctgggctgaagcgatcytcctgcctccgcatcccaaagtcttgggattgcaggcatgagtcacagtgcccggccattgaaatatattcttaatatagtcagctttatagcagaaattgacagcgtagtatggtgaataggaagaaygttgaatttcaaaacaagattgaaatttaattccttgctttgccatccctggttttatgatgatatacataaaaggcatgtgattttagaatttctcacatgctatgtaatcttatgttacctttatatattctgagacttggtttactcatctattaaatgggaacaataatagctacacacgcttcatagagactttgtgatactaaaataagacagtgttataarcttcagaaaataawaccactaccacgtggctaaataagttaataatatgttataaacacgacatgttagcggtgagttagtcaatgatgtggaaaggatataacttccaatcccatatctcatamctcccattcatstgtaactacaaagaacaagttcttatgtatcctttcagaaattttttaaaaaaattaaacgatcatatatatactattctctatgtatcttgctttccacctggtatattttaaaagatctttccatatgttgatatgtctttccatatcaacatatgataccattttaatcttttaaaccagcaatcgccaaaccagcagtacccagggacctgtttcatggaagacagtttttccatggaagggggtgggggttggcttggggatgagactattccacctcagatcaggcattagattctcataaggagcgtgcagcctagatccctcgcatgcacagtttacaagagggtttgcactcctctgataatctaatgccgctactgatctgacaggaggcggagctcaggcagtaatactcctcatctgccacttgcctgctgtgtggcatcctggtttctaacaagccacagatgggtaatgttctgtggcctgggggttgaggacccctgttttaaaccactgtgtaatagttcctcataattaattagtccccccccccctttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagaattagtccccttttggaggggcatttgattgatttcacttttcatcacataaaaacaatatttcaacataagtttttgcatacctgtgtgaatttatctatttgtaggaaaaaagttttacaggaaatctcatagagccactgacatagtttagtttatatatggtgatgcataaaatttgtaacaggcaaaaagttccttttcactgtttaaaaacactgtaaaccaaaaatgccactttgtatagaagattaagattgggggagtctcagaagcaataaaaggaaacattaacaaatatactactgaatagtcacattctagaagacattcctaatctcctgagcaaaggtaaaacatacttcctgctgcctaccaagaggccaagtagctgagggcattgataaagatcatgaagatgtcctgtgatgtctgtatgacatcatggcttttaatacgcatatgaatgatatgaagacatggaagatatatgcttggtttttaacttttattgggatcatggatccttttgagactttacagtgaaagggttcttctgtgtctttctaagaaacaagtttagtatatagcctgctttcatttgttttttcaactaatgtttattgtgtatctgttatggaccggtaaggaatgtaacctgcttcagcctacctttagaggcccttcatagatcttcttttggattctttatagccaagcttgttcttgctctgttatcttgtatgatttctttggttgtctccttgtacttcgagacctcagatcacttatccgtggaggtcttttgtgatcacccagtyttactttattgcattccttattttaattgtttstgtactacttatctgatctttctttatgtttttgttcctccctgctttcttccttctctgccttgctctctccctctttacttccctcccttctcctttttttcctgtcattccccttaaactccctcccaccaattccttgtttgttaaaatttaggtcctagaatattcagggacttcaatacttagagcagcttctggcatataatggatgttgaataaataaatgtgctaggcccagtgataagtgctttatgattttattaagtcttcatgacaacctatttgaaatagacatsagcttttagttctgttgatttttctctattgtagttttgtttcatagaggctttgtgatactaaaataagatacaagcttcagaaaataataccaggtagctaaataagttaataatatactataaatgcaaaacatgttagtctgttttattaaattcttcttgtatctttattattttattacttgtactttgagttcaatttgctgttttttttttcctagcattctgagatggaaacttagatcattgatttttaatctttctgattttgtattgtaattagaaatataaatttgcttctttttttttttttagggacagggtcttgctctgtcactcatgttgaagtgaaatggtgcgatcttggctcactgccgcctcagcttcccagactcaagtggtcctcctaccwcagcctcctgagtagctgggactaaaggtgcatgccaccatgcctgactaattttttggtttttttgtggtgaaagggtcttgccgtgttgcccaggctggtcttgaactcctgggctcaagcaatcctcccacctcagcctcttgagtaactagkactgtaggtgtatgccaccaagtccaactaatttttggattttttgtggagatagtgtctttgttatgttgcctaggctggtcttgaactgctgagctcaagtgatcctcctgccttggtctaccaaaatgctgggattacaggcatgagtcacctcccccagcctaaatttgcttctaaatattgctttagctgcatcccacaagttatgaaatgttgcactttgtcaaatcacaaagtatgttgcaggctggcatggtggctcacacttgcaatcctagcatttttggagactgaggtgggaggattgcttgagttcaaaagttcaagatcagcctggacaacatagggagaccctatctctacaaaaaataaaaaaacattagccaggcaaggtagcacatgcctgtagccccagctacttgggaggctgaggtgggaggatctcatgagcttaggagtttgaggctgcagtgagctgtgatcatactactgcactccagcctgggcaatagagcaagaccctatctcaaaaaaaaaaaattaccattatgtgagcactttttagtttttattttattttttaagtattggtttctatttagattccacataccctgattcttatacctttcaaatttgttgaaaccttatatagtctattttggtaaatgtcctatgtacaattgaaaagaatgtttattctgcagttgttggatatattgttctatgcttgtaagtttaagttgtttaattatgttgttcgaattttttacacctttattgaatttttcgtttcctggttctgccagttactgagaggtgtgttaaaattgccaatcatggccgggggcagtggctcatgcctgttatccagtactttgggaggccgaggtgggtggatcacgaggtcaggagatcgagaccatcttagccaacatggtgaaaactgtccctactaaaatacaaaaaattagctgggtgtggtggcgcgtgcctataatcccagctacttgggaggctgaggcagggaaattgcttgaacccgggaggcggaggttgcagtgagctgagattgcgccactgcactccaacctggtgacagagcaagactgtcccccaaaaaaaaaaattgcctatcatgattatggatgtgtgtttttcttccatgagtctgtcagcatttgctttacacatggaaactgtaaatttagaatctgtataaattgcatataaatgtaaaattattttccttttgaaatgataccctatgtccaggcagcagatcttcagcttttatttgtttgaaaaccactttatttcacctttagtgaaataaagaatatttttaatatcctgggtatggaattctatgttggcattcttttctctttcagccctttaaatatgtcattccgatatcttttggcctttataatgtctgttgaaatgttattccttttaaggtagggaccagcaaaccacccatctgtttatgtacataaagttttattagaacacaaccatgcccatttgtttttgtattatctatagatgctttcattgtgcaatagcagagttgactagttacatcagagatggtatggctggtaaaacttaaaatatttactttctggccctttacgtttgttgactcctgtctcaaggtaattttctggatgcctttttttttaaaaaaagatagggtctcacccaggctgagtgcagtggtgtaatcatagctcactgcagccttgaactcctgggctcaaacaatcctcttgcgtcagccttctgagtagctaggattataggtgcacactatcatgcccagctaattttttaaaaatattttttgtagagactgggcctcactatgttgtgcccaggctggtcttgaactcctggccgtaagcaatcctcttgcattggcctcccaaagtgcttgattataggcatgattcaccatgctcagcctctggatgcttttaagatttttctcattgtttcttgttttcagcagtttgactatgctstacctggtgtagttttatgtttgtcctttttttctaagatttttaaatatgtgggtttatgtttttcataggttcagaacaattcttaaccattatctcttcaaatactgcttttgtttcatactctcttttctctttggaactctaattagaggtatgttagaaattttacctttatctcatatgcctctgatgctctgttctattttttccattcttttatttctctgtgcttcaatttgtatattttctcttgacctgccttcaagttcgataatcctttttttctcccatttccagtctgccattaaacctatctaatgagttcttaatttcatatactatacttttcagttctgaatgtccatttggttgttttgtatggattctactaattgttgatttctgtgttgtttcatctgttttgtccatctcttctacattttcctgaccatgttaattgtaattattttaaaatccctgtgtgataactctggtatctgagtcactcatggatctgctcctggttttttttttttttttttcctttttttcttttttgggcgggggtaatttcatcctgtttttagtatgtctcgtaagttttgatcagatgctaggtatttaggataaaaatgattgatgaagctttgggwgatagcttcttccatacagggctgggtttttgtttttgtttttttttccagccaagcaaatagaatgtaagcagatcattctgatcttgtcaaagctcagttttagactttttaaggtcttgtttatggaactttttcttatactcctcgggcatcttccttagcactctgtgtggctcttcagtaatcttaatggaaagtccagggcattcaccaaagcctctcttctgaggacagacttgacagctgctgttttttgttgtgtttcctggagtcttgccttaggaattgcagccaacattttgcacacagatttttgtgtaccttgtctctggttccctcctctgtaattttgtccttcaagtctcagtcaytgtggcagccctggaattcaacatttgtctcctcaagttattaagactgtgacttctccttgggttctgttctcccacatggcaatttgggaaatgtactgagggaaaaagctggtgtgaatgaggagctctttttttcccttgagagagataggttcttactctgtcacccaggccacagtgcagtggcatcatcatggttcattgcagtcttaccctcttgtgctcaagattctcccaccgtgtctctgagcagctgggattacaggcgcatgtcaccacacctggctactttttgtatttttagtaaagatggagtctcaccatgttgcccaggctggtctcaaactcctgaggtcaagctatccactagcctcggcctcccaaactgctgggattatattaataggtgtgagccactgtcctggcctaggggctcactttttgtgcttctcttctttcaaggatcatggccccttaagagtacttgtgtgtgtgtatatgtatatgcatacatatatgtgtgtatatgtawgtatttcagcttttatagttattttctatggcaggtttagttttttgtaagctacagtgtcatggacagatatggaagtccctacagtatattctgaatgtagcagccagaatgatcctgttaaatagatcatgactctcctgtgttcaaaacctgcagttctttatttattcagagttaacaccaaaaacttttagagttatttgacctgcttatcctccctgtccccctttgctccccatgatatctgcataactaactctcttatttgaaaatctttgttcagatgtcacttttaaaatttactcaaactgtgctattaaaattgcctccttctttcctttctgtatccttttcctctgtttttttcccccatatcaccttacgacttaaaaatgtcttatttattatgtttgttgtttcttttacttaatagaatgaaatccctatgagggcaagggtttttcctatcacttttgttcattgctgtgtcacagatgcgaatggagaaccagatgagaatagagcttcagaatctaaaggaggagggaatttcaagatggaagagtaatggtcatatgtatcagatgtcaacagaaagagccaaactttgtaaaataattgaagaggtttattctgagccacatatgagtgaccatgacctcaagagatcctgagaacctgtgcccaaggtggttgggttacaacttgattttatatttttaaggagcgtaagacatcagttagtacatgtgaggtatacattggctcagttgggaaaggcatgacagcttgaagcagggggcttacaggttacaggtggatttaaagattttctgattggcaattacttgaaagagttaagttgttattgaaaaacctgggatcaagagaaaggtgtggctgggttaggataaagggctgtagaaaccaagattcttatgaagtctcttaggtggctgcctttagagacaatagatggcaaatgtttcctattcaaatctttaaaagtgctggactctcagttaatctctttagaattgttagagcctggaaggggaaactctgtagagatcctttacagatgcagattttcttccacaaaaggctgctttgcagggccggttcaaaaatatggcaaagaagcatattttggggtaaaatattttgattgccttctttatatgtcatgtgacgttatgctatagtcaggttggaaagtaagccacgttacgtagggttaaattaaaatccatctgatgagaatttatggtttgtagggcaggactcctcaggccccttaggaatttgggcaagagagaraaaagtcagagtttagtcctcacaagtacagaggaataatctgaaactattcatgagattttaccttggatttttaaattaagacgttgtttgttaccctgtgtgagagacattttaaattaaaggtaaatgagattaccaagagttgaggaagggtctgtaggcttttttctttttaatcttgtgaacagtataggaggaatattcatatttatttggataatttatgattctgacttttagaaagtttgtttgttttttgttttttgagatggagtttcactcttgttgcccaggctggagtgcaatggtgccatctcggctcactgcaacctccacctcccagattcaagcaattatcctgcctcagcctcctgaatagctgggattacaggcatgtgccaccatgccaggctaattttgtatttttagtagagatggggtttcttcgtgttggtcaggctggtctcaaactcccgacctcaggtgatcctctcgcctcagcctcccaaagtgctgggattacaggcttgagccactgtgccctgcctagaaagttaatagatgggtgagcaggtaaagacactagcaatggagttttttgtttctattcactgttgcatttattaagtggaggctttgtgccaaaagttttycccctatattacctcatgacttaaaaatttcttacttattatgtttgttgtttcttttacttaatagaatgaaatccctatgagggcaagggtttttctgtcatttttgttcattgctrtgtcacaaatgcgaatggagaaccagatgagaatagagctacagaatcaaaaggaggagggaatttcaagatgaaagagtagtggtcatgggtatcagatgtcaacagaaagagccaaagttctgagcactctgcaagggaagcttagatcctaagtgaactgaaaatgttcctaagccttaatgttttgcacaaaaacattattattatgagggccactccctttggctacatagcactgggaaatggtaagttctgactctgtttccagcgttttttctgcatatccattcatatttgcagcgcaccacttggatagtagcatcttttattggagtggttctctatgcctaaagaggtgcctgtgttttggaattttttggtagggctccataaaggtccarccttcmcttcgttgaatatttttatacatccttttttgggcatgtatctctgattggaaattgctattccttatcacttttccagtccatgatttcctggatgtaagttttaggtgttgctttctatggtatataaattttggtgtaccataattttgaggaaaaagaaggtaactttgtagtgtggggctctcaaatggtaaaagtcctttcttttttctttttaaaatttccagtccaatattgatggatacttctacaaaatacaataaaaaataaattactagaaaaataaaatgggccaggcgtggtggctcatttctgtaatcatagcactttgggaggccgaggttggtggatcacctgaggtcaggagttcgagaccagcctggccaacatgatgaaaccccatctctacttaaaatacaaaattagctgggtgtggtgatgcactcctgtaatcccagctactcaggaggctgaggcaggagaatcacttgaatccaggaggcggaggttgcgtgagcsgagatcacactactgcattccagcctgggtgacagagtgagactctgtctcaaaagaaagaacaaacaaacaaaaacataataaaattaaagaaaaataaaatgaaaaaggcacacaaaataaaatacaagccccactttttaaattagactcaataaacataaaattacattgtcaaattgttccgtcacggttctcaatgtgcttattctgaattttggtacctatctcctcatgggttggtaacaaaaatttgtgaattagtcatgattcttggaccagactttctcagatcatactttaagtagcactgatatagtgtacagtactacatagtcttaattttccccttaatttatgttgtctttagaaggagtagaaggttttaatgagttatggattatagattgattaaaaagagaggtaatttacactacataatagccctaacacatccctagttcttatatataactggtaaactttatttttcagttatagttactagttcattctggggctaaaataagaatgactttcctggtaatagtaagatttgccttaaatgttcagttatatattcttctctgtcctttgaaacttaaaactggcctattttgaacatgaaaggaaaagttataccatttaacaccacaagatgtcacttatgtaaaaataaagttggtatcctaatactcaaagctagaaagctacaggtaactaggtaaatgaagacacaggtaaattaaaaatgaatatatttgaaacaactattgttttcagcaaagagttgaggaaaatattgctaattcagcattattttgactcaaatattgatatttarcaaaatagtatctaagatttatgcagtaatacatgttaactgatcatatttgaatctacgtaatgaagaaggtagacctaaaagaacttaataaaagttaatgtattttgagggtaaagtaggtgttatggtattaactttcctaaatctttactgttttggtgacaggcaaagargaatttgggaagaaacatgtaatttatatcagaattttaaatagatccttatgacatacgtgagaagctgcatattacatcaggttgaaacagtgcctaggatttttcttgtctcttccctgaacctcagaattattagtttctcttcctatattaatgcagtatttgttgttgaagactagcttttctgttaaccatgaagagcaaaacctttayctttaatattgagattctgttttcttgtttttagtttcagagagcaggtgcttgttctgggcactctgggaatttgggctttagatgagcaaaccaagtttccattagtttacgagtaagactatgcctggaattagaggttgggctgttctaaaaattgacacttcattcctcttcattgctcacttctctctccagataaaactggtagaggagaataatgggacactttggggaacagaaaaggggaacaagcaggagaaaattgttttcttttttggcatgtgtgtatgtgtgaccacatttcctttctatttagttcctatcgaattctttttttttcttacctaacttcagtaagatttttttaaggtttcttttagggtttaggtttttcattataaaagtatacatagtcattaagtaaataggaaaatacagcaaaaagtagaagaacaaaatacagttacatatatagttccattaatttctctcccttttctgttacctgtgaaatctgaaagagcctgaaaagttttatgcagggatcctaaattccttaaggtgaacatttatagtatgtgtagtagttgtatgttctcagagacagtttttatttattactacctctactgtttaaatattttcaagctgtatttttaattaggaagaagtaggtgttttaattatttaattgtattttgtcttctctactggtcaccattgcatttaattttatgagctgtttggaaagtaaggctcatttttttcataataaatttcattgcatttattccttttgaaaaaaatgtgcttagcttttacttatttttttcttgcaatgacagtttgtaacatttaacccttgtattagtttgctagagctgccataacaaaatgccacagactgggtggcttaatcagcagaaattaattttttcacaattaatgcctgggagtacaagatcaaggtgttggcgggtttggtttctgctgaggcctttctctctggcctgcagatggccaccttcttgctgcagttatttaacattgcccatgatattacttctaattcttatgaaaatgatatattttaagctatctaatataaaaatcaaagtatggattttttttcttctcttttgtaataggaatgaagatctaaagcaaatgttagagagcaacaaagattctgctaaactggatgctatgaagcggattgttggggtaggtaaaatactcatttacttcaattttggaaaaatggacaagcagtgatcatattattatatatatatataaaaataygttaaataccaagtctaatattctgtttgcccttaatattaacttagaatttcctgtccaaaaatgttaaagaaaaaagtacattaytgaagtgtcaaaaatcaagaaacttaggttttaattttatcttttctctgttttaatttccctgtatctaatttcaaggtatttctactatgagaatgaggtagttagtcattttgaagacaaaataagatgatatacaagctattttgacttcctacacagagggatactaaagaatgattttttttgtcctttcacagcctaaatgttctgagcatactttcatctgttttttaaattctcttactaccaatagaaacactttattcastttagaagcctagaacttctaataaatattattaaatataagagcattcaccagtgttcagctgtaaagcaaaacataaacaattgattaataagttatgaggattctattgccagagaattaaagatataatatagttccttaattatttttaatgttttaattttaattttttatttttccagggttctagttgtatataccatctttagtaaaatagttttgcaatttatgttgcactctctgtacgtactcatttgattttccacattcacagagaaaaaacttgcttaattccactgactatctgatgctcaggagttttgcttttgtttcactggaatcaaattcataaaactgatttttcttattaacactatcctttttatcaccaccattgctgattctattttccacttaattttatataataaggtcaaaattgaatacatttgcataattgcttaaataaactactgtaataaggcgatgacacaactaaaacaatactgttttccagcaggcagtgccatcgtatgagagcttcagatctcttttcctttcttgatatattaaagtccaaataacaggtatcagcatgctctgttaaaaagtgaggtggtatgaaaatcaaatatattaaagtcaagtwctaattgtatctgtaggacatctgtaagtgacttgatccttgctttcatgtttatgtcatttggcagtatrggggcaattttgaggattccattgtaaatttttgatttgttaatgttatgctctatacataggagtatttatgggcaggcagttcttgctttgcatggcttttatacatatgaatttcagttactacagtttagttaagtgacaccaatcccctaacaatatggttcaaatttcatttaccatggtgtattaattgtgtacttggataatgtacaaacttgactgctagctcttcattctacaaataacttgtaaattacaaacatgtatcatgatccatgatcaatcatgtcacttctttcaaaatctgtcagtgattggtcactgtgcatctgttactcagtttatgcacagacaacaaagcatgtagttgtgttgcctctttgtctcccagtaagaaacacatgtgacattttacagaaatgaataattgaaagaggcatttgcccaacaaagtgaaaatacagcaaagaaatgaaaagtgataacatgtaatgaaaatcaggtagaatataaatgaagttatacagaagtagctggctgtggaactactgacattacacgtttttaagagactgaatttatagctggaggaacttggtaaggtgagattttcaaccaacataaatgatgaaagtgattttgttgaagagcatgaagctgtctcagaggaagtgatgctgtcagaagacctcacattcattaaaggaactctaggagatagttgagaacattgaaaatgcaaagggtaaaatgttggaagctgatccagacttagaaaggagcatgataatttactgaggaatacgaaagattcttcctcagtatcatgagttaaacactgataagagaacaagttctgttcaaaccactcttgataagttcattttctttgcctttttttttgtttttttagagacagggtcttgctctgttgtccaggctggagtacagttgtgcagttgtaacacattgcagctttgaactcctgagcccaagcgatcctcccacctcagccttctgagtagcagggactacagatgtgtaccactatgcccagctaatttttttatttttattttttgtagagacagggtcttgctatattgcccaggctggtgtagaactcttggttttacttgatcttcccacctcagcctttcaaagtgctgggattataggtgtgagccaatgtgcctggccaagttaattttcaatttttccaacgttttaagttatagtatactaaatattgatttttattattttttcactttcctataaatttataactgacagtaaaagagttattaatgctttgacagaaattttaaatagtatccagggatttagtgaaataaattaccttaatgggatgtaagagccatagtttaaagaaataaataagggcagtccctactttgcatggtagtgcaggtctatgccctgcaggaatgcaagcagaaaccatggaaagaaattttaataagccaactggaaaaattacaattgatctatgatgcttaaaatttttgtcaaaacaggaraattagctgagtcaggtggtatactgttttgagttaatgactgtaataaatagttttgtataaatctttccagacggactgtttatcccttgttctttccctttcttccttcaataacaatgctttggttctatgtatgctttaaaggattcaacttggggctgttgcttgcatcttttaaaaaattattgggttggaaattgtttaaaagaccaagatttttctgcagtattagtgtgcatcaggatgaattcctggttatcaggcctgaggttttactggtgatgtgacacctatagaactttagtgggttttctatcagctttgctccaatgtagtctctggaatacaaaataagggtcagttaactttctgtatctccatttattcttgactgttgattcttaagagttactgttgggtctgaaaccctttgaaaccttttctctctgtttttgttacctgtgaattaactagcagttttctgtaaattcaaaattctgaacttttatctcatctttattgctttgaagaatgaccagtggaaattaaaaattaaacataatttcatcctttttcaaaaaactgggtttaaaaattatgtgaatttttggatctagattattattcaatacagtcatgcatcacttagagtcatgcatcgctgaatgacagggatgctttctgagaaatgcatccttaggcagtttgttggtgtgaacctcatagagtacttacacaacctagtatacttacacaagcttactacacacttaggctatatggcatagtctattcttcctaggctataaatctgtacagcatgttactgtactgaatactgtaggcagttgtaacacaatggtaagtatttgtgtatctaaacgtatctaaacatagaaagttacagtaaagatacagtattataatcttacaataagattatatatgtggtccctccttgaccaaaacrtggcacgactgtaatttaaaaataacacaaaattcagtcattgtaatataccacattaacagaaggaaagggaaaaatccctcacaatcatctcaatttattcggagaaagatttgacaaaatttaatacactttgatgataaaagtactcaacaaactaggaataggaggaaactacctcaacctatctgttaaagagcaggtgtggaaaacccaaaactagcatcacactcagtagtgaaagactgaaatcttttactccaaggtcagaaacaaggatgcttgcttttaccacttctgtgcaacacagtattggaaattttagccagaacaatcatgcaagaaaaagaaataaaagacatccaaatggaaaaggaagaagtaaaattatttttattcacatcatcttatatgtagaaaaccctaaagattccacaaaaaactgttagaaccaatacgcaagtttaccaaagttgcaggatagaaaagcaacacaccaaaatgacttgcatttctacacattaacaatgaacaatttgaaaataaaattaaacaaatattcatttataatagcatcaaaaagaataaaatattcaggaataagcttaaccaaggagatgaaagacttgtacactgaaacattactgagaaaaattaaagaagacacaaataaatggaaagacatctatgtttctgggttggaagactaatattgttaagatgtcaaaatgatctgtatattcaatgcaattcctatcaaaatgccaatgatgtgcatggcaaaaatagaaaaaaattcatcctaaaatttatatagaatcccatgagtccctgaatagccaaaacaaccttgaaaaagagcaaaattggctgggcacagtggctcacgcttgtaatcccagcactttgggaagctgaggcaggaggatcatttgagcccaggagttttagaccagcctagactacatggcaagaccttgtctccacaaaactaataataagaaaaaaattactacctgtgcctgtggtcccagctgcttgggaggctgaggttgtggtatcgcttggagtgagctgtgttcatgccactgcactccagcctgggcaacagagcgagaccccatctcaaaaccctgtctcaaaaaaaaaaaaaagaacaaaattgaatgtctcatacttcctgatttcaaaacctatgacaaagcatagtagtgaagacattgtggtactggaataaagacggacaacgtatagaccaatggaacacaatagggagctcagaaatcaaccctgacgtaaatggtcaaatgatttttggtaatggtgccagatcaatcaattgggaaaggacagtcttttcaacaaataatgttggggaaactggattatatatatatgcaagaaaatggtgttggatttctttctgtatcacaccataaataaaaataaaccaaaatggatcaaagacctaaatgtaagagctaaaactataaaactcttagaagaaagcatagagaaaaagcttcatgacattggatttggcataggattcttagatacaacactaaaacaagaacagtaaaaaaaaagtagattatttggattttatcaaaattaaaacttgtgtgcatcataggactctgtcaacaaagtgaaaaggcaacccatagaatacaagaaaatatttgcaaatcatatatctgataaaggattgatatccagaatatataaagaactcccacaactcaaccattaaaaacctaccaaatggctgggtgtggtggctcacgcctgtaatcccagcactttgggaggtcgaggtgggcggattacttgaggtcaggagtttgagacaagcctggccaacacggtggtctctactaaaaagacaaatctcgtctctactaaaaatacaaaaattagccaggtgtggtggtgggtgcctgtaatcccagctgctcgggaggctgaggcaggagaattgcttgaacccaggaggcagaggttgcagcgagccaagatcaygccactgcactccagcttgggtggcagagtgagaccgcgtctcaaaaaacaacaacaaccggtggctcatgcctgtaatcccagcactttgggaggccgaggtgggcagatcacgtgaggtcaggagttcgagaccagcctggtcaacacagtgaaacctcgtctcttctaaaaatacaaaaattagccaggcgtggtggcgggcgcctgtaatcccagctacttgagagactgaggaaggagaattgcttgaacccgaaaggcagagattgcagtgagccgaggtcgtgccattgcactgcagcctgggtgacaagagtgaaactctgtctcaaaaacaaaacaaaacaacaacaacaaaaaccgaccaaatgaaaaaatgggtagaagactggaatagacatttctccagagaagatatatagatggcaaataattacagagaaagatgtgcagcatcactaattattaggaaaatggaaatcaaaaccatagtaagatcactttacaccattaggatggttattatcaagaaaacaaaattgtaagtgttggtgagggtagagaaataagaactcttatgcattgctggtgggaatgtaaaatggtacagttactgtggaaaacagtatggtggttccttaaaaaactaaaaatggaattatcacataatccaccattctccttttgggtatatacagacaacagttgaaaggagatacttgaacagatatttctacatcagtgttcgtagcagcattatttatagaagccaataggtggaaacaacccatgtgctcatcagtggatgaataaacgaatgtggtacatctgtgcaatggaatgttattcagctttaagaaggaatggaattctgatgcatgctacaacatggatgaaccttacttaagtcattatgctgagtcaaataagccagacacacacacacaaaaaattgtatgattccacttttatcaggtacctagaataatcaaactcatagagacaaaaagtggaatggtggttgccagcagctagggggaaagcgagaaattgggagcttgtctttcaaaaatcattttggacatttattttaaatattatgaaccctattaaaaatagttgtgtaggcatgagcgctgtcccactcattatgctttcacttttttttttaaacttacattcctcctcattctttttttattttctattttttatttttgagatggagtctygctccgtggcccaggctggagtgcagtggtgtgatctcagctcactgcaacctccgccttctgggttcaagcaattcttctgcctcagcctcccaagtagctgggattacaggcatgtgtcaccatgccccgctaatttttgtacttttagtcgagacgggggtttcatcatgctagtcttgaactcctgacctctggtgatctgacctctggtgatctgccctcctcggcctcccaaagtgatggaaatacaggcatgagccaccacgcccggcccctcctcattctttagagttttggtttattttcaggtgatgggggcatttcatttaggaagagaatgtagatggcattctttcaaagtccttgcctgtcggaacaggtttctatttttttttccatgggaaaatagattacttaagaatagtattgttgggttgcaatgttttcttttccttagatttttgtagatttcattcttgattttgtctggctttagctgtacagagcagaaatgtgatgtgatgacaatgagattgcttttttaaaaaacatttaatttttatttcttttaattttattattaatttttttttgttttttgtttttttgagatggagtcttgctctgttgcccaggctggagtgcaatggcacaatctcagttcactgcaacctctgcctcccgggtccaagtgatcctcctgcctcagcctcctgaatagctgggattacaggcgcccaccaccacacccagccaatttatttgtatttttagtagagttggggtttcaccattttggccaggctggtctccaactcctaccgtcaagtaatccgcccaccttggcctcccaaagtgctgggattacaggcgtgagccactgcacccggccatatatatgtatttttaattttagtgggcacatagtaggtgtatgtattttgggggtacatgagatgttttaatacaggtgtgcatgtgaaataagcacatcatggggaatgggatatccatctccttatacctttttccttctgagttacaaacaattcaattacactctttaagttattttaaaatgtacaattacattattgttgattgtggtcaccctattttcctgtcaaatagaaggtcttattcattcattctgttatgtttgtacccattaaccactccacctcccctgtatcccccacttcccttctcagcctctggtaaccatccttctactctctatgtccataagttcagttgttttgatttttagaccccacaagtaagtgagaacatgaaatgtttgtctttctttctttcttttttttttttttgagatggagtcttgctctgtcaccagtctggagtgcagtggcacgatctcagctcactgcaagctccacctcctgggttcacaccattctcctgcctcagcctcccaagtagctgggactacaggcacctgccatcatgcctggctaatttttttgtatttttttgtatttttaatagagatggggtttcaccgtgttagycaggatggtctcgatctcctgatctcatgatccgtccgccttggcctctcaaagtgctgggattacaggcatgagccaccgtgcccggccagatgtttgtctttctgtgcctggtttatttcacttaacaagatcttcatttccacccatgttgttgcaaatgactggatcccattgttttttatgactgaatagtactccattgtgtatttgccccacattttctttatccatttgtctgttggtggacacttaggttgcttccaaatcttagcttttggcaacagtgctgcagcgagcattggagtgcggatgtctctttgcactcctgattttctttcttttgggttgtacccagcagtgggattgctgggtcatgtggtagctcaattactagtttctttttgaggaacctctaaactgttttccatagtggttgtactaatttatattcccaccaacagtgtgcaggggttcccttttctccacatcctcaccagcatttgttgttgcctgtctttcttttgrgtataagccattttaactggggtgagatgataactcattatagtttagatttgcatttctttgatgatcagtgatgttcagcatcttttaatatgcctgtttgccaattgcatgtcttcttttgagtaacgtcttttcaaatcttttgccccctttttatcatttgatcaaatcttgcccatttttagattattagactttttcctatagaattgtttgagttcctgatatattctggttttaaatctcttgtgagatggatagtttgcaaatattttctcccattctatgagttgtctcttcactttgttgatcgtgtcctttgctgtgtagaagctttttaacttgatgtgatccgatttgtctgtttgtgctttggttgcctgtgcttgtggggtattactcaagaaatctttgcccagaccaatgtcctggagattttccccaatgttttgttgtagtagtttcatggttggaggtcttagatttaagtctttaatccattttgattttatatttgtatatgctgagagataggkatctaattttgttttcctgcatatggatatccagttttcctagcaccatttattagagactgtcttttcctcagtgtatgctcttcgcatctttctcagttctctgtaggtgtgtggatttgtttctgggttctctattctgttccattcctctgtgtgtctgtttttatgccagtacatgctgtttggttactatagctttgtagtataatttgaagtcaggtaatgtgattcctccagttttgttctttttgcttaatataactttggctattctggatcttttgtggttccatataaattttaggatttctttttctatttctatgaagaatgtctttggtattttgataggcattgcattgaatctgtagattgttttgggtagtagggacattttaacaatattgagccttccaggccatgaacacagaatatttttccattttttggtgtccttttcaatttccttcttcagtgttttatagttttcactatagagatagttcacttctttggttaagttwattcctgggtatttaattttgtgtgtggctagtgtaaatgggattacttttaaaatttctttttcaccttgttcactgttggcatatagaaatgctcctgattttggtatgttgattttgtatcctgcaactttacttaatttgtttatcagttctaatagttttgtggtggagtctttaggttttccccaatataagattgtatcatctgcaaacaaggatactttaatttcttcctttccagttggagaccctttatgtctttctcttgtctgattgctctagctaggacttccagtggtatgttgaataacagagatgacagtgggcaaccttgtcgtgttccagagcttataggaaagactttcagttttttcccattcagwatgatactagctgtgaggtttgtcatatatagtttttattatgttgatgtatgttccttctattcccagttttttgagggtttttatcatgaaaggatgttggattttatcaaacggttcttcagcatcaattgaaatgatcatatggtttttattgcccattttgttgacatgatgtatcacattgattgatttgtgtatgttgaagcatccttgcatcccagggataaatcccacttggtcatgatgagtgatctttctgatgtattgttgaactcagctttctagcattttgttgaggatttttgcatcaatattcattagagatattggggtgtcattttctttttccttgatgtgtctttgtctggttttggtatcagggtaatactggccttgtagaatgagtttggaagtattccctgctctgtttttcagaacagtttgagtaggattgatattaattcttctttaaatgtttggtagaatttagcagttaagctatcgggtcctgggcttttcttcagtgggagactttttattacagctttcatcttgtgatttgatattggggtctgttcaagttttggatttcttcctgattcaatcttgataggttgtatgtatctaggaatttgtccatttcttctagattttccaatttattggcatatatgggtgctcatagtagccactaatgatcctttgaatttctgtagcatcagttgtaatatcttctttttcatttctgattttatttatttggatttttctcttttttttcttagtctggctgatggtttgtcaattttgtttaacttttcaaaaaaagctttttgtttcattgatcttttgtattttttcatttcaatttcatttatttcttctctggtctctattatttcttttcttctactaattttgtgttttgttcactcctgcttttctagttccttaagatgcatcgttagattgtgcttttgaagtttttcttcttttttgatgtagacacttatagctatgaaattccctcttagatttttcagtttctttcttaattacttcattgacccactggtcattcaggagcatattgtttaatttccatgtgtttgtatagtttccaaaattccttttgttattaatttctagttttattctattgtgatyagagaagatgcaattatttcaattttttgaacgcttttaagacttgttttgtgacctaacatatggtccatccttgagaaagatttatgtgttgaggaaaagaatgtatattttgcagctcttggataaaaggttctgtaaatatgtattagattcatttttgtctatagtgcagattaagtgtggtgtttcttgattttctgttggaagatctgtctgatgctgaaagtggaatgttgaagtctcctagctgttattgcatttgggcctgtctctctctttagctctaataatatttgctttatatatctgggtgctccagtgtagggtacatatatatttaaaattgttatatcctcttgctgaattgactcctttatcatatagtgaccttctttgtctcttcttatagtttttgtcttgaagtcttattttgtttggtattgtatagcaactcctgctcttttttcatttccattgggatggaatgtcattttccatacctttgttttcagctgatatatgtttttatgggtacagtgtgtttttttgtgggcaacagatcaatgggttttgttttttcatccattcggccactctgtttttctgattggcgagtttagtccatttatgttaaatgttattattgataagtaaggacttactcctgctattttgttatttgttttctagttattttatggttttctcttccttctttctttccttcctgtcttctagtgaagggattttctctggtaatatgatttagttttttgttttttactttttctatatatcttgtatgtttttggtttgaggttaccatgaggcttgcaaatactatcttataatccattattttaacctgatagtaatttaacactatttgcataaacaaacaagcaaaaagaaaactaataaaaactccgtgctttaacttcgtctcctcactttttaaccttttgttgtttctgtttatatcttattgtaccatgtcctgaaaacttgtagttaccatttttgattggttcatcatttagtttttctactcaggataagaatagtttatacatcacagctacagttttataatattctatgtttttctgtgtacttactattaccagttagttttgtaccttcaggtgattatttattgctcattaatgtcattttctttctgattgaagtactycctttagcatttcttgtaggacaggtctggcattgatgaaatccctcagcttttgtttgggaaagtttatttcttcatgtttgaaggatattttcactggatatactattctgaggtgaaagttacttttcttcagcacttttaaatatgttaggaaaccttacctgtttccactgaaaagtctactgccaccatattggagctccgttgtatgttatttgttctttttctcttgctgcttttaggatcctttctctatccttgacctttgggagtctgattattaaatgtctcgaggtaggcttctttagcttaaatctgcttgatgttctataaccttcttgtacttgaatgttgatatctttctctaggtttgggaagttctctgatattatccctttgaataaactttctaccgccatcgatttctctaccttccctttaaggacaataactcttaaatttgcccttttgaggctgttttctagatcttttaggcatgcttcattcttctttattcttttttctttggtctcctctgaccgtgtatttccaaagagcctgtcttcaagctcatgaattctttcttctgcttgatcaattctgctgataagagactctgatgcattcttcagtatatcaactgcattttttaactctagaatttctgattgattctttttaactgtttcaatctctttgttaaatttatctgatagaattctttttttttttttttgaggtggagtcttgctctgtcgcccaggctggagtgcagtggcatgatctgcaagctccgcctcccgggttcatgccattctcctgcctcaccctcccaagtagttgggactacaggtgcccaccaccatgcccggctaattttttatattttttagtagagatggggtttcactgtgttagctaggatggtctcgatctcctgacttcatgatccgtctacctcagcctcccaaagtgctgggattacaggcgtgagccaccgcgcctggcctatctgatagaattcttaattccttctctgatcttgaatttctttgagttttctcaagacagctattttgaattctgtatctgaaaggtcacatatttctctttttccagaattggtgcttggtgccttatttagtttgattggtgaggtcgtattttcctggatggtcttgatgtttgtagatgttcatcagtttttgggcattggagmgttaggtatttattgtagtcatcactgcctgggcttgtttatgcttatctttcttgggaaggctttctagtattcataggaacttgggccccaagcccaataatgctgtggtttttgcagcctcatagaggttggtgcaagtagatgttctttggtgtctgggcattgaagagttaggtatttattgtagtcttcactgccttggcatatttttggccatccttcttgggaagtctttccagatatttgaaagaacgtgggtgttgtgatctaagctatattggctttagggggcaccccaagctcagtaacactgtggttcttgcagactcatagaggtactgcctagatggtcttagaacagatctaggagaattatctggattaccgggcagagactcttgttctctttccttactttcttccaaacatacagagtctctctcttctctgttttgagccagataaagctgagaatggtgacacaagcacccgtgtggccactggtactatgtgctgggtcagacctgaagccagcacaggactgggtcttgcacaaggcctgctgtaaccgcttcttggctattgccatgtttgctcaaggccctggggctctacagtcagcaggtagcaaagccaaccaggcctgtgtccttcccttaagggtggcgagctcccccaggccccggatgggtcaagaagttctgtctaggagccctgggagtcagggactagagtcagaaaccttagaagtctacctagtgttctgttgtattgcagccgagctggcactcaaaccacaaggtgcaatgcttcccactyttcctcccctttctgaaggcagaggagcctcaacctgtagccaccaccaccccaggccacaaagagtactgccagagtacccccatagtcccttaacgcccaaggtctcttaagtcagcattcatgaaaagctatcgggggaactctggcagtacttttcatgaatgctgcttggcctgggactcacccttcaggacagtgggctcccttctggcccaggacatgtccagaaatgctgtccaagagccaagtcctagaattgaagacgctaagagcccacttggtgctctaccctgctgtggctgtactggtacctagggggcaaggcagagccccttttactttcccccctgctgttctcaagcaggagttttgccccatagccaccacagctgggaatgtgctgagtctcacctgaagccaacaagtctcagtggttcaccaaggccctcaatgtagtacctggatattgctgctggttattcagggcccaagggctcttcagttagcagattatgaatgctgccaagcctcagacctttccttcaaggcagcaagttcccttctggacgagggtgtgtctaggaatgtcgtctgggagtagttaggtcctggaatgggggcctcatgactctgaccggtgccctatcctgctgtggctgagctggtatccaagatgcaagacaaagtcctccccactcttccctctcctctcctcaagtggaagggaggggtctcttttggagccaccagctgtgcaacctggggttaggagagataatgtcagcactcccttggctgccccaggtggtatctcagtatgttgcgtgctccctccattgtctctaggcctagttcagccgtaggacttgccaaagagttgcagttcttatggcctagactgtctttcaagtttacttggagacacacagtgctgtagccctcggtggcgaggttttccagggactcaagtttggacctctgggattcctttctggctagggctggtttaaatgctccccctgtgggtgggcatcagctgagttcggtccggttttcctttctgctctaacaggacagcacagagttcagtgcctcacaattgcagtgttctcccttccccagtgcccagagataccctccataccatgcactgctgctggaagaggagtcaccactctgaggaaaagggtggcattggtgattcaggactgttacttttaatctcttctgtgcttctttcagtgatatgaagttcaaaccaagtcctgtgagtgctcccctgatttttggttcttatgaaggtgtttttttctgtgtagatagttgttaacttttttgtcctcggggggacgattggtggagctttctattgcaccatcttgctctgcctctgagattgctttttctctttctcttttagagaatctgtttcaactgtctggatatgtagatgtttttaatattttgaggaaaaagaaaatattcaagatacggtctgtgttttttctttactgatttgttatgttactaatgaaccctttgattctaaaattttaaatctgttttacttagagaatgtttgtctgctatttattttctcccttttctgtcagtctgccagttctctcttagccttcctattatgtgtgtattatattttttggatccatcctctgtytgcctctgtcwtctcccctgtcaaattgacctctctaacctttcctgtcatttttaggattttttttgagctggcattgaagtcagtttagaatttttgacattatcctttcttctctcattatattttaaaatttggtaattatatctttatctgaaaattttctttgctattccaaagtcattcttttttaaaaaaatgccacatcccctcaaatctcactaagaatatgagttagatatatttcccatggtttttctcttttatatccaactttttccccatataatttattcatacttctccagtgggtccatttcttttgaactgtggaatgtttttatatgccctgttatttttttcctccttaagtcatcctcagaaagcattagagttatttatctttatttttccagaatttctgtttgaaattggttctgttgtaggctctaaattcataagatcaataatttcaggctccattgtgggttgaagagagtagtattcgtattaataaattaagtattagaagaccaaatgtctatttagaatagagtgggacaaacagatagctgagggtaaggagcctgagagcactcttccctctgtctttaattggtacgtcttcattaagttcttcactgtttttctgttttttcctttatttttcttttttgggtttaagtattctttgggaataggtactaagattctttgggaataggtactatatattctgctgtttggtatgttgtcctcagggtacttccctgaagattattagaaagaccaatatattggagccaagggcctgtctgatagttaagtagtaggtaaaattaggtccacttttgattaagtagtaagttcatccacttatttcttaggttgtaactagattggtagatgcttgtttcctaaaatgttatcttatgtgaaccatacccctgcagaaatttgttgaaatttctgttatgtggatagtactttatctaaaatagaaaatatcctggattgatgcaatagcagaatggtgataacagaagaaagagccagaagttgaagacagatcattagaaattattcagtttgtggccggacacggtggctcatgcctgtaatcccagcacttcaggaggctgaggattgcttgagccaaggagttccgagaccagcctgggcaacaaagtgagaccctgtctctacagaaataccaaaaaatcagccaggtatggtggagggtgcctgtggtcccagctacacagaaggctgaggcagaaagcccactcgagcccaagaggttgaggctgcagtgagccaacatggcaccattgccgtctagcctgtgccacacagcaagactctgtctcaaaaaaaaaaaaaaaaaaaaagaaaaagaaaaaaatcattctgaagaayagagattgaaaagaacagagccttggagttttgttggttcattctaaaggtctaacgtatgcatcattagaacagcagaaggagaggagaaagagattggagtaggaaaaaatatttgaagaaataatggtagaaaacttcccaaatttgatgaaagatacaatttttatttttatttttattttttgagacggagtctcactcttgtcgcccaggctggagtgcattgtgcaatctcggcttactgcaacctctgcccctggggttcaagcttctcctgcttcagtctcctgagtagctgggattacaggtgcccccsctccccagccccaccatgcccagctagtttttgtatttttaatagagatggggtttcaccatgttggtcaggctggtctcgaactcctgatctcaggtgatccgccctcctcagcctcccaaagtgctgggattacagacatgagccaccgtgcccagccaagatacaaatttatagatgaaagaagctcagcaaatgccagttaggataaactaaaagaaaaccacgcataaacacagtaatcaaatggttgaaaaccaaaaataaagtcttgaaagtagcgggaaaaaatggtacatagaggggaacaataatttgaataaatgcagatttctcatcagaaatcatggcagccagaagagagtggaacaatatgtttcaagtactgaaagaagagaactgttaacccagaactctatatccattgaaaatatccttcaagaacgaagatgaaataaagactaagagtatccatttctaacatgtttactttaatgaaatgttaatagacgttgtgtaggctgaagggaaatgataccagatgkatatttaggcggaccaatcaaaatggtaaatacgtataaaggactaattttattcttaagttatcccactatctgagaggtttttaatatgggtggctaaacataaaagctagtggggaggtggaaataaaagagtctatatggttgcaatgtttctgcatttttcttttctttttttttttttttttttttttgagacagagtctcgctctgttgcccaggctggagtgtagtggtgtgatctcggctcactgcaacctctgcctcctgggttcaagtgattcttctgcctcagcctcctgagtagctgggactactacaggtgcacgccaccacacctggctaatttttgtatttttagtagagatggggtttcaccatattggccaggctggtcttgaactcctgaccttgtgatctgcctgcctcagcctcccaaagtgctgggattacaggcgtgagccactgtgccctgcctgtttctgcatttttcttgatctggtacagtgttaactgtaagtagactgtgtaaggtttgctgtttctgtatttatatatttatatgtctgtttatctacctatgtatctgataatccgataagttaaagatatgctgtttgagcacaaaggagattcatttaaaccgctattgctatagattatgcctatgatgcatttttaygaggaaccagtaaattatataaaaagatataggcagaaagttaatataaaaatatgaaatactaaaaattttctaaggaaaagagaaaagaggaagtaggagaacagaaaatacagggaataaacaggaaacggatactaaaatggtagacctgaatctaaccatgttaataattctattacatgtaagtggtctgacattaccaataaaaagagatcttcatattggatgaaaatgtgaagatacaactgtgctctttgtaagaaacctacttttaatataaagacataagttataaggaaggaaaaatgcataccatacaaacactaaccaaaaaaagttcagatgaatctatttatatcagagagagtaaacttttgaacaaatagtatggttaggataaagaacataacaataagagtcattttcccaaaaagacataataatcttacatgtgtctaacaacagagcttcaaaaacggagtaaaaaaaaaaacctgttagaactgacaggaaagattgacaaattcacaattatagagacgtcagtgcttttttcttaaaaatcaatagaatagggagatagaaaaccaataaggaaatttaagactagaataatatcaacttatatgacctaactgacatttatagagcagtctactcaacagtagcgaaatatacattctttttattattattatctatattattatctatattatctatatattataattattatctatattagcaagatagactacattctgggccataaaacacaatcttaacaaacttaaaagaattaaaattatgcaagtgtgttatctgaccatatagaattaaactaaacacagtcattggaagagatcaaaattttttttaaatatttgaaaattatacatcaaacttatacatttagaaatgatgacatgatccatgagtcaaagtcaaagtaaaagtcacaagggaaattaggatgaaattgaaaaaccacatatcaaagtttggaggatttaggtaaaacagtacttacaagggaaatttatagtaataaaagcttatgtttgaaaagaagtatttccaatcagtgctctgagcagctaccttaacatagcagaaatagaagagcaaattaaactcaaattaaaactaaagaaagaaataataannnnnnnnnnnnnnnnnnnnaaataataaggtagagtagaaatcaatgaaattgagtagagaaaaccagtagagtaaaatcagtgaaatgaaaaactagtccttggaaaagatagataaaattgataaatctgtagacagagtgaccaagaaaaaacaggacaaattatcaatatcagaaatgcaagaccctgttgacatttaagggataattagggaatattttaggcatcattagccccataaatttgactactttgttgaaatgagcaaaatccttcaaagataagctatgatgtttactcaagaagaactagattatctgaatagtcctatatctaataaagtaattgaatttttcattaaaaaaatttctacagggaacgttcagttctacataagctcttccagaatatagaatatgagaaaatacctctgaattcaatttctgagttcagtgctatcctggtctgaaaactagacaaagacattatgaaaaaattaaattatgtccatctccctcatgaacatagaggattggatggagagtaaatcagtcaaatttcccaaaatacagtgctgttaggctatacccattgtaagtaaaaacattgatgttggggctgaggccaccaaaggttgaaggatgaaaaaaaataaaagtcaaatgtgtgaagttagagaacaggtatcagaaactgatgatcactcttttaatcagatgcctgcaaccagtgaatgttctttggggcactctggaattccatctctaccttgggtagaagctatctaagagcttagcagagggcatgattagaacctaggagagtttagagctacaaatgaccttatgttatctcctcaacttttgcccagctgctccctaaacatgactctcactttttacctgaaaacttgtcttcctttctcaccttttatctagagagtcaccttcaaagggcagaatcgctggtactgcagctttttcaaatatcaggaacttcaaycaaataaaatgaaaaaggacatattctcctatgctttccacctatgaaccttacttttccctcagggcccaaatgtggctcccctcaattcctatgctccttgttctgggtaaaagagtacaaggggaccaggaacagggtttttacctaaagcagaagggagagagggtgggagaagtatgttatttgagtggataaggargaatactgagaaggactgcccgctttcaaactgaggttcaaggagtctwagagcttctttgctggtttcttcctttcttcatgttgggaaaagggcttgtggggtgtctgtataaactggccataaaaatatgggacaataagttgtggaagccacaagaggcctctgaggaggaaagtctcctaattgccatcatgttcccatgctcagagggagacccgctttcttatctgtaaacactgtgttcaaggagaaagacactcctttgaaacactggaatgtgaacaggcgtgcaggctcctagttaagcccgctcctactagctgctctctgataagttaaagataggctgtttgagcacaaaggagattcatttaaaccactatcgctgtagattacgcctattacgcattgcctccctttcactgtttcgccctgaacgtctgcttctcagatctaagtgattgtactcaataaatagtgtggagaccagagctctgagccttttgcagcctccaaaagtacaactggccccctggctccccacctttactcttaacttgtctcttctcaatcctttgttgccaccggactttgggtaccctatgggtggttttgaggctggtccccaacactccacaatttctactttgttttttttttgagacagagtcttgctctgtcaccacgctggagtgcaggggtgcgatcttggctcactataaccttcgcctcctgggttcaagcgattctcgtgcctcagcctcctgagtagctgggattacaggcacgtaccaccacacccagctaatttttgtatttttagtagagacaggatttcagcatgttggccaggatggtctcgatctccagaccttgtgatccacgctcctcggcctcccaaagtgctgggatgacaggcgtgagccaccgcacctggccacaatttctacttttaggattgtactatgtcttgtcrctcagtctacttctctgtctgtatgccctcctgtagtgatctcatccctttccaaatgcatattgctaaccagtgctgtctcctgtattctgtagcctttattcccatatattcagctggcttctcagcatatctgaaaccaaactctggattgctcatctccccaaatacctgcttcttccctagtctttctcatcatagtaaatggcaattccatttctccagttagtcatttgtagtccttcttcttttttttttcttttgagttggagtctcaaactctgtcacacaggctggagtgcagtggcgtgatctcggctcactgcaatccccggctcccaggttcaagtgattctcctgcctcagcctcccaagtaactgggattacaggcatctgccaccatgcctggctaattttgtgtttgtgtgtgtatgtgtgtgtttttagtagagacagggtttcagcatgttggccgggctggtcacaaactcctggcctcaagtaatctgccagccttggcctcccaaagtgccgggattacaggcagtagttcttcttaattcatgtccctyctttcttatatcatatataatctattttcagaataaatcccaaatctagcccattctcactgtgctcactatctttcctctgcataattgctgtagccttctgttttccatggtatcatatcttctggtctatttttcacattgcagccagaaagatccttttaaaatatgagtcattgctaaatatttaatgatgtctttcctctgctcacaactctccattggtctcctgcttcactcatagtaaaagccaactcattttacagtggtttatacatttctgaccttatctctcaccattcttcccctcacttactccagtctggctctcctggcctcctattcctggcacatgccatgcctaaaccattgtttccctagctagtcacatgggtcccttcctctcttcctttgcatccctgccaaaaggaaggccttttctgaccaccttatctaaaagagcaactcccacctccacctcagcacttctcatcccccgatactactttatttttctccacagtagtctattgccacctcactattattgtttattgacccttgccccattagaaggtaagcagcacatgggcaaggactttgtattggttatggttggatccctaaggcctaggatggtccctgctagaaagtatcttctcagcaaatatttgttgagtgaatttgattgtggtgtttttttccttccccatatttgaataacgttctgcggaataaagttagatagtcatggagtaggataccataggacaggatgtctgactttaggtaatcattgaatgaatgaatgaatgaatgaatgaatgaatggcaggggtcctacagaacatttaatccctctcttttcttatttcaaagatgagaaaatggagagaggtgtacaaatcatagaaagatgtcttagcttcagtattttgtaaaccctccatagtgctcagcaggtttcacaaaatactcaaaagaatgtcacaggtaaggaaatagaatataaaaagactagcttgtattcaagaatattttaaggctatcatatagaaagttcttataagaaattggtaacggggattctaatgcttcaagtatcacatatttatataacatttgttgtaaattaataaagctaatatctttttaaaggcagtttattagatatggtatgtaattcataaggaatcccttttccccaaattaccctatagtttgaactttattttgtggttaccaaagtctggacttttaaaagatataaagttataatctgagaatgagaaagacaaaatgggaatacagatagatataaaactaaaataaatagaaatgtaaaatagtgcacaggaaattctaaatgataagtgtagattaaaatattctagaggaggctgcacatggtggcacgtgcctgtaatcccagcagtttgggaggccgaggggggtggatcacttgaggtcaggagttcaaggccagcctggtcaacatggcgaaacctcgtctctactaaaaatacaaaaattagccagtggtggcatcaggtgcctgtaatcccagctactcgggagactgaagcaggagaatcgctcgaaccygggaggcggaggttgcagtgagccaagattgtgccactgcgttccaggctgggcgacagagtgagatactgtcttaaaaaaaaaaattctgaaagaaattaggattgggtgacacagtggcccaggtgttaggagatggctgtagcaagggagaaggagtaaaatttgatgatgctttagatagaaggggagaacttagaaagctggggccatgatctgagcagaggcatagtggggcagccagagaatattctagtagtgagtaaggtcattttaatagaaccttaggtcagagagtttaagaacagatgttagtgcacattgtgagaatatttgaatgttacataaaatcatttggactccagacagtcagaagcttttgaaatcttttacgggggctgacatgtgcaaagtagtgttttaagcatattaaactgtcagtgatatacattatggataggaagaggagactgaaaagttctctgtgaggtgatactgacccatgctaggataatagcannnnnnnnnnnnnnnnnnnnttagttactcttctgtgagaagagaccagggtaattttgtggtttttggtatctaggagaactgtggaaataggaaattctatcatgaatgtcattttatcatgaatgccattttgtcatgaaagatgagtttggctttagacatagcaagtttgggatgagagcaatctaatgatgtctagttagagatgtggaactcaggctggatttgggctacagttagtcctaacggtgaatgaaatcttaggagtttcagagattgtagaacagtgtaggctgaaaagatggtggtgcgcagaactttagtgggcagaggaagaatgtttagtgaaggcaactttgaaaagcaatggttgcagaagtagggtaacctatgaaaagaaagcaaaggktcacataattagttggttcaaagtaacattcatccctctctcaattcccccattgcaaatgcagtacatctttaatgtcagatcctggaaaatagaaaatagcaaaaatatttttaaatatttttaaaaagtttttacccagcctgggcaacatagtggtaccctgtctctacaaaaaaattcgaaaattagccaggcatgatgacatacgcctgtagcctcagctgaagctgaggtgggggatcacttaaacctgggaggtcgaagctgccgtgagctatgattgagccactggactctagcctgggagacagagtaggatctgtctaaaaaaaaaaaaaattacttataacccagttagccagagaaaactagtaaaatatttaaatatatatcttaagttactaaatatttcttgtttattgtgtctatgtatttgtgtatttatattgctgtacaagatagtgtttattatttgctgtaaatagttgaggtaagatgattcaaaaagagttcagcggttaattacgtagcttatttgttgacctaatcttctaaatatttaatatatatagaatttcccatattgtctgttttgtttattcttcagatgattgcaaaagggaaaaatgcatctgaactgtttcctgctgttgtgaagaatgtggccagtaaaaatattgaggtactgttttgatctataatttttatgattccttttgttttcatgggaccgtacactttttatgtagtataatgcaacataagatacttaagtatcactagatttttgttatgattaaaatgtccttaattttaaatgtaggtaagatcaaataaaaagtaggcacaatcctagctttggatttttggtagaaaatatgaaaagcaaaacmgattgattcccctgagtgaatgatggtaagttgtcgagttttcacctgttcctagaggcccgtttagtttaaattttgttccagggacttaattttaagatagcatatgtccagtgaaaaagacctatttgggtatatccagaccttgatgatttggggctttttgggatttctaggactgagcccaagaatatttcccaagtttctcagactactcatgacatgtactaagcactcagtacatatatgtggatttattgaatgaacacgtcccagtaaaatactgttttctgtaagctacactaatatagtctagtattaaggttacattctcctctccaccctggttaattgataaattaattgaaaaagcctggttaattgataaatttttctcagtttaaagctttaaagcctttccctcaccataaaattaaagatgtgttactgctactatttgtttgccattttattggcagatgatgaagctcattaacaaataacagaaacattctaatccagggaacatggttatggtgacagagaaagtgcacaagcattcttrcacgggcaagtgtgagagcgtaaggaggatgggtgtgtgatttcagagggttcgctaattttgtagttatgattttattttccatgcatagtatggtcattttttggtagtgaagttttttctattttgcgtgatgattttaaatgttcaaagtattcttgccagcaaaaccaaccagagaaaaagaaaacatttttgagctaatgttctttaaatattacttaactaaatgtgattgatagtgttggtgagagaggaatttttaatctcccaatcatgattttgattttttttttttttttttttttgagacagagtctcacttcgtcactcaggctggagtgcagtggtgtgatcttggctcactacagcctcgacctcctgggctcaagcgatcctcccgcctcagccccacaagtagctgggactacaggtgcttacaaccatgcttggctagttttttatatttttttttttgtagagacagggtttcgccatgtggcccaggctggtcttgaactcctgagctcaagcaatctacctgcctcagcctcccaaagtgctaggattacaggcgtgaccaaccgtgcctggcttttttttttttttttttttctgagacagggttcctctctatctcccaggctggagtgcagtggcatgatcgtggcttactgtagccttgacctcttgggtttaggtgatcctccttcctcagcctcctgagtggctgggactacaggtgcatgccrccatgtccagctaattttcatattttgaacagagacagggcttcaccatgttgcccaggctggtttcgaactcccaggctcaagcaatctgccaaccttggcctcccaaagtgctgggattataggcatgagccatcgtgcctgggctgattctggaatgttttatttttccccttaatttagtattttttgcttatttttaaaagtactcctattaggcataactctttgggttttcctgatgaattgacctttttattataaaaaaatcctttatttttgttaatatgttttgtcttaaagcatatttgatttgttattagtattgccactccaaccttctcatttctttttattatcatttttattcatttgctttcagcttgtctgtttatatctagtgtgcacctgttgttgacagcgtatagttgcagccttccctacatcccgtgtgtcaatctctgccttttaattggagtgtctattttgctaacacttaatataattattgatctgcttagatttgagtctactattattctttttcttttctctttgtctcttttatttttgtcttctattcttcctattccttttttgggttaactagaaacattttaaaatttcattttagtttttttccaacttgcatttcttggcatatatgacagtggtcccatatgattataatactgtatttttactgtactttttctatgtttagatacacaaatacttaccattgtgtgatagttatctacagtattgagtacagtaacatgctgtacagatttgtagcctaggagcaataggctatatcagtagtccccaacgtttttggcaccagggaccagtactgtggaagacaatttttctctggacccrgggtgggtaggatggcttcaggatgattcaaaagcattacatttatggtgcactttatttctattattattacattgtaatatatgatgaaataattatataactcaccataatgtagaatcagtgggagccctgagcttgttttcttacaactagatggtcccatctggggtgtgatgggagacagtgacagatcatcaggcgttagattctcataaggagcacgcagcctagatccctcttgtgtgcagtttacaatagggtttgtgctcctatgagaatctaatgctgctgttgatcttacagtaggcagagctcaggaggtaatgcgagcaatgaagagcagctgtaaatacagatgaagcttcacttgcttgcccactgctcactgcctgctgtgtggcctggttccaacccctgggctatgtcatatatcctaggtgtgtagacccctggtctgtatcatatatcctaggtgtgtagtagtctataccatgtaggtttgtgtaagttgcactctgtggtgtttgcacaacaatgaaattgtccaacgacgcatttctcagaacattgttaagcaatgcatcactggattatagcattttaaggataggtactttaaacctactttttttttggagacrgggtctcgctgtgttgcccaggttggagtgcagtggcacgatcttggctcactacaacctctgcctgccgggttcaggtgattctcctgcctcagcctcccgagcagctgggattacaggcttgtgtcaccatgcccatctaatttatttttcgtatttttagtagagccggggttttgtcatgttgcccaggctggtgtggaactcctgagctcaagtaatctgcccaccttggcctcccaaagtgctgggattatgggtgtgagccaccatgttcagcctaaacctacttttaaaaaaagatttaatattttaaagtatgcttcttgctttttttgggggggaactgtagtggcatgaacacaacacactgtagccttcacttcctgggctcaagtgatcctcctgactcagccttctgagtagctgggaccacaggtgcgtgccactactcctggctatttaaaaaatattttgtagagacgaggtctccatgttgcccaggctggtgttgaactcttgggctcaggtgatcctcctgccttggcctcccaaagtgctgggattatagatgtgagccactgtgcccagctcttaatttttttcattagataggaagtgcattctgtatttcagatagatgaatttttctatcaaaatgaaatagttcttataaactcaattagactaagttggataagccaaaatcaaaacagttgtattcttgtggccagtttatgaattagattaaattagtactgkatttaaatgacttgataaaccatactttctttgtagatttcttgagtaaaatcaattttacttatgattaatttagtagatatttattaaacactatgtgcttgttatatataattctgaattgataattttyaactactctccctttgacaccttatggccatgatatctgagcttctaatttgatatgtttattagttttatggcctgtggtataagaaagtccaaatatctggaaaaaataaacatttaacttagaaaaattatgaggcataggtgaagcttgtcttagtattatcaggaatagagtctcttagtagcaataggaataattgctaacattaaaaaaacctgtctgaccaaggttattagtgccttgcatagatctactccgttttatcctcacaaataaccctgtggggctgtttctgtcattacttgtattttatatatgaggacaagatggcagaaaggttaaattagctgatcaaggtcacacagccagtgtgtagcagtcagaatccaaagctaggttgcttgacttcagaacccatcttagcccattcagcgccatctttcctgtttgatgattcctccctctgttttgtctcttaatatttttgactccttatcaacatctggcattagccatcctttgggaggtacctagtattggcatattttttttttttatgttttagttatgggtagaaatgacgaagtccttagaaattggtggtaaagtagctagttccctgaggacttctagttcttgttgtaaacagaaaattccataccaattattgttccttcagaactgttttactattcaaatagttatcagtaggagaacttttccatttgctcatattttccctttacaattagattctggtagctgcctaatgttctgttacaaaaatgtcaatataaacataattattggtctatttgttttggatttctttcgttctttaaataccttgtttattttatttttttgaaacatggttaagcctttaatgttttgggaaaactgacataagtttcttaaaacttatgttcagaaattgaatgtttcactcctctcaagtgcaaaatttcatttttacaagtacatgctgctttagacacacaggtgagctgtacgtcatctaccattaaatgtcaaatgataccaaaagtgacctagtaagcaatcagtggttatagtacaaaaataatcaaaggtttagtcaataactcatgaagtttgatgtactagtattgataagctaattaaacagatctgtctgtgttcttccagcctactggggctctgctatgattagctttacagcaaggagtgttataacattgaatgaaagtaaccgatcagagaatgatgtagtcacggagctttaactactcccatttctggtcacagaatggtttcagggaaggtaggctttctttgcacacctgcagcctgtcagtgcataggcctcttgtggtcaatattgattgattcttataacagaagtagaacaaatttagtgtttcgcaaccttctgtgatttaatattgttatgctttttgccataacagtcacagaaatccttctccaatagtgagtaattattgcaatgcctgctagctcagctgtggttctgaatgtttcagtgttgccaatataaactctgtgatatattctagagttcataatccagttttaaaagctggctgtacttggtgaataaaggtattgctgagaaataaattgtaaggggataagggagaactggacccattctttctcaaaactttccagagaactgtagagtgagatctgaatataattagtaaagagaaagaatattttaaaagaatattttaaaaaaccaaaccagctgtgttggtgtgcacctagagtcctaattaccagggaggctgaggcaggagtctctcttgagcccaggagtttgaggccagcctgggcaacagagcgagaccctatctctctttaaacatacacccacacctccacccccactcactgacacacacacacccctccccacacacccacatacaccaaaaaaacaaccagactaacaagttaaagactttggaggcagtctttccaaaacctgttgttttcttcatagtatgttggtgtctttctagactttgctgttcaatgaattatacccactggtgtgagaagttagatcctagatgtagcactctaatgggaaatgtcttaatttttttcagtctacagttggtctggaatgtgatccagctgataaatattgagcttttactayatgccaagcaatgtaataagtccttgcaatatacagatgaataagaaatggttgttgtactaaatagcctcaagttcacttccaggcagatgggataaattacttagttaaatacatattatgtgttgatttgatatattgaaactgttgttaatcaactgctgatatattgatatatatttgatatattgactgctgttaatcagtcaaccacgtgttaattgctttctaccattgctgtattcttaggaastttaaatctagttgaggaaaaagtcatctatcctcaaatagttagagaagcgcttctaaaactgatctaagaatttgaaaaacttatatttacacttaaatataatctgaaacattaagtatagtttgaatcatttggtttccatcttatacmtatatttgtattcttgtgtaacatcacttggttccaagtgatcatttaaaggaacagtgtttcacaaatatgtgtattttgggtttgaaaaattctgaaggttgagaagcactaatttaaaccaagaaagtgtaaagagtctaatcgtgaatatagatggaaagtacattgataatagagatggggttctatggaatgaagtcattactaccttttactacagttgtaaatttcttgttggatttttaataataatactgcaatgatgtcattttcaaatgagaagatgtgcaattggggttaaaaaacagtgatttaaagcattcttcttttataaatgtatatattataaataaaatataatttttttcctaggttttcagatgctcttaggggaagagttgtctcctcttttgttaggggtaccttaatagaaatatctgcggactgccatcataggccacaacatgtagtagttaggaacatgcccgtttgcatcctgattctgcacttgctagctctgtgactttgggcaagttatataaacctctgagccttactttccttatctttgagagggagataattgtacctaggatagatatgagaattaaacgagtaatataatgtagatgtagggccttacacatttaaattctagctggaaagttatagcagattgaggtgaagaacaaaagctgtcgcaggcagttttcctttcatattctgtatttcctaattaattttaatactagccagaatgacaagggtacttttagaaaagaaaggctgggctgggcgtggtggctcacgcctgtaatcccagcactttgggaggccggggtgggcggatcacctgaggtcaggagttcaagaccagcctgaacaatatgatgaaaccccgttctctactaaaaatagaaaaattagctgggcgtggtggcatgcgcctgtaatcccagctactctggaggttgagacaggacaatcgcttgaacccaggaggcggaggttgcggtgagctgagatcatgccattgcactccagcctgggcaacaagagcaaaacgccgtctcaaaaaaaaaaaaagaaaaaagaaaaacaaaggctgaggaacttctccagatgaaagaagaccaaggagacatgaaaacttaaatatgatgcatgatcccagatcagaaaaaatactataaatataggatgttattgagaatttctaaatatggattatttattagataataaatnnnnnnnnnnnnnnnnnnnntgtagtgttagcaattgagaaacatagatgaaggcggccgggtgtggtggctcacgccagtaatcctagcactttgggaggccgaggtgggtggatcacttgacgtcaggagttcatgactagtctggccagcatggcaaaaccctgtctctactaaaaatacaaaaattagctgggcgtggtggtgtgcacctgtggtcccaacttttcgggaggctgaggcaggaaaatcatttgaacccaggaggcagaggctgcagtgagccgagattgtgccactgcactccagcctgggagacagaacaagactctgtctaaaaaagaaagaaagaaagaataaaacataaatgaagcctatatgaggcttcagtgaactagtcttggaacttttcagtaggttgtattgaaggatgatatctgaaataagacaatttattgcttactatagcaagggacaactgtgctttttaggcacagcttctctgggcatagagattgctgatattattgtggattattgggaagggcagtcttcagggattgatggactttcagggtcctaagtgggttgatgtcatctgtagatgcgtggtcatgtgggtgagactgctcttgattgattggcactcagaggtgggtgtatgggagtgcagttgttcctgactggctaactttcacaagcaagaggctgagcaagaaaacttgttcattcaggtgcctttttattgttctgtagaacaggtttaaaacagttctggtggctacatgttgccaaggctttagaaaaacctgtctctccgaggaatgtgggaacttaaaaacattaccaatttgaaatctttttataattaaagaatttaaagtattagaagaatcacagcactattattttgttttgagggccatctggaaagatgagattcacccctatcgtgaaatatctttattgttttatctgaccccaaagtaattaatattcctttaaagataatatagaaggatgtaaagagtgaaagtcactggttaataccatcacacagagatagttactattaacattttattgtatagatttctcaattttgtgcttacttgacttgaatcttagttcttctatttaatagatacggtactttagtcaagttacttaccctgtctgtgtttcattttcttatctgtaaaataagaataaatacttgtttattgagttgtgaggataaaatgagttaatttatgtaagacatttagaacagtgtctgacatgtagttaatgcwacctataaggatttgctattattaccatattatgtccattctaagacatatgtttgctattttaaagtttctgcagttgggatttaacttaacaactggtggtgattacgatgggtagtgttttctgtttgtttgttgttgttctttcctttgtggtccataatataatggtatgttttacaattggtggtctatttagattgcataaaatacagtatgtgggcatctattttttttttatacagaagtgagatcatacaatgcatactcttttacacctttaaaaaattttaggccaggctatggtggctcacacctataatcccagcactttgggaggccgaggcgggcagatcacctgaggtcaggtgttcaagaccagcctggccaacttggtgaaaccccatctctactaagaatacaaaagttagctgggcgtggtggtgcgtgcctgtaatcccagctacttgggaagctgaggcaggagaatcgcttgaacctgggtggcggaggttgcagtaagtcgcgagatcgccccactgcactccagccttggtgnnnnnnnnnnnnnnnnnnnntcttaaaacaaaaacaaacaaacaaaaaacctttttcaaggacatattttcttttctttcttttctttttttcagatggtgtcttgctttgtcacccaggctggggtgcagtggtgcgatcttggcttgctgcaacctctgcctcccgggttccagcaattctcttgcctcagccttcccagtagctgggattacaggcatgggccaatacacctggctaatttttttgtatttttagtagagatggagtttcaccatgttggccatactggtctccaactccggacctcaggtgatccgctcgtctcagcckcccaaagtgctgggattacaggtgtgagccaccgtgcctggccacaaggatatattttcaatgtcatacagatttatttaattttgtatagtggctgaatagtatagtgttatatggaggaactgtcatttgtttactgtttatctactaggactctttattgtttaatttttgctcttgtggaagattttaataagtggaacttggggaagtggaacttggtgaagcgggataacttgggataacctgagtggagattgagataaagagtgcaagttatatttggggactatttctgtttgactaggaaaggaggtttcgaacagattataaactgtattgagtactaggttaagagctttagattttgtttttaaggttttgtggagccattcaacattgaagagtaattggaaaaaggttttttcatttcatttataactctacccgtatagtatagadggattgatatcaacttaaaatggttgtgtttaacatatttatcaaygatgaagatgtacaaagtttgtttgctcattaagttttcatttgtacttatgaattgagaaatagtttggattataaaattatcatctcaaattatcttaacagggtgccaagatgtgttgaatctaaattgttgacaatttctgtagataaatggaagattttgcctttcatttaaaataattttaaaaaaattccrtgaggacagttgrattttgatttggtcagcagtacatttggaaaaggtgtatggttttaatcaagaattagtcatatctgtggaagtacctcatctggagcaagttcttatctagtttgttctgtttagactttatttgtagtttgtagtgtcacgctgaaaaaaattggagtgagtttaggaaggagcaaacaggatggtrgaggaactaaagctgttatgtttcacgagaaattagggtacaaggaaggaaggtcatgacagttgtctctaaagtagtccagattggttagtatgactggaaatatgatccagtatagtactgtttttatatttccagcaccaattccagctatctccaactttttcccctcatttcttgtgttctttgagtatataactttttttttaattttaaatttttwaaatttttgagacagagtctctttccagttgcccaggctggagtgcagtggcacaatcctgcctcactgcagcttcgacctcccaggctcaggtgactctcccatctcagcctcccaggtagctgggactacaggtgcatgccactgtgcctggctaattttttttttttttgttttactagaaatgggatttcaccatgttgcccaggctggtcctgaactcctgaactcaggcaatctgcctgcctcagcctcccaaagtgctgggattacaggcgtgagccactgtgcctggctgagtacataacttttaggtatatactgtgttggtatcttagaagggtaatcaggaatgtgaagatatttgagaaggtagatacaggctataaatagtgctagaaggaagcaatggataaatttcaactcaaattctagtttttgtttatttctttttctgttcataattttgttgtaaacttagtgattaaattacctttaaaacttgttttcaaggctgggcataatggctcatgcctgtaacccctgtgctttgggaggctgaggtgggaggaccagttaagcccaggagtttgagaccagcctgggtaggcaacataggaagaccccgtctctataaaatcctaaaaaaaagccgggtgtggtggtgcatacctgtagttccagccactggagaggctgaggtgggaggatggcatgaggccaggaggttgaggctgcagtgagccgtgattgtgctattgcactgcaccctgtgcgacaaagcaagactgtgtctcagaaaaaaaatcgaaaaccaaaaaaaactgtttccagaacacacatccaatcttcttgaatttttattacgttaaattggtattcatagtcacacattattcttactggactgaaaatatcatgtaatgcgtgttgaaatgtgagtattaccataaaaatcagagttagggctctggactcttttaacagatgaggaaacaagttcccataacatatagttagtggcctgggcccaaattctttctcttattattttttaaagaggtagggtctctctgtgttgcccaggatagcctctaactcctgggctcaagtgatcctcctgcctcagcctcctgtgtagctgggactacaagcatgtacgccatgcctggcttctttcttttatttttatccctcattttgaaaatatttttacaatttagttaatattcttatatgagatctgctcagggattttttattcccttcaagaggaagggacactttgataggctattgctattgkgaactggactattaaaatgcttactttaaaagcttttcctgttgtacttattatcccacaaaatattatttktattttacaatctaacatgtgaccagattcagttatttacttgagaagaattgagcatggattttggtatagcaaatactgagttttaaattttcactctggytatgaataaatgattttttttttaacagatcaagaagttggtatatgtttacctggttcgatatgctgaagaacagcaggatcttgymctcctgtccataagcacttttcagcgagctctgaaggtaaataatggagtgagtaggcaaatagctacaaggtttctgcagagttgaaagtgtgtcagttaaagaagtggagcgataatccactaaatagcacagtagtgtcttgaaagagttaaaagcctcctatagtgcctactcagtacacttagaaaataatttatacaaccaactgaaaccttgctgtatatgttacagcttctgtatgtttgtttatattcaatataattattttcatgcttcaaagagctgtttatcattatactagttgttgaaagtacgcaaaaggggttataagacatttttaaacatgaaattgatgacctgcagcattttattattatgaaagtataaaaacccagcatatttagtaataaatgaccaactagaattataactattacttttctttaaaacattattaaagaagtaaacatttatgtctgtctttttttcccattcctatatactaattgttcattttaaattaagtagctttcttttgctattgtcatattacaccctttaagcacctattaactgtgtctgaaagatatgtttaaaatattgtaaagttgaaattttggtgaatatttttgcactatttttaggacccaaaccaactaattcgtgcaagcgctttgagagttctgtcaagtattagagtgccaattattgtacctatcatgatgcttgctattaaggaagcttctgctgacttatcaccatatgttaggaagaatgcagcccatgcaatacaaaaattatacaggtaggtgcattgttaacaatataccaaagatctctgatgttacatggaatgttatagaccacagaggcttgttttattcgctcttttaggtaggctgctcttayactaagtaaatccagtgactgtatgatggtatttccccctgctgcaaatgttccttacacatctttaatttcgttttggctatagagaccctatgcaggtttttatttgtgaggctgttagagcctgtgataatttatagattttataacttaagaataatcagaatttgaattctcatttatatagtctatctcatgtacacatatgcttgtattattagaaaattgagatttttttttcctgtttagggtagaatcttaagtgtctgatcctctcaactcasttatatgtgttttcctttcttccatctttgttcctgctsctcccttcgttgtctaattcttttccagagctattttattaagtaattttaaaaagtgtagtgatttgaaatatagtgtgctataccatatctgtgtgatattttagaaatgttatgcaatattatacaatgccctgatctctgtggaaaatttactgtccaaatagaattgtctayaacaatttggtattattttcagctatcatttattcctcaagctttttgagactctcttctgtttctggtgttgtattcacagtattgtgctatgtgtatttagatgtatgaaaacagtagaggatgtggcacttaattatgaatagcatatcatgtatttgaggaagaagatcaaagacataccaaataattaaaggcaatctataatgaataagatattagcacttgatatatatgtatatacaaaggtacactagcaatgtctttgataggacagggaccagagatgatcatattttgttaccggaaagtaaagatgtaatgagatgggattggtagtgaaatactgctttgagaaggaagacttaagctgaaatttgaaagaattaaaaagtttgtccagataattataatgtttagtaataaatgtgtatgtttgtagaaagtgaaacctcatattcctatgttaactgccagacaaggttttatcatgcttctcactcaccttttctccttagaaacttatgggataagatccatgctcactctaacggyttaaaagtccttctatcattgggcaccagtatattccagcctcaatgcttgcctctccttgccttgagcttatagtctgttagtattctatctcaaatgttttaagcttattactacctcttatttttcytagttttagttggcagattttataatgcatgtctctatcagtgaactagtatgatataaaattcttatttggaaattctccatatttgtttttggsaagtatgtatgcatagtaaaataatgactgctatctagttatttttttcctcccagttgaaaagagtttgtggtttatctacttacagtcgctttcttgaagttttccaactcttttagaagtgaacttgttctttcagtactatcttaactaaaccattgatatctggtttagttaatatgaacaatattagagggaaagatgaggacacattcatgagaaaaaccatcccattttatttgtttttctttatttctaacttataattcttgctctcctttccctctttaaaaatttctcaacatccttgaattggtgagcatcatgtaaagctagaattaaagggaaaaattaatatgttatttttgtattttttagccttgatccagagcagaaggaaatgttaattgaagtaattgaaaaacttctgaaagataaaagcacagtaagtaatgtctttttacgtctttgacataaaaatgtactttatttacatagtatcatttaccattatatattttatatagttgtatttattgatttcaaaatgstataaatattaatggcacacaggactatttttaaagaacaaaaattttcatgtaatgagaaagactgcatttggagttttagatcgttatgtgtttcttcatcagaatctgaaaaaaggcaagttgagaaaaaaatctttaacctgtggctaagtggttaacatggtaagatcaaggaatagaggtgacctatgggggatgtgagttrctagtgtactagtatcttagatggggcttttgtacccactttatatttctcaaaactactgaggaaaaggattccagctcatcttaggatgctatcatcagggagtatgtactatctatgcatggcagctatctaatacagtaggcagtagccctgtgtagctgtaactattggtttatggcttagcatttgatctatcctggataatgttcaataaacatttgattagaatgtgtattctgctgttgttgagtggagtgttctatagatatctgttttttagtgttgttcaaatcttctactttgctgatcttatgcctacttgttctattcattattgaaaacagggtattgaagtctctttaattctgttagtgtttgcttcatctatttaggagattggatgtttggtgcatgtatgtttataatttttttaatcttccttttgtcattgtaaaatgttcctctttatctctagtaacatttttttgttttaatgtctgttttgcctgttataaatactactattctagcttttttatggttgctgtttccattatatatctttttccatccttttactttcagcctgtttatatttttgcatctattgtatgtctccatagacagcatatagttggctcttgtctttttatccagtttgccaatgtgtgcctttaattggaatgtttaatccattcacacttattgttgttattaatatagttggattttaagctgtcattttacttgcttttatatgtttcatgccttttttgttccttatttctcctttattgctttttcttagattargtgaatatgttctagtgaacattttaattcttttcatggtttttttactatatatttttgaaaatattgtcttatacatggagattatacttgtagtttcattcctagaccatttagtaaatttctgttagtctgtagtgtaccagaaatcattattgcatttcttctatgcatagttggtataacgtaggaggtaactaaatatagattgattataaatgaagatagagaaaagaaatttgattcctttttgtcttctgtatgacaggcatgctatctgccagatatgaagtcaatattattaatattatggttaacttgattttaataatttaaaaaaatacttagtgcttttctattataagtgcaagagattggctaagtaccatggagagtagtaagatctacaagaagcagatctgtcattttaatgagttttaccatcatttctgctacattatagactaagagaaattctttggatggcctgggaatgaactctctctgtataatatgtgcatgtcttcccagacaggatacagcatatcataggtaaaaacaatagcgtttgaatcagatagaactggcttaatgtctgagcrtctgccacatagtatatgtaccaattctttatgagttttaggctccagatttgtagggtttataatatctaatttatacatttgctgtttgtgtcgagagaaagaactattgtatataaaaccctyagcacagtgcctaacaccacatgggatgtgattaaaaatyccaaataagaaataagtactcaaaaagatgtaaagatacaatatctgtgtaaaattggaatgtctgtttccaaaatacaccagaaagtaaaaaatattgaatacttgttcatcacaggtatttaatatttgttgaatgactgttgaattaatttgttacattcttggtgatagtaattaagtgtgtagtatcgtttttaatgtctccctcacccccctgcagtggtttcatgctcagtgttcataggtagattctttgggggctttggtggcctaccctttgtgaggcactcatttttcctaaagtgttatatactatatgtttattttttttaattaagaatacatatttctttttctgtctatagtaaaaaacaaagtttttactgacacctgtaattctggtggtatagcacagagttccttccagcctccttcctttttatatttgaaactgcctattcaacattaagaaatgtggctctggccacgcaccattgttcatgcctgtaatcctagcactttgggaggccaaggtggatggattgcttgagcccaggagttcgagaccatcctgggcaacatggtgaaaccttgtctctacaaaaaaaaaaaaagaaacaaacaaacaaacaaaaaaacaagaaacagggctcctatttccacaatctgtttacatttttgctgagtctcagaatgcagagaaactattgcttcagaattgctagcactgtacctctgtggggtatacagtagcatggggcctaataattagagttaaatatttaattagagttaaatattagtttagagttgtttttgtctttaatcttttttttaatgtatggtaaatcaaaattgcttcaactatttatatctttgaactcgttgtgttggtatgtaagaaagctattgattttttttgagtgataaattttatattctgcttttttactgaattcttctattgtttgagttaattttctcattcatcctccttgggtttttttttgcatgacaaagagtctttacttttaaatgattatcagtacaccaagtagtaacatgtaacaagttcttgaattctgtcctctttgattaagtaactaaaactggcccaaacaattatactagtgttcattgttctaaccactagcaggaatggactaccagatattgcagaaaaaggccaagacttcacccctcttctgcctaaactgcttccagatggttctcttctcctgggtctcctctactttaatgctgcagctgccttgggatcgcagggcagcagcctccttggccttgaactctttctccctctgcaggcaatattgttcaatttcaccttgaactgctgctttggcctgcttctccctccggttctttcactgcaggtctcagacacccttttcagcaacctgcagcagctactggatccsctgagactgactggccatgacagcaccaactctgaggcagaagcaagcagcctaaatctctctctctttttttttttagagaatgaatcatatctgcaaatagagatgttttacttcctctttttcagttcctagaactctaatttctcttgcctaattatattgtttagtgccatcactacagttgtgttcaatagtagtggagatggtgggcattcttgccttgtttcagtctaaaggaaatgcttacattgtgtttgcattaaraaagatgctggccctgaagattttatctttgaaatatagtacttttgcaaggtacttcaggattacttgatatgggtcaattgttttgccttggtactcagtgagtcctttcaaaatgtasattcagaatttttattatctctggcaaagtgtttttttttaagattataattttaaatattaattctgttattttttttctttttcagggattcctattttatgcacattggatcttctttgcctgttttacattccaatcattgtgtctctaaacctcttctttctttatctcatttttattcttttggttctttttctacctttctttaataccccttttaaaattttcattcagtaattttattcgaagggcaccttgcaatttagtcttcacrtctgattatttttgctctcttgatttctttcctgttgtcaatcaatcctgatttcttttgttaatttataactttaaaaaatttataatttatatttatatttcctatcttcaaatgcttctcttgagggtatttaattcattttgaagtgtcgtgttgtttccttttgcttcatcatttatatttctttgtcggtaatttttgccagttgaattgttttgattttcattttctgtttttagtacttacagattacttgcatcttcttatttctttggacaggattggtgatttgattttgaggtagcttgcaagattcctagtacaagagtaccctctctgttagaattacaaagtatgttttcttagtagatggccttttggtgggagggcgtgcatgcataggaccagtatatgtccccaaactatttcgagatatgttttgtagcagcctaaatttttctctcttcttttcttttctgcctaaaaaagaagggtcttactctgtcacccagggctggagtgcagtggtgtgatcatggctcactgcagcctcgacctccccagcacaagcaatcctcctgtcccagcctcctgagtaaatgggactatagacatgcaccaccatgcccagctaattaaaaaaaattttttgtaaagatggggtcccactgtgttgcccaggctggtcatgaactcctgggctcaagtgatctcgctttggtcttgcaaagtattgggattacaggcgtgagccactgcacccagcccctcttatttctttttttctgttatttcacagtttccaaaggactgctctccccttacttttttttttttttaagctaattttctccgtgaaactttccctttctacactacctcattgaatcatcctctctttcaagtctttcccttataggctgctctgatctaccaagaatcttttccagtattttcacacttagggtgttctttctctttctgttgttgattttcgtttacttttaggcctgccattaacttctgcttgctttgttccaggcagttttttttctatactgttggaggtctttgtgaagttttgtgatacaagcatgaaaatagttatctggaatttagggtttatatttctacttatatataatttgaggtttagagattctctgttttgaagttaggcttaaagcatgggttttggtcccttgttgtttttttttttggatttgggttgggagattcagacttacttaggcatcatcaacttctctacccagtatttaaattggctgtattttgtgaatgttttctggtaattttttcttttgtgtgattataatccattgtagaaaggttaaaaatattctacacagatatttgtggatcatatcttaattattacctttttttggtcacatgtaattcttcattgaaggaagacaggtacatttctcccctgccccccaccaccaaatttttaatgtcagcattggcatttaaaatcaatagaggatcaaaaatcactttcatttaaaaaatctcccagttaaatgtaccaggtctaatttatttccacattttgaaaaggaatttatttgttgccagcagcagttttttgggatcaytattacgatgatgacattggtgttgctgctgatacatatacatttgaaagatgttgatctattaaactttcttcatttaacctctgttgattttgaggcataccatctgttgcttcttttaggctagaggatattttctttcaattgagatctcaaagaaaattagttccataattctcattttaaggaaaggtggaattataaatatattaaaatataatagaatggcttttctcttttactaaagaccagtatgtgtcatatgaatagttttttcctaaaaatagaacattttagtgttatttaggtaaaagatattacagaaaccttacaactgtagtcagtgaacttaaaagggggcatctaatctatattctgtcatctccaatcaactgttaccatttttctttatatgaatttttattgtttattcttaaattttataccattttcatctaccttctcaacatgtcctaaacactttcctactttactacaagccttttctaatgttcacgtatgaatttatttttaaaattaataagtttctcttgtttttctttaaaatgtagcaatccatatttgttgacattcttttctttagaacactttagaagcagagtggtatttatttccttttcctttcaagttaatcctaaataaatctttttgataacatcgaactttctgatagaaaacagagtttcttaggaaaacaaattaggtcagtgcctgctgaaaaactgatttatgtatatatttttgatgacataaaatttcctctttttgatttttgctataaaattatgtttaatgaatagattggtagtgtatagctaaaccgtagggataagacacaaattttaagttattgatttaatgttgataaaagccccaccgttatgtgcaaaaaacacacccctgagtttgtacagatgttttattgtgatagatctattatccagctattagaagataaatgactgatctttcccattttccatgcctcaagaaaattgaaataagaaggggaatatcatttgggctgtatgattagggaaggttggatggccattaatttaagggaagaaaatcttggcagcattggccaacttataccatattatcaatcaaaccttgatgcacttcttgtgatgacccagcactctcaggtttttgcaatgttaattagaattcatgacaaaatagatgcaaggaaacgttttgtacccttcataattttatagaaaatttattgttattagaggaaccatttgcttagtgtgatttttttcattaccagcttgtcaactagcatagataatctagagaaaatatgaactccatagatggggtgtcacttttgttgatggttcatgtagtttaccttggagcacagctaatggctgaagttcatagcaacagcacagaaaaacgtggcaaccaagggaagataaatgaaccatgtttattgctttaatataaaaaatacataaatggaaaactgcatttgaatttgatgagctcattgctggttttgttggagtgatttattttttccctkatatgaaaagctactattgacacagtgagatggaagttaactgtctgttttttggaaaccagtatttttggttttaaaatctgagtagatcatttaattttaattctgaatattttatagaatattgaacatttaataaaccaaaattattaattttccttgtagtgtttagcccagggtcagattgttaaaactatatgattaagtatctaaaatgatcagttttattttgtaaaagtactctctttatatgctttttaattattttgatgttttcttaaactttatttggttctatttaattaatgatatttgttagtaccttagaaggtgttagtactttagaattattgtgtacatgtagctcttggtttaatgaatttaatattatatggtagctgattttccatttaattgtttagtatcaaaacacatttggaagaaaataattgctaagacagaataacttgattttacatagtattttaaaaattgaaactgtgaattacctgttcaatttcatggatcattttatcctagatactatcctttatttttgcactttaacaccctttaccaattgatgttgatattaatataaggttgataatacatatatatagatgtttatatctcacaatgagttattctagagtttaatgtcataaacttagttgtaagatattttaaaatgatactaattgtcactttatagaaatgtaattatcacaaaatgtaatttctaaagaaattatgtcttttgcagaagacatcaaaatgtgattgaaagcatgagcttaacttccttgccatatctataacaaataggaaaattatatatatannnnnnnnnnnnnnnnnnnnnntcaataaaatgcagcttcacgtttaatactgaattggtaattcataaaatcccccacaggacttgaaaacttgtttagcataatagcgagtctatattctgagctgttttctttcaattgtattgttggttgcatattaataaactaaatgtcagccaactagagggacaaacactcaaaatatgaatatcattgtatctaatatttttcaaaaagtaccatttcagtaagttatatttctatttaattgcttattttaagtcattggggaaattttagacactaaagtgaagatccctagtgttcagatagaatatggtattaatttgtttttcaaaactgtattatattgtgggctaactgcacatatatcatttgtacgtatagagaagtatttgtataatatatattctgcttagtttgtgtctttagagtaaaggaatctcaatgttaccactttgtaaaagcatcacagttcagaaactaacattatgattcattaactggtgttggaagagcccccttttgttagtaatatattattccaacttatacacattgttatgaaagtgataagagcccaggtgatgttctaaaatttcagccagtgtgttttctttgtaaataaattatattgggtaaaaaccggtggattaagatgtatatgatttgaaagtgttcttctattaaaatttatgaatttctcatatactttttaacataagttcattttagaatgattgtcsttctcattttaaactgacacaatgtgagctttgttattgtcttgattctttttctgaatattatgaacaaagtactgaatttttagattagaatttaggttagctttaaacatgaaaaatgtgcgtgattaatgtttaatccacatatgaacaatgtgttgaaatttaacctggtgaaataaacacatcagaatttacttctcttcagaatagtattttctagacatattagaactattaaaattattctttgacraatagtcaccataaagtttgttattcaaacatgaacattcattttaattgaatgactgaatactttaataytgattggcatgaaactgattactrtaatgcctgagtaagacctttgatgtaggggagaaacattttttaataagttactatttctttcttttctagttggtagctggcagtgttgtgatggcttttgaagaagtatgcccggacagaatagatctgattcataaaaattaccgcaagctrtgtaacttactagtggatgttgaagagtgggggcaggttgtcataatccacatgctaactcgatatgctcggacacagtttgtcagcccttggaaagaggtaagtgttgaacagtcttccactttcaagtatactaagagaatggatgagctttttaaaacttgggcaaaaaattaggagtagtaaactagagaaatctgcrtatttaaggaagactcatttgtctcttgttcttttactaaagcaggcaaccaatataaatgcaagcataattatccattattttggcactgattgatrcatatttattggtgtaagtatatacacttttagtttgatactggcaagaggcccttgttaggaggagcagcatgacacagtgtttacagtgacattgccaaaccatggatttttttggttactagttactttcacgtctttgagccccagctattccaggtactcatttgtaaaaaaagtaggtgatgtgctcctatagcatgtgaatttatacctaaagtaattaatttcttgcctctatagataaatattgttgaacttttaaactactttttcctagttttgtatttataaaatgtttgtgttcttctcttcactttagctggtagcatttagtaaaattaataatttaagtgaagctatttgttttctttgtgcagattaacattagaagtacgccttattcttttttttaagtatgccttattcttttcatcatattgacaatttaraaaattttatcatataacttgtaattaagatccttaggatgtatacatttaagatttaaggtaattttaaaccagtttaaataaatccttaaatgttgtaagaatagcacattcattctagtcttttgatgkcttatctttttaaaatacagtattatagattttaaaaaccaatttgtgtaaaaaaaaaaaagatttttaaaaagctcctgttatatcaaagtggtctgtatacatacttatgacaggccttgagtgctcagtacatcttgcttttgttaattagaaaaatgtaaataacatggaaaaatgtatgatacatgctttaaatgacacatcaagcttgcaaattattataaaatgttgatcactattttctatattgatttagtattagcattaaaaactgtttagaaattttaatacttctttatccacaagacagtaatactgattttcatctcacttttaatattaacaaaatgatgattatgttatccatcttaaaaattgaartatgttttgaattattaatatgtaagtcttatgttacataatgctcttaaattgatgaaattttactatccttgtcaactttaattttataaagttaattttatttatcattgagcaaagtacagttttgatggcacttttgctagattaaggaacatctctatgatgaaaatgtcctggcccttttatgataactttgatgagagatttttgttgccaaacagcttatttgtttgatttcagccaattcctttcaaaacttctgctcagattttttttctattgtataaagttataggcaattttgccttagctaatcactgtcaccatttaaatttttaaattttactttcctatcattttcagtaactatatgcaaatgatcctttgcttgtaattatatagaaactggagttaaaatatatagtgtacttaccatacctgctaaaaatatgtaacccgtagtaaaatctctgcttttgtatatttgtctgtttatttgtttttctgttccttgaattttatcttattttagataaaatttatttttaaagccattgcaaaggaaagttaagttttacaccatcatatacatttgttttttgacagataatttgaaaaattgggactgtattcattcttggtgttttcacatgttaactccatgaacatgaattaggacaaacatgaggtgaagtctggtcattgtccctggcatactggaatgggctaagtcatttcttttctttgccacttacttgcaatccaaccttggaattattcgaaatgctgtgctcattagactaatttagtggttttccagtgtgcacatcagccctcaggatgtgctagcactgccacaggaacgagccaagcagggcaggggtgctctagactgtgcagctttttgggcttttgccactgtttcaaacacagaagccttttttgccttcctttcttatgcagcgttgaatttgatttcctttgagaaagatccattggcttaaaagacagatagaaagaaaaccactttaaatagaagatttataagtttagctaatttgattcctattattgttgttgttgttttttaattatagaagcaattcaagtacatgttcccttctcgtaacctcttggttgacgccttagaggcaattattggtaactgtttaatttcagttactctggtggttataaattttactttgrataaaacattttgctttatttattaatttaagttgatatcagttgacctcaattcaaggaaaaattattcatcgattgtgtaagtgctatttgagggtctcgtttagcccagaataatcagtataacaggcttttgtctacatacgtacatatgttcagttcagaagcagtgtgaaagatttgaaaggctcagcccttattgcagtattagaatcaaggattgtacaatatgttagactcttgttataaatatattttataaaattaagattcaaatgagtggtcaacactaggaccatgtctgtgctctcactcttccagttaacccatctcaggcttcctctgtgctaattatgattttgttttactgagaaactttggagtgagcagtgtagccatttatagtcttcagtgctttctgatctaggcttgatgttgcttccaactttttagygactacacatggtagttttagctttagaagttggcagacgaggccgggcgcggtggctcacgcctgtaatcccagcactttgggaggctgaggcgggcttatcacgaggtcaggagatcaagaccatcctggctaacacggtgaaaccccatctctactaaaaatacaaaaaaaattagccgggcacggtggcgggcacctgtagtcccagctacttgggaggctgaggcaggagaatggcrtgaacccaggaggcagagcttgcagtgagccgagatcgcaccactgcactccagcctgggtgtctcaaaaaaataaataaataaataaataaaaataaaagaagttggcagactaaatctcaaagcagagtttgaccatagctagaagaaactgagaagtatttggcatttatatttgcttgctctttcttatgtgatgttgtaaaaggaacaccatgtagtaaagaaaggttaagatgattatagaataaaaagacaaggtgaaacagtactctagcagaggcattcctgagagtttacctctcttttttatccttttaccatcaacacttgaatgtgttgtttcatggaatcatccaagtagaaatgtcttcaytctagccctccattcccttttacctacaggcagaagtcacttacataaatgctatataagcaccattttatgatgaattaagggccattttaccttgaagtaaagaatttgccagtaggaaaaagtgtcactaaaacaatgtatcgacataaaagttaaatttataattaaaaaaacctgcctgtaataccgaattcatttaaatccagcagttttctctcagatactaagagaaaatgtgaaaaataatactgtgatgctttatayttaatggcttatcatttttgctgtactttcttttcttctttgttttccttttttgggatagagtctgtctctgtcacccaggctggggtgcagtggtgcgttcttggctcactgcaacctcttgcctcctgggttgaagcgattcgtctgcctcaacctcccaagtaggtggaattacagacatgtgccaccacacccagctaacttttgtatttttagtagagatggggtttcggcatgttggccaggctggtgttgaactcctgacctcaagtgatctgccctcggcagcctcccaaagtgctgggattacaggcgtgagccaccatgcctggcctgtactttcttacatagtattccatttgccatagggcaatcagaattattatacccattttatatatgaagaaattgatatatacagattttagcaagtcacttaagacaatattaattataaaaggtggagcagaaatataaacagaattatctgatgcccaggccagcattattgcctttatattttgttaccctgtgacttgtaaattaaaataatttcttagttaccttaataagttttctgtgtttgtttattgtgttccggtcaaaaccagctttgaggctcccaatccatagtgctcagacatgcaattagctaacaaccataattaaatttgctctcaaagagaaaaatcatgtttcctattgaatttttgcaaacatttgtttacgttaatatgcttgaagtgtggcaaaattgttttttgttgaggaatcgaaaattcgtagatacactttttgagatgagctgatgtacatgcttttgtcaataagttctcaaatgaacacatcatatacaaacaagcttcttcaggggcagaagagatttttaatttagtttatttgcatcattatagatcagtatttaggctgtttatatgtaaatgtatgatttgaggaacaattaagtgttgacaaagtagattgcagtcatatcaattgcagtgcattttccataatttttctaactgacatctttgatgataaatagtggatgtcaagtcaaagctgattatacagtgcactaggaattcatggggctgtcagggagaagaccgattgactttaaatttacatattaatgagaagatttgttaagagggtgcttgactatagaaaataacggcgtatttatagggcacracattttataaataaagctgatgcaggaaaatggaaattaaaccttttaggttaataaattcaagagactgctaaaatgcacatttgcatttttattttcttaaatttaccttactctttgcagtccatgtgggttgttttttattctaggtcaagtttgtataattttcaaggatataaaattgtttaagtattttatttgtcattcaagcctattatgggagatttcttgaagcataaacctagatctctaagactaaagttgcttttgtaaaattaatcgatttaaaaaaataaatattataaaacacagagtaaattttaagagtgatttaaaataaaaaccaacatctgttagtggcatcaattgtaaactgaaaggaaactctgacactggggcctgctaggaatgtttttaattgcatgaatctagctttttacaactgaacttkctctgggagatgagaggttttcaagaattatcaaaatattttacttcagtgatttggaagttaaaactctaaatatttaccattattttttagaatatgaatccgggttatgtaattctggtggcagtatttatgccagtttaaaatttggagtaattaattttgtctctctctgtatatctgtacatcaattataaaaccttacataagtttaacaaagtccaaatttagaattttgtttaaagtatttttaaggtaagttcttaagtttttcagtggtagccataaaataacttatcaaaatscaaaatttataaatgtagttttttgatgagcaattttctgtaggtacagaggtacttcagggaagtacttcatgaactccacatccagatcctgtcttaacggaccaaaatgttagagattattgagttttaattttctttactgattaattttctttgttaaaacaaattttgtcatgtgtcttaccaatggactatagatccacgattctgtggaatttattaaaaaaacaaaatactgagaagttgtggtagaatacattctttacaatgcaataagagcagttttttgtgcactgttttaagtaactgttgacaaaggrttcaacatataatttaaggtgaaactaaggaccatgatctaatattgaaataatgtctcctctcttcccattggttatgaagcatttatcgtaaagattccgtattctttttgttgtttataatttattcctattgattggaattttttttaactcatgaagttttcttttttaaaaaagaaaactttaaattttaccaaggaacatatgcatggtttaaaagaaagaaaatgaatagtactacaaggcttatgagaaacatttttctgagtgacccttctcaatgtctgaattagcttcctcagttcttttcccttctgtgtgtgagctcaaaagtatctgagccaggtctcaatcaatttagaaagtttattttgccagagttagggatgcacctgtgacatgtgcagcctcaggtggtcctgatgacatgtgcccatggttgctatagcttgcttttatacattttagggaggcataatacattagtcaatacctgtaagatgcacattggttcaatctggaaaggcaggacaacttgaagacggggcttctaggtcatagatggatttaaagatttctgattggcaattaattgaaagttaagttgttatctgaagacctggaatcaatagaacggaaatgtctggattatgataaggggttgtggtgactaaagttttatcttgcagataaagcctccaggtagtaggcttcagacagaatagattataaatgtttatcagacttaaggtctatgttgatgttaatgctggttggcttttcctgaattccaaaagggaggagggtgtaatgaggcatgtctgacccacccttcctatcatggtctgaactagtttttcaggttaactttggaatgcccttggtcgtgagaaggggtcccttcaggtggttgtggggtaagaattttatttttggtgtgtgtgtgtgtgtgtatttacctttctccatttctaggtaatagacatatattgctatttcttgatttatcaattttaggcattatgtattgacttcctattatagaaatggagaatttgtcattcttctattaccttatgcttctgcttacctctttcatctttggaatataattatattagaattttttcaatccataggtgttcattttcctatgatttatgaatattattcagctgtataatagcatttcatctcttgtggaacttttggttctttttggaatcaaaaattgcttcattttaaatttgcttactttatcatgtcactatatgaagcattccaagttctccrttggaatattaaatattctccaaatattattttatgtgcagttgttgtgatacttcttgtctacccaatgtcagttctacccctcccacttatttaaataacaggatcctgattttgttcagagtagttatatgccyaatgaaaaataatcaacrtactaaattcctttagagtcagaaatgggtccacatctggaaattgggattctggggaagctattgtttttctgacagacttatttgacatatgtatattttaccctttgccctttctcatgattccttcccagaatgcatgtgtgatgattagaggtgcagtagtcatgttacaagcataaggataaaactatattctgggggtgggcagagctgaaaaacaaagtgtttggggcaacttttcattttatggagctacctaactagatatttctgttatatatagctgaacacagttctgactagtacagttgtcaagtatatcaagtatttcaacagcttcattttcttcccaggagatatgttcctggagtcttcaccctctgttctaatctgattgcttactaggcctgcacagttccaatctgtttttctagaacttaatttcatgtctcttctgtgttraatcctatttcttaggctttcttcttctctctctctttctctctctgtctctctgtctctgtctctgtctgtctctctcctttcttttggttttcctggctttggagcatatcctccaatgttttcttaagagtgggtagatgggagataaaattttgagactttcagtgtcactctcacacttgattgatattttacctgggctcttggattagtattctcttaggccttgtgcatttgaaaatggtttattgtttcttgtatatttgacatcttgctggttatggtactgttgggacacacccttttcttcttttgagaactctgtagacattacttaattttcttctgcaatgaattttgctgtgaagaaatctgaagatagccaaagatttttctcctttgcaggtgacttgattttttttttctgcatgctaaaaaaacctgtttaaaaagtctttgaraattaatcaggttacatctcaacgtgarttattccatatgatctccaggttcacttcttccttttattttagggaattttcttttctttttgtaattttaaaaattcgatgtttacattttttttctgcttcatttgtaagttatatacttgaggaatacccgttattctgttttataatctttgtctaccatgtccatcatatttttagaaaatttctttaatgtttgtccttttttcttttttttgagacaggatctcactctgtcacccaggcttgagtacactggtgtgattacagttcattgcagcttcgcccttccaggctcaagtgattttcctgcctgagcctcctgagtagctgggaccacaggtgtgtgccatcatacttgataatttttttttttttttttttttgacactgagtctcgttctgtcacccaaggtggagtacagtggcacgatcttggctcactgcaatctccgcctcccggatgcaaatgattctcctgcctcagcctcccaagtagctgggattacaggtgcctgccaccacacctgcctaatttttgtgtttctggtagagacggggtttcaccatgttggccaggttggtttcgaactcctgacttcatgtgatccacccgcctcagcctcccaaagtgctgggattacacatgtgagccaccgtgcctggcctaatttttgtattttttataaacacaggatttcgccatgttggctaggctgatcttgaactctggggctcatgtgatcctcctgccttgacctcccaaagtgctgggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgtgttcttagtaacgtgttgagtgatatgcttttgacacttacatatagtccgtttatatgtgaggagtgtggtcaggggagaaagatccttcttcctccttgccctactggctgttggaggtaatcaacagtctctaccacattctccataataacctaaaaaatttttgaagacactatgatttggaaagaataattgtttcatctgttaagatatatactattcatgtatatatatgtggtataaatattagattaaaatgaagtgttctgacaaaatttttttatctcaggagtacacctcctgttccctctagattttgaaatggtctattttagtttgatcacaatgtagtatattttaattcattaaaatagatgtctggtaggtgaggaaggcctgatacattgtaggttggaagctcttaattaatttataagtgaaataatggaccttttctcattctcatttattaggaaatacttcaggctgtgtcatctaagttgctgattcattccaatttttaaaatttgttgtggaaatgttcacattaaaaaaaatcagctcatactgacctttgtgaaaygctttaaagaactctgttaaaaaatgttagttaaaaataagttttcttgggttgatgtccttcagaaacaccaatttttcttagataagtaacttcatacattttcatataaagtacatagaaaaaccattcctagtrtagtagagctatattctgaaaaaaaaaatttttttagacaaaataaatcccctttcctcttcaccctccatccccatgattctgtgtatgtcctgctgaaaattcatgtacttgtctagcatggggcttatagtatgctgtatgtaagcactaggtratggtgctggttagttatccatttgacatgctgaccattttctaatttgaacagttctagccatgttgttggaattaaaaatttagggccagacattgacctttgcttttttaacatttcctttagtggttagctactgccttcctcaacccagtggagaccttgacagattccctattacaagtaattgcttccagagctagttgttattcctgttaatttatttaggggccagtaaagtttagtgcctatatatataaaaatatatatttgtgtgcgtgtgtgtgtgtatatatatatgtatatatatatgattccatctttaaaataatgtatttattgatttaatgatttagtttttatttttatacattcagcttacttagtaaaaggcaaaagatttatacagtctgaagagaaaccagagcatgagcttacttagaatataaaatctctttagtgagtttatattagcactttctctcactttctgtttcctaaacatcctttttgtgtgactagccttatttttgcatttcttataattttaaaaattgtatctttatgtcgtatattgttagtgaacttttattactgttttatgtcattttgggtttcctaaattttcaagtttttcactgtaagtcacagttccaagagaaacagataagttgtttctaatccatattttccccaacattttattttaagaattttgcaaatggaaagtgatatcagtaaaaatggcagagtagagaactcccaagagcttgttgctccacagagatacaagaaaatctgtaaaaacagtccaatcagctttttgaattcagaaaatagtcaaaggtttacagcaaccattcaaacatttaagaaaatggggcctgaaacycaggagaaaagatttgtggcatttaaacttaccctcactctatcctcccttctctgcctcagtgacaggggctggatggaacagagtagattctgttcgcaaagaggtgtgattatttgttttgacctgcctggaggatccctaatgcaagggacatgcctttattttgctgaaatcataactccctcagaacaaattatctactaatgccccttggggcaatagatatcaatgggagtaaacaatggacatgccaagaagcctggaacaaaaggctggaggatggaatgctttggggaataagggagttgagaagctcctgtggataatatgggatctagaaagtccatttcatgcgtagggttagacacctactcagaaaagatctgataagaacctaagcttttatgtcagactgaccttcaagctctgcagaagaggaagtgatggctaaggcaaatttttaaatggcccagctaagttttaggcaaactgcaagctaacaaaacagtaaacacttccatgaccacatgcaacaaagaatgtactcttttcagaaatagcttagaaacgactgtaaacaaacaaacaaaaacctgataggcagcaacaataatccctggggaggagttagaatctgagttagttaccacattataatattcaaaatgtctagtttttagcagaaaacgatgaggaatgtaaagaaacccataaatttgttccatccacaagaaaaaaagaaagtaatggaaactgtactcaaggaagtccagacattggatttgctagcccaagggttttaaatcaccatgttaaatatgctgaaacagctaaatgaaaccaggaaaacaatgactctccaagtagagagtatcagtatgtatagagaaatgatgcaaagaaaccaactagaaatactagagggaaaacgtataataacttaaatgaagtattcacaagtagcaatcaacagcagatttgaacaggcagaaaatgaatgggtgaacttaagtcaattgagattatctagtctagggagtagaaagtcaaaaagcatgaagatgaacagagctcaagagacttaagaggcctgtgygatgacatcaagtgcaccaacacacataatacatattccaggaggaaaggagagagagaaaggggcaaatagaatggctgaagaaaaaaatggctgaaaacttcccaatttgatgacacactaatcaacacattcaggaagctcatcagaatctaagtaggagaaattctgaatgcacaccaagacacatgatatggtttgggtctgtgtcccccccatatctcaccttgaactgtaataatccccacatgtcaagagtgggaccaggtggagataattgaatcatggggggcagttttccccctactgttctcatgatagtgagtgagtttcacaagatctgatggttttataaggggctttccccttcactctattctcattctctctcctgctaccctgttaagaggtgccttcctccatgattgtaagtttcctgaggcctccccagctatgctgaaccgtgagtcaattaaacctcttttctttataaattatccagtcttgggtatttcttaatagtagtgtgagaatggactaatacagcacataaagatcacattttcaaaagctaaggacaaaaagagaatcttgagagcagcaagagaagtgactcattatttacaaggtttcctcaataagatcaacagctagtttctcattagaaaccatggggccagaaggtagttgaagaaccatgtttgaagtgttgaaagaaataaaaaagtcaacaagtaagttcttctttggcaaaactttccttcaaaaatggagaaatcggtacatgcctgtattggtataaacagtccaatgttttagatgcatttcaaagtaagatgcagacatcagtacacattacacctaaacacttcagtatgtatatcattaattagaattcaatatttgtttatgattattttccttttgttgacataaaattttcacagtgaaatgcacaaattttagagttttgataattgcatgtatgttagtaacacacacaaacccttttcattatatgaagtattactgttgtgcttccaagttagttgtttgccctcagatgcaagtattgttttaatttttttcattatagtgttgtattcaaaaagtaaaggatttgaggtattaccatactcctgcatttatacacacacacacacacacacacacacacacactgaatatatggcatatgtttagtgtatgtacacacacaaaagcagaaacactgatgtgtggatcagagaagagactttttatttactcatggttatcttagtgtcactttcctgcacttcagttccccatgagggtgatgttatgagggttagtgccatctgtatatcttgggggatggggagttgtaatacaggagaggagctcctcctaaataaatgaatctcagaatttatataggattgtgtatgtagtccattttcatgctgccaataaagacatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttcagtgttattttgctgaataatagtctattgtatgaatattccatagtttatccattctcatattaataaatactgggctatttccagtgttttgcctattgtaataaatctgttaggaacattcttgcacaaatctttttatgtttttgtatatgttgggtcaatacctagatatagaattattggatcataaggtggatatattttggttcygcaagaacctgtcagtctttttcccaaagtagttgtattattgttttagtttgctacagttgccatgacaaaataccacagattgggtggcttaaacaacagaaatttattttctcacagttctgatrtctagaagtgcaagatctcaaggtgttggcaggtttggtttctcttgaggcctctgtcctttgcttacaggtggccatcttctcactgtgtccgcatattcctagggttttcctgagtatccagatttccttcttttattaggacactagtcacattgtattagggcccaccctaatggcctcattttaatgtaaacacctctttaaaggccctgtctccaaatatagtcatatttggaggttaaggcttcaacrtaagaatttagggttggggggcacagtttggcccataacaaccaagctgtaaaccttacagtgacatatggagattttgtttgctccacatcctcaccaacatttggtaacgttaatgttattcattttggccattctgttgggttttctgatattttaaaatgagttctcttagtggtattctaataaagaattattcaatacttttttgttgttgtttttaatgaggcagggtctctgttgcccaggttggggtgcagtaatgccatctcactgctgcctcaacctcccaggaccaagtgatcctcctatctcagtctcccaagtagctaggactacaggcacacactgccatgcctggctaattttttgtctttttagtagagatggggtttcaccatgttgctcaggctggtcttgaactccagagctcaagtgattcgcctgcctcagcctcccaaagtgctgggattacagaataactatttaattctgagatggtttgaggttagaaaacttagtccttttatcctcaaaaaccataactagataattgaagggttagaaaaaaatcaaaaatcaaggttggagcctccttgaacccttctgttacacacccattccccttgtcccccctccccctgcttggcagtcacagattgcacccatttatgtttgaatgatgactcctgtacacccatggagctgtcatctttgcctccagtgccacaggtgtttgtgtaagcatatgttttcatttctgtagggttctatagtaagcatgtgcccttccccgtcttacctccagtggttactctccaaaggcaaacagatctcttttggctttgtcttctactggttatcttcatattttaaaaaataacttgtttatatgatttttttccccagtgactcagtgtatcctataatttagatacaagaatattttggaaataatgaagaataaatagtccctttttgaaactttatataaaaaccttttatattccaattatttctgttttttcttttttaaaatgttaagttggtgttttgtggagatctagttttctaccctccctttacctagaatataagtttttttcctgttttatgtattaagagttcttcatagtattaaacaaaaggaacttttaattaatcgccctccttcttaggttgtccacaaatattgtaaaacctctgctttaacccatttgtttttatgccctagaggagaattaaacatcagtttcaattcaacacacatttactttcctgtctctaatataaactttttattttagagattaaggtatggagagaatgaatacatgaggaatcatgattagttctacttaggatcattgtaattttgtttcataatttatgatcaaatgaaaactactctaaaatgaattttgcttaacaaaaaatgtttctattttcttccccatcactggatctacattatttagtttttaaataagtaggacccttatttctcatgtcttgaaacccttagacctaagttcaacatgtttcatgagcatattttatttcagaaaatttgaaaaatgctttattatagatcctctagatttctcagtacaaagtttggaaactgctgcattcagaaagcttgtttcttacatactagagctgaatctagtcataagaaatgagatgtgttgtgggcaattgaacactgaagtttcatagtggctcaacacaaagttactgtgcacaggtgtttctataattgtgatgtattgggggagattcagtgttcaatggtcctcaaacccacacttccacctgtgtagtatagtggtcactgggctgtgatataaaacatgtaaagtgtatagcatagcagtttcttcacagaaggaaaaaaaatctcaaaccagtatgcatatcctttgttgttttacatagacacaaattttggggaaggagactttttcttctttgtgaaaaatactaaattaaaagttttattaaacgtgaatttttttccagtgaattatctctaataatgtattctcttcctgcttagtaactaatttgactgagtgattattatattagttaccacctacccaccctggtcttgtcaggtacatctaacctaatgtcagagagatgtaacacaatatactgctgtggtatgtgctatggactgaatgtttgcatcccctctgagtgcatatttgaagacttagccccagggtgatgatatttagagatggataaaagttggtattcttaaaggcaatgcctcaggttactttagcttttgggaggtaatgaagtttagaggaagtcatgagagtggggacctcataatgggattagtgcccttctaagaagcttgcttcctctcttccaccatatgaggtagctgtccacacaccaggaggagggccttcaccatgaattgaatcacctgccccttgatcttggacttttcagcccckagaactgtgagaaataaatgtctcttgtttcaggcacctaccctgtggtattttgttataacagcctgagttgactagtgcagtgtcttagattatgtgggaatgtcatgatgtgttaaagtcacttttaaacattttgcaagagtctcaggccacagcaggttgcagagattgtttcatcctggtgtaaatcttgagatggcactagcacccttcaggctgccttggaattcagaaggcaagtgggtatattcagtgtcttttatgtgactactctaaatgccaaggtaataaaggtgagaggtgacaggataaagaataataattcccgagttcaaatcctggctctaccatttttaatctctgtgactattgataatttatgtaaattgtgtgcacctcagttctttcatctgtgaaaaagatagtaaatacctgctttgtttaccacatggggtggttctcaggtttcaaagaggtatttgtgcaagtgttttattaatactagaagtttcttaagctgaagttgttttttatttctactaagtccattgttactgctcacatgatacaaaagtagatatttttcaggaatgtttgattcctttatcaatttttatacataaaaatattttgctgtaggcagttttaactgtcattaatttcattttttatttttctattattccttatgaactgacaaaagatcatagtttgtgtttatttcttaggaaatccattcagataaaataagtctccctgtatcttaagatctctttgaaaagtaaatattaccctcagcacccaaaattgtgggttcagttactgacttattactatttttgtgaacatttatgtttagagcttcagatacaaaatatgtagaaagtactactacttaagtataatttcacacttttctttattccatgagcctgtggaatagtaccttaagagtatataaaccatgccttttccaaaatatacttcatggagttattttttgccttcataaagcttatatgtaatgtaacaacgtttgtctcttctgaaagtgaatgttttagagcaaagtgaaaagctatattttattctgattttttttttcactagcattagggtggttggtaaacatagcagagagagacctatttttatataagataggttcagatatattaaactcactgctttcttaaaaataaaaataagctttattttttggagcagttataagtttacggtaaaacttagttgaaggtgcagggatttcttatatatcctctacctccacacatgcaaaacatcccccaccatcaacattttacattacgatcaatgaatttacattaatattgttgtcacccaaagtccacagtttacattagggttcatccttggtgttgtacattcttcggattttgtctgatatatgataacatgaatacaccattgtgttttatcatacacaatagttttgctgccctaaaaattctctatgctctacttgttcatccctccctccccaccagctcctggcagtcactagtctttttaatgtctacatagtttgccttttccaaaatatcatatagctggaatcatacaatatgtaacctattcagattggattctctcacttatattgtaatatgcatttaagttgtctccatgtcttttcatagcttgttagctcatttatttttagcactgaatactagtcctttgtctggatataccacagtttatttatccactcacctactgaaagacattttgagcactttctagttttggcaatgaggaataaagctgctgtatccatgtgcaggcttttgtgtggacatcttttcagcttttttgggtagatatcaaggagtgtgattgctggattgtttggtaagagtatgtttactttggtaagaaactgcaaagttgcctttcagagtggctgtaccattttgcattcccatcggcaatgaatgagagttcctgtcactttatatccttgtctgtatacggagttatcaagtttctggattttgtccattctaataaatgtgttatagtatatcattggttttagttagcaattccctaatgacatggttttgaacatgtttttatatgtttatttgccatttgtgtatgttttttggtgaggtatctcttcaggtcttcagcccatttttaaaaaattgggctgttattgttgaattttaggaactctttgtatattttggataacagtcctttatcagatatgtctttggcaaatattttctcccagtctgggcttgtcttcaaattcttttgaccttgttcttttgcatagcaaaagttttaaattttaatgaagtccagcctatcaattatttcttccacagatccatgnnnnnnnnnnnnnnnnnnnntcttcccccagatcccatgtcttttgtattgtatctaaaagttgccataccccaaggtcaatctaagattcctatgttaacctctaaaagttttatagttttgtgttttacatttaggtctgtgacccattttgagttaatttttgtgaagattgtaaggtctgtgtctagatttatttttatttttatttttattttttgagatggagtcttgctttgtcgcccaggctggagtgcagtggcatgatctcagctcagtgcagcctccacctcccgggttcaagcaattctcctgcctcagcctcctgagtagctgggataacaggtgtgcatcaccacacccagctaatttttttgtatttttattagagacagggttttaccatgttggtcaggctggtctctaattcctgacctcgtgatctgccctcctcagcttcccaaagttctgggattacaggcgtgagccgctgcgcctggcctgtgactcttcgtttgttccagcatcatttgttgaacgactatcttttctccatcgtattgtcttggctcttttgtgaaagcagttggctgtatttatgagagtctgtttctaggctttctcttctgttccactgatgtttttctctgttatttcacaaataccacactgtcttgatatgtgtagctttacagtaagtcttgattatgggaaactttaaacatacataaaagtatggctgacagttcaacgaatccctatgtatacatcacgtagctgcactgttcatcagctcatggctgctctcgttttgctaccttaccccattccaagatttcatgtaaaattttagatatcatataatttcatttctattgagagtgtatttataaaacattatctttgctttaaagaaactgcaaagccttctccagtataaattggtccccatttttttaaattttttttttttttggtttggtccagcttaaatgtatatttttaaagaaactaaaaaaagtattctatggtagtatttcatttcatacatgtacatattttaaacatggaaaaataaaacattcatttataaatagaacattttatactcattttatgaaatagttttatcacatatattttagagacattttgaggactcctttttgagtcattttcatttaatagttttccattggaaagcatctttacttctgtctggatttttggagatacacattaccttggaatatggatacaatgctgtmatagaaatatgtttcagactttgagtactcattcacatgatttagcatagtcacttagaattattttgtaaggaagatctgtcatttctccctcatttatttatttattagttgttttaactgccttagctctagaaccagtcatgtttccatgtaaaagagcaggttttatggccttagaagtaatgttttctgtcttagatttcagtcagatggttctgtctttttgtaatagtaatagtattatattggagcaaagttggcattacttaatggttgtatagaaaaactgaaaccacaatataaaacattttaattagtacgaattagaaatcccatgtatgataatgcctcatttctgtaggctcaatagaaacaacatgtataataattgatttttttaaaccttttcatgcatttgtaaaacacatttttcttgtcccttggcaatggaaaatataatttttactgttttcttttaaaattgtgtcttttattatctgtataacaagaaatcagaatatcaagatggttgaaatgatatgcataatatactaaaaataagggcttcatacataaaataatatttaaaggcttcataacagccatgctagctacataaggggtttttctactttgtttcaaattcatagatgtattaattgagactgcctaatatcaatgtctagttaagaaatatatttgggccaggagtggtggctcacgcctgtaatccaggcactttgggaggctgaggtgggcggattatgaggtcaggagattgagaccatcctggctaacacggtgaaaccccgtctctactaaaaatacaaaaaattagctgaaaaaattagccgggtgtggtggcaggtgcctgtagtcccagctactcgggaggctgaggcaggagaatggcgtgaacccgggagcttgcagtgagcgagatcacgccactgcactccagccagggtgacagagcgagactctgtctaaaaaaaaaaatatatatatatatatatatatatataaaaatatatacaaatatttaaaaatatgtaaatatataaatatttaaaaatatatatgtaaatatataaatatatataaatatgtatatatttgaggatatagaataagctcagaagattaagcagttctactaaaaacagaatatttctaaaaactttcaaatacaaatggagggaatattaaaattagatattagaattctcttttgtgtatatgaagtatggttagtataccaagtggaataagtggaaacttactataaagtagatttcaaagtctttcaaattcatttatttttactcttaagcagactaaacattttccttaatatatcttgtttgtcttatttaactattctgtttctggacaaggagaaagtaaaattcatttcatcatatagttaacatgttaaataagaatgattacttttaaaaccattcagagtcctctcagatataaactttgattcctctacttaacttacttaagtatctaggctattatctctaacagaccacaaatctttatctgatatgtcaaaagtatcacaaaggtaaaatcagttaaattgaaatttttaaaatattactgaatttaaagaactctgtaagtggtcactgaaagtctagcactttatttaaacacaatataaaaatatatctgagttttctgaaaaattgtgttatgttgcattatctgccgtaaagctcgatcctaccacttaattccttgaacatattaatcatagttgttttatagtctgtcttagtttgggctactgtaacaaaaatgtcctagattggatgagttaaacaacaaacatttatttctcacagttctggagactgggagtacgggatcaaggctctgacagatttggtatctggtgagggtctacttcttggttcatagatagatgactgtcttcttcacatgatggaaaaaaggccagaaagctctctgaggttcattttgtaatgccactaattccatttatgagagttccgtcttcatgacctaatcacctttcaaaggccccatctcctatcctaataccatcacactggggattaggatttctttctttctttctttttttggagatagtgtcttgctctgccgccccaaggctggagtgcagtggcgcaattttggctcactgcaacctccgcctcccaggttcaagtgattcttctacctcagcctctggagtagctgggattacaggtgtgtgccaccatgtgtggctaatttttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaacgtggagaaaccctgtctctactaaaaatacaaaattagccgggtgtggtggtgcatgcctgtaaccctagctactcaggaggctgaggcaggagaattgcttgaacccaggaggcggaggttgcagtgagccgagatcgcgccattgcactccagcctgggcaataagagcgaaacatatactgcaaatgactatatattttcacaaactgaatacacctatgtatcaaatacctagattgagaaacagtaattatcagtatacttcataagcccccttcttgatacccttcacttaataatctgcttttccttacagaaggaaacagtatccttacccttagtgataccagcatttcctttctgataagttgttggactagtttgaagctttggatgatggattttgttctacttgtggttctagggaatggattcaacaatcttgagttcacttatcacctcaattatggattgagatgatttaagctgggcttttatctgaccatcgttactccccaagacatagattttatattttaaaccaaagactaggagagttagcaggattgtaatttttggcggatcctggcctcaccttttgttactgcatttttgttaacctgctgaaagctctactgagcttttaggcctctcagcttcctcttgtctaattaacacatcctttttttttttttttttttttttggggaaaagcaattccaaaagccaatcagaattctaggtttctagatttactacttcttctgggtcttgtctgcataattcatcactgtttttttagccctccagtgccttctaacaggtttcttaacttttccccagcttttctagttctcactgacaggcggttgttctaagttgtctgtttagccattcttagaaatagaactatataatcttatattatgtgtttttaaaaagtgttctctaaaggcttagttaaaaatgacatcttttatcactgtgatttgtgactccttttaagcatccataactagcattgattgaagttgtttcagtgtaatgagttccccaaacamtacattatggttcaaaatgaagcagttgtgtamgagcctcataatacatttataaatcctcaagtatgaggcaacttctttctgagggataattttaggggggaaactttttttcatatttggcatctagggatattgaatttgaggcatagtaatagtttcaattacatggcttctagaaagaaagtttcttaataatagaagcagtggcaatagctactgtttgtgtactttaatttgtatcaggcactaagtgcttgtataatgttcaataaactgattcaatctttataaacactataatgatatagttactgcttttatagatgagtaaaccaagacaaggaaaaaaatcaagacaaggaaaggttgagtgatttgtcatggtcatagagccagcacttatattgaactggtgtgtccagatacacccatatgctgtgtacgtatccattctgtttggactaatgcctgttctgattcattaaaaacctgagaaacatagtccacagtagtacagattcaaatatgttgttggagattcattcttgtcctccaagaaagcctcatctccttcatttcattaacctcataaaaacgtccacccttcacttgtcaattttttctctgcttggttccaacttagagaattatgcagttggtacatgcctatagctagtaactgggagagccggatctaagaagctgtgtcatgatgttctcatggcagtagaaccaaactgaaatttcataaaaagtataagagaatttcttctgaggggaatgtttttaaatgataattaacatgaactattttagctataagcaacatgttcttcatgtttgttagctcataatcccattataaaaactttgttatttcaaataatcccttttattttaggaaattacaatttctgtaatattatatgttaatttgtagaagttttattagtagcaatataagatcattgaatcatgtggaaaagatactaatgaaagaaaattactcttttgaaatctttttattattaatattttattagtttgcataatttttatttttattttattttattttattttattttattttattttattttattttattttattttatttgagatggagtcttgctctgtcatccagtctggagtgcagtggcgtgatcttggctcactgcaacctctgtgtcccaggttcaagcgattctcctgcctcagcctcccaagtagcttggactataggcatgtgccactatgcctggctaatttttgtattttcagtagagatggggtttcaccatgttgggcaggttggtcttgaactcgtgacctcaggtgatccgcctgccttggcctcccagagtgctgggattataggtgtgagccaccatgcctggccgcataattttttaaaactgtaaaaaaattcatcaataggaagcagttgcatcaattgtgaaccatgtatgttatgaaatattactaaattttaataagatagtgattcatcgacctttaattatagtcattaaaaatgccatcctttcaattaaatacatattgaagaaatacagtagtgcaagtaatcctctgtaaagtgttcatatttttgtaaatgcatattaaaatcaaaccatataaaaatgtttcttatggaagtgaactcaaaaacctatatgatggtatgttcatagaggacactatagaaacatttacataagtttaaaaatttttttttaaataattttattattattttttaagttccagggtacatgtgcaggatgtgcaggtttgttacataggtaaacgtgtgccatggtggtttgctgcacctatcaatccatcacccaggtattaagcccagcatccattagctcttttccctaatgctctccccactaaccctgccctgacaggccccagtaagtgttgttccctcgctgtgtccatgtgttcacattgttcagttctcacttataagtgagaacgtggtgtttggttttttgttcctgcattagtttgctgagaatgatggcttccagcttcatccatgtccctgcaaaggacattatctcgttcctttttatggctgcatagtattccatggtgtatatgcaccacattttctttatgtagtctgtcattgatgggcatttgggtagattctgtgtctttgctattgtgaatagtgctgcagtgaacatttgcgtgcatatatctttataatggaatgatttatactcttttgggtatatacccagtaatgggattgctgggtcacatggtatttctggttctaaatctttgaggaatcagcacattgtcttcaacaatgattgtactaatttatgtacccaccaacagtgtaaaagcattcctatttctccgcagcctggccagcgtctgttttttgagtgtttaataattgccattctgagtggtatgaaatgatatctaattgtggttttgatttgcatttctctaatgatcagagatgttgagctatttttcatatgtttcttggctgcatgtatatctttttttgagaagtgtctgttcataccatttgcccactttttaatggggttgttagtttcttgwaaatttgcttaagtttcttgtaggttctggawattagccctttgtcagatggacagattacaaaaatgttctcccattctgtaggttgtctgtttgctctgatgatagttttgtttgcggtgcagaagctctttagtttaattagatcccatttgtcaatttttgcttttgttgcagttgcttttggcaatttcatcataaagtctttgtccatgctgatgtcctgaacggtattgcctagattttcttctagggtttttatagttttgggttttacatttaagtctttaatgcatcttgagttaatttttgtataagatgtaaggaagggatccagtttcagtttttcacatatggctagccagttctcccagcaccacttgttaaatagggaatcctttccccattgcttgtttttgtcagatttgttgaagatcagatggttgtagatgtgtggttttatttctgagttctttattctgttccattggtctatgtgactgtttttgtaccagtaccatgctgttttggttactgtggccttgtagtatagtctgaagtcaggtagcatgatgcctccagctttgttctttttgcttagcattgtcttggctacatgagctgcttttggtttcatatgaattttaaaatagttttttctagttctgtgaagaatgtcaatggtagtttaatgggaatagcattgaatctataaattgctttgggcaggatggccattttcatgatattgatacttcctatccatgagcatggaatatttttccatctgcttttgtcctctttgatttccttgagcagtggtttgtagttttactgttataatatactgccataatcttaaacatttgtacagcaaaataagcaatacatatgtgtctttcattaaaataatgtaattgaactcagtatgttaattaacaatgaggaagaaatggaatgagtagatggttataaaaagcagttttttatgtacattttgatgattttgttagtaatagtgctatgtctgttaatacagcactttcattatgtatcactttcaggtagagtttgaacatttgtttaattaaccatgacttaagattgtaagtgagtgcttatgcttagagcatttaattatttgtgttttattggtttattaatgtacttaacagaactactttagcctggagctccataaaggaatagtcactcaagtccagctttgatataaaagtatatctcacttatagtctttttattaagcactaaaagacaagtagtgtgtttgttttgaattctgtattcaaaggaaggtgataatgttatgatttctagtttaattttgaagatgagtattagtagaaatacttttgttttcaaagagtataaattttgtgagttttctctgaataattttataagatttttttgcctgtggatttaaaaagcactgagctaatattattcctattctgagagacctaaaagttgtacttttgatgaaaggtgttttccagtgatatttatgtcaagatttaaggaaagattgtgtaaaatctgtaggcacctagcaagggaaaaatacttaagtgatattaacctaaaacattttagataattttctttattgttatgtataacaatgcataaatacaacaaattgcttttaagtgacttactgatttttatctccttagttttattcaattaaatggtttttaaaagataatttagattcacatgaaattttaagaaataattgagagagatctggcataacctttactcaattttccccaatggtaatgtcttgcaaaactctaatacagtattacaaccaggatattgacattgatacagtcaaaactgagaacatttccatcacagggaatcttcatgttgcygtttcatagccaaaccgactttattccacatgtttaaccttactcccaacccttaacccctggcaactgctaatctttctgtttccatarttttgttatttcaagaatgttatataaatggaattatatggtatataaccttcattgtagattatccattttgtcattctataatgtccttctctgttgtaattttctttgctctgaagtgtactttatctcatattaatatagttattgtgctttcccttgattaatattagcatgctatgtatttttccatctttttacttttaacctgcctttatctttatgtttatggkgaatttcttataggcagcacatagttgagtcatgggttttaatctactttgccagcctttgtcttttaatcagcatactgatttacatttaatctaattatttatttttaaggcttaagcgtcccatttagttttttgttttttgtttgttctctctagtcttcatttctcttaactgtgggttatttcaacattttttagaattccatctttgcttatctgcagttaatttgaatatatctctttttttattaattaaaacctatttttttgaaattttttagagatagggtctcactctgtcacccaggctggagcacagtggcttgatcatagctcattgaagcctcaaagtattgggctccagtgatcctcccacctcagcctcctgagcagctaagactatgggtacatacccccatgaatggctgagttttgttttattwttttacttgtagtagaggcaaggttttgctctgttgcccaggctggtctagaactcctggccttaagtaatctttctaccttggccttaagtaatctttctaccaaagcacgaatatatctctttgtgcagcttctttagtggatgctgtaggtattacattttacatgcataacttatcatcttaccatcacagtctactgatgtcctcatgttacacttcaaggggcaaactttttaaccacttagctccctttgatctcttttttctctccactttataaatagttttcttaggtatgtcctttacatgcatttagaaccgtatcaatgttataacttttcttcaaccatctaatataatttaaaagactcagaggagaaggaaaaactattatatgtactcatatttttccttgccatattctttcttccttccagatgtttgaagattccatcttttatcatttcctttctgtctaaagagcttcctttagccattctttcaggataggtctgcttataacaaatactctagttcccctttatctgaaaatgtcttgattttctcccccttcattcctgaaatatatttttgctagatataagattctcttttgatagttcctctccatcagttggtctactgtgttctgtcctccatggtttttgatgagaaatctgctgtcattagacttgtttttctgttattggtaaagtgtcatttctcctttcctgctttcaagatttgtttttctttgtctttagttttcagaggttttactataatgtgtgctgttttggatttctttgggtttaatcctgtttagggtttactcagcttcctcaatttgtagttttatttgccaaatttaaaaagtttgcagtcattatttctttgagttctctttcaactcttgcctctgtctcttctccttccaggattgattaatagatgaaaggaatgttaggtcttttgttgcattttcactggtccctgagactctgtttttttttttttgagacagtgtctcgctgtgtcacccaggctggagtgcagtggccaatctcggcttactgcaatctctgcctcccaggttcacgccattctcctgcctcagcctcccgagtagctgggactacaggcacccaccaccatgcctggctacttttttgtatttttttagtagaggcggggtttcaccgtgttagccaggatggtctcaatctcctgacctcgtgatccacccgcctcgcctcccaaagtgctgggattacaggcatgagccaccgcacccggcctgttttttagttttgattttttttgtccctagtctattttatctttgttcagattgggtaaatcttgttgttctgtgttccagtttactgattatttcttttgtccccctcctctgcttttgatcccattcattaggtttttagttttggttcttgtatttgccagtcgttaacagtttttatttggtctttatatcttctatttctttctttaaactttataatttttttttttttgagatggagtctcactctgtcacccaggctggagtgcagtggcgcaatctccactcactgcaacctccgcctcccagggttcaagtgagtctcctgcctcagcttcctgagtagctgggattacaggcgtccaccaccatgcctggctaatttttgtatttttagtagagatggagtttcaccatgttggccaggctggtctctaactcctgatctcgtgatccacccacctcggcttcccaaartgctgggattacaggcgtgagccactgtgcctggccttttttttttttttttttttaagatggaatkttgctcttgttgcccaggctggagggcaatggcgcgatcttggctcactgcaacctccgcctcatgagctcaagcaattctcctgcctcagcctctcgagtagctgggattacaggtgtgccccaccagccaggctaattttgtatttttagtgagacagggtttcgccatgttggccaggctggtcttgaactcctgacctcaggtgatctgcccacctcggcctcccagagtgctgggatgacaggcatgggtcactgcacccagtctagactttataattctttgctaaaaccttctatttctgtattttttaccaggatgttctcaattgctcatcgaagcattttttaatgatttttaaaaaataatcagatcattccaatatctctattatcttggtattggcatctgctagttatctatttttattcagtttgagatcttcctttctcttggaatgatgagtgattttttaattgaaacttggacattttggatactttgagactggatatttttaaaccttcaggttaactggctttgtttgataccactctagcagggaagggtggtggaaagagagaggggtgctgtctcatcactgccaggtcatagcaggagtccggattccctgcttatcctccactgacacttcagagggattttactcattgttaccataggtgaatgtgggatttctggctccccaaccgtctttctctgatagctgtctgctaggagggatacaaggtactgttctatgtgtgtccttccctgacaaccaccagggtgtgggcggggctgactttggttactactaggtgtggtgctgcaagtcctgactatgcactaggcctcctctgacatcatcacagtgaggaggaataaggtcaccttgacactaatggatgggcttagaagtccaagctcctcacttggtcttcactgacaatatcagaatgccttgttacctcttggtagagatgaaactctcaatcccatcttggccttttctgaaaccacctagtgaggtggttggggcatctcattacagcctaataagggtagaagtctaggatcaccatctcagcctctactggtggggatgggggtagggccataattttttatctggtgttgggctgcacttgagtagttacttctaaaagttttatatcttgctagactgcccctttcctggtcctttggctagagagagcggttctggtggtttctttcatctgcatttgttgccagcttctgcaccgagttgtggatatatgaaataaaaagaaaacccagggaactcactggtctgtctttctttggatcttgaggttcctatccagtgctcctcctttttgcctttcaaagtcttcttatgtttgttttatatatgttttacatgtagtgttctgcttttctagatctctacttagtgagagagatggggaaaagtacatctactccatcttcctggaagcagaaagtatgtttcagatacttggtaacggaagttacctctaaacagaagttgaattggatgtatgtggctattactgtgtttgtttggttttttgtttgtttgttttgagcactaaatgcctgtaggcatattttattggcagagataaagaattcaaaacaaaaacctagaatcagctcctctggatatttataaatctcaaactgagacgttttcttgacaactcagggacctacttaacaacactagttttttcgtgtcacactttactgtgatttcttttatgttactattcaaacaatgctcctctttttttgactctttgatctagttacagagtggctgacaatttatggaaatagttttcaggttttaggtagtattataggccttgttaaaatctaacggtcatgtgttccttttgaaggactataggtatttctatggggatttaatagtcaaaaatttactttgtaatacaatagaagcacatcatctatagcacagtaacttgttataaaatatgagaaaaatcaatagacctttattcgatataggttgtgtaatatttttaaattgcccaaacagaagtattctacggtaaaatgttgttatagatgtttaaaggaaagttttctttgactatataatatgcagattgctcaaggtctaaagtaatcttgggttggatttctttcattgtagggtgatgaattagaagacaatggaaagaatttctacgaatctgatgatgatcagaaggaaaagactgacaaaaagaagaagccgtatactatggatccagatcatagactcttaattagaaatacaaagcctttgcttcagagcaggaatgctgcggtatgttaaaatccttataagaaataattcactggtttttaaaaaacagcaattaaaaatatctcaatttagtaagtgagtctgtgtgtgctaatggagcatttgtttgtttacacaccaartgacatgtaatggatagttggaagtacagtgtggaatgtaagctatagatttagagacctaatgtctgagaagtaatacctaaatatatttcagccttccatgtttccaggtatacagagttaggttttgatgacaatacctggtttggcctattggacttcatttacgttttaatggttttgttaattggcttttcttaagatatttctaagttgtttctcaattggttggattatattagctcttatataagaactatgtatatttatcagttattccattgtgattgggggtacttgatctggtattagtccatactgtttgtatctgtctgatagaatttttaagagactaacaaaggtaatgcctcacatattataaatgtaaattggcagtaatagtaattaaaaatcatctttatttgggtcataaggttttttttgtttgttcgacacctttttgtttatataaccatttatattttagaagaatacatgtgcacaatacaaaattagaaattacaggctagcaaaactaaaaagaaaattaaaacatcacattctcaacactcagaaatcacttatgtcttagtgtattttcttccagatctttctaatctgcataagtgtacatatattcatggttacacatacatatatatatattttttaaccaagataaaaatcatactgtacatagcattttctaacctttttttctctagtcagtcctctctactttttattttaataaaatttcatttcatttaataccaattgatcttaaattattctttttggatgatttatccaaaccattatctaatgcattgcatcttttaaagcctgtcaagtcttgcagaatgtccttctgggtttgtctgattgctgctgcttctttttattttgttattttgtttgctatacctactggaatgggatggttgcatcttttatagtgtcatttaattcttttatattctgtgtttcctgttaactggcagttatatccaaaggcttgacggatttaggttaaacatgttcttaaagattttaattgagaaagtattcttaatgaattgttctgttcagaacaattcttaatgaattgattcttgagaatttagagcttacagctttgtatatccaagttatcaacaacaatttttgtctaatacctaatggtttagtttccaaatcattattcagtaatcatgcctagtcataatgaaaatattatttcatggctgttgtaaaatatgcttatattttaatgtactcagcttagccagatgctagttaggtagctgtaatttgccatcttaagctgtactttatgagtgactcactgttcatttaactaggtcttagaaattgattttatagttcaaatacttatggatcaaaaacgttttcaaatagtgaaacaaatagtggcagtttgtacttctggtcccattttgtttgggttccctgcttacttgatgctgtaatagaggtggtttactttttgtgtcagtgtattttggtaccttgttttgggatgctgctaaatatgagtaaaggctaacttttgaagaattgtggatagatttttttttaacctcgtacttaagtttatggagagactttgagaatttctttcaggaaacataatacatcattgctatgtagtttgtactggagatagatactgaaagcggaatgttaggaggctattctaacagtctaaataaggtgacagcggcatgaatggttaagagtagaaaagtgtttataggatgcgctttattatgaacaggcatgatgtaactgtagaaggtctataaggttgtatatttttagtctttttggattttgaagttttgggaacttttttcatggcgtttacaaattagcctatacatttcaaatctgggtatcaaagcgactttcaactgttggatttctaaataccgaggaaaaagaggctcatttagtccttttggattttggagtaccctaatatattagaacagatggcatgccaaatggcagctagaattttaaagacattgacatgtataggaagtacagtttgctttcttgccagtaggattggacttttatttgtaagggaaaaggatttactatctgtaagatagattaaaattaagattcagctttcttttctatcatttactaatacttattagccaggtatatgcgttaatatttttttaaatgactgatcttggattaggtcaatcattaattgagattcttttattttataagatttaaaattcaggagagtttattttgtaaccaacttatatttgcagttcacaagtgaagaaatgagatattcttgcattttttaaattctcaactaatatcttaaagctataaatcaaacttgtaagaaagtacaagaaatggcaaacagtaaatttaggaccctgtatactgtatttttaaaaacggttctttagtttcagaagaaacttttttttttaacctcaaacattcttctgtgctgtatactatttaggcatatatattaatagaatttttgctatatatttgttcaaacttcatagaccaggcagaattaaattaatattagtgtgtcctttgagccaaaggcagcattggtaacatctgtagctatgtctctgcagttgtcactctgaatctgagtgtagaggcacttaggggaaacagtactcttctgttttgagacaaagaaattccagtcaccctttgtttgttttgttttgttgagacagagtctcactccattgcacaggctggagtgcagtggcatgatctcggctcactgcaacctctacctcctgggttcaatgattctcgtgtcccaacctcccaagtagctgagattacaggtgtgcaccaccacgcttaacctaatttttgtatttttagtagagatggggttttaccatgttggccaggatgctctcacacctgactgcaagtgacccacctgcctcggcctcccaaaggggtgggagtacaggcgtgagccactgtgcccagtctttgaatcacccttataatggctttgaaccagaagccatttttaaggttctgtgtttttaaaaacaagattattttaaatgctactgctgtagatgtatttgttttaatggagtttctttaattgtaacttaaatgtgctgagttttctttatttcagcctactagttactgttatcctggcttcatttagaaaggcatgcttataattcttaaaaagccccagtctcagagcagcagctgaggagcatggaatttcgagtgtcttgagctttgccacgtactagctgttacaccttgagcagttcattcagtgtctctttttttttctgaggatgtattcttttcatagcactgccatacatattgccacaaactgagtggattaaaacaacagaaatttattctgtcacatttcaggaagccagaagtctgaaatcaaggtataatcagtattggttacttctgtacgctctgagggagaaaccttctctttcctggcttctggtgattgccagcaatccgtggcattgcttggcttatgggtgtatcacactaattatctccatcttcacatggccttcacggtgtctctttttgtcctttttttttctcttataaggacacgttcattcgatttagggctcttaaccagcatgatgtcatttcaattcttatattaataatttctgcagagatcccacttccaaataagatcagattctgaggatagtattgggcactgggagtgggggacacttcttcaactcactacgaagagtaacattccattttacgtcacaggaatttgtaggacttagaggaaataatgtgtaggaatggattttgaggttgtagagtgctctagtgttcatagttctgttatttttatgctttatcttgtaggtggttatggcagttgctcagctgtattggcacatatcaccaaaatctgaagctggcataatttctaaatcactagtgcgtttacttcgtagcaayaggtaggtcatgattttatatatattttttcttttgtattccttcaaaagtaatgtttgaacaaatgtaatctttcaggcatttmatatataactctgactatattttaatcaatcgatcagtaagatttcatacttaaggggattattataaaagtctttatgcatttatctcaaacttaatgataaatactgaaactttttaacctcaagcccaaagatattgaaaatattttgtggcataacactagagtgtcactagtagcctagtattagtgtttgaaatttttaggtatggcaataatgatgtttgggagttttggtaaatctggaatcactgaaaaactatactgaagtactatcagattgacttactcaatgtattaatacatggttttatatagagcaatgtgtatgctaagtaatgtagtttatgccagaattgtgcttcctataaagctggaatatttaattactatgctttgctccactctaaaaagagagctgtgtttttaatagctactcattttaaagattgcatactcttagtttcagatagacagacagaaagagcatgccaccttctttgattttacctctttataatttagtggtttaggttaacgattcaaaacaatttattgagtttccatgacatataacatgagaatcatgatttcaggtttaattcagacatttgtttctgtgtttaagaataccttcatttcagctatttgacataccttagctatttttcagtaattagttgttttaatttgaaacaatgtttttcattgagtgcttgtttccactaattgcgttggaaggaaaaaactatgtatttatttttgcccttaactggaacttagtccacaattgtagctcttgactggcttagtaacaaatgagatgccatttcctttgtgttcctattctccctatctgtatatccagctattatttttctcttttgctagttcaatactttttttttttttcctatggctagttcaaaagatatcagaaagacctggaattggtctttcacatgaagccttataccagattcagttcatttattagatatttgggtctaaaaataacatgactacttttaaaatctggcctttgccctgggaagaatgagttatttaatgagtttataataacagtgtggtcctatctacccctattaaccctaagaataccttccttggatgtgttcaaagcaggtacaatgttaacttcatattttaggagcactttattataaaatttgttttaactattcttcatgatgaatcacgtctaatttattggtattttataggaaaagtgcrttaaaaagacacacatctaagatttactaaaaacttttcattattacatttaagagtctcattcacttgaaattattgctaattctttgtcattattgtagtgcttactcaaagatgtttcattggaacatatacccagtaaaaattatcttttgatttctagggaggtgcagtatattgtcctacaaaatatagcaactatgtcaattcaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctggttcatctcactgggactggttggacagtgggtgcagccccagagggtgagctaaagcagagtggggcgttgcctcacccaggaagcacaagaggtcgggtgatttccctttcctagccacgggaagccgggacagactgtacctggaaaaacgggacactctcacccaaaaactgcgctttcccaaggtcttagcaaccggcagacaaggggattctctcccatgcctggctcagcaggtccaacgcccacagagccttgctcactgctagcgcagcagccttagattgaattgcgaggcagcagcctggcttggggaggggcatccaccattgctgaggcttgagtaggtaaacaaagcggctgggaagcttgaattgggcggagcccaccacagctcagcaaggcctactgcctctatagactccactctgggcaaggcatagctgaacacaaggcagcagacaactgcagacatcagtgtacctgtctgacagctctgaagagagcagtggttctcccagctyggtgtttgagctctgagaacagacagatggcctcctcaagtgagtccctgacccccgtgtagcctaactgggagacacctcccactaggggccgacagacacctcatataggtggttgcccctctgggacgaagcttccagaggaaggaccaggcagcaatatttgctgttctacagtatttgctgtgctgcagcatttgctgtgctgcagcctccgctggtgataaccaggcaaacagggtctggagtggacctccagcaaactccaacagacctgcagctgacgaacctgactgttacaaggaaaactaacaaacagaaaggaatagcatcaacatcaactaaaaggatatccacaccaaaaccccatctctaggtcaccaacatcaaagacsaaaggtagtataaaaccacaaagatagggagaaaccagagcagaaaagctgaaaattctaaagaccagaggacctcttctcctacaaaggattgcagctcctcaccagcaacagaacaacgctggatggagaatgactttgatgagttgacggaagtaggcttcagaaggtcggtagtaacaaacttctccgagcgaaaggagcatgttcaaacccatctcaaggaaggtaaaaaccttgaaaaaaggttagacaaatggctaactagaataaacagtgtagagaacaccttaaatgacctgttggaactgaaaactgtggcacgagagctttgtgacacatgcacaagcttcaatagccgattcgatcaagtggaagaaagtgtatccatgattgaagatcaaattaatgaaaaaagtgagaagacgaggttatagaaaaaagacttaaaagaaatgaacaaagcctccaagaaataacagactgtgggaaaagaccaaatctgcatttgattggtgtacctgaaagtgacggggagaatggaaccaagttggaaaacactctgcaggatatcatccaggagaacttccccaacctaccaaggcaggccaacattcaaattcaagaaatacagagaacaccccaaagatactcctcgagaagagcaaccccaagacacatctcacctgcagggacacacataggctcaaaataaagggatggaggaagatgtaccaaacaaatgcaaagcaaaaaaaaagcaggagttgcaatcctagtctctgataaaatagacttcaaaccaacaaagatcagaaggccattacataatggtaaagggatcaattcaacaagaagagctaactatcctaaatatatatgcacccaatccaggagcacccagattcataaagcaagcccttagagacctacaaagagacttagactcccacacaaaaataatgggagactttaacaccccactgtcaatattagacaaatcaacgagacagaaggttaacaaggatatccaggccttgaactcagctctgcaccaagcagacctaatagacatctacagaaccctccatcccaaatcaacagaatatacattcttctcaggaccacatcacacttattctaaaattgaccacatagttggaagtaaagcactcctcagcaaatgtaaaagaacagaaatcacaacaaactctcacagcacagtgcaatcaaatttagaactcaggctaagaaactcactcaaaactgcacaactgcgtggaaactgaacaacctgttcctgaatgactactgggtaaataacgaaatgaaggcagaaataaagctgttctttgaaaccaatgagaacaaagacacaacataccagaatctctgggacacatttaaagcagtgtgtagagggaaatttatagcactaaatgctcacaagagaaagcagtaaagatctaaaatcgacaccctaacatcacagttaaaagaactagagaaatgagagcaaacacattcaacagctagcagaaggcaagaaataattaagataacgaaatacccttcaataataacgaaatacccttcaaaaacgaaatacccaataacgaaaaacccttcgaaaaatcaatgaatccaggagctggttttttgaaaagatcaacagaattgatagactgctagcaagactaatggagaaaagagagaagaatcaaatagatgcattaaaaaatgataaaggagatatcaccaccaatcccacagaaatataaactaccatcagagaatactataaatacctctatgcaaatcaactagaaaatctagaagaaatggataaattcctggacacgtacacactcccaagactaaacgaggaagaagttgaatctctgaagagaccaataacaggctctgaaattgagataataatagcctaccaaccaataaagtccaggaccagacggattcactgccgaattctaccagaggtacaaagaggagctggtgccattccttctgaaactattccaatcaatagaaaaagagagaatcctccctaactcattttatgaggccagcatcatcctgatactaaagcctggcagagacacacacaaaaaaagaggattttagaccagtatccttgatgaacatagatgcgaaaatcctcaataaaataatggcaaaccgaattcagcagcacatcaaacagcttatccaccacagtcaagatggattcttccctgggatgcaaggctggttcaacatatgcaaatcaataaatgtaatctatcacataaacagaaccaacgacaaaaaccayatgattatctcaatagatgcagaaaaggcctttggcaaaattcaacagcccttcatgctaaaaacacgcaataaactaggtattgatggaatgtatctcaaaataataagagctatttatgacaaacccactgccaatatcatactgaatgggcaaaaactggaaacattccctttgaaaactggcacaagacaattatgccctctctcaccactcctactcaacrtggtgttggcagttctggccagggcaatcaggcaagagaaagaaataacrggtattcaattaggaaaagaggaagtcaaattgtccctgtttgcagatgacatgattgtacatttagaaaaccccatcgtctcagcccaaaatctccttaagttgataaacaacttcagcaaagtgtctcaggataaaaactcaatgtgcraaaatcagaagcattcctatagaccaagaacagacaaacagaaagccaaattaatgagtgaactcccattcacaattgctatgaagagaataaaatacctaggaatccaacttacaagggatgtaaaggacctcttcaaggagaactacaaaccactgctcagtgaaataaaaaaaggacacaaacaagtggaagaacatttcacgctcatggataggaagaattagtatagtggtaatggccatactgcccaaggtaatttatatattcaatgccctccccatcaagctaccaatgacttccttcacagaattggaaaaaactactttaaagttcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaaaggattccctatttaataaatggtgctgggaaaactggctagccatatataaaaagctgaaactggatcccttccttacactttatacaaaaaattaattcaagatggattaaagacttaaatgttagagctaaaaccataaaaaccctagaagaaaatctagagaataccattgaggacataggcatgggcaaggacttcatgactaaaacaccaaaagcaatggtaacaaaagccaaaatagacaaatgggatctaattaaactaaagagcttctgcatggcaaaagaaacttccttcagagtgaacaggccacctacagaatgggagaaaaattttgcaatctacccatctgacaaagggctaatatccagaaaaaacaagaaaagagcaaccccatcagaaamtgggcaaagtatatgaacagacacttctcaaaagaagacatctgtgcagtcaacagacacatgaaaaaatgctcatcctcattggtcatcagagaaatgcaaatcaaaaccacaatgaaataccatctcacaccagttagtatggcgatcattaaaaagtcaggaaacaacagrtgctggagaggatgtggagaaatagaaacacttttacactgttggtgggactgtaaactagttcaaccattgtggaagacagtgtggtgattcctcaagaatctagaactaaaaatatcatttgacccagtgatcccattactgagtatatacccaaaggattataaatcatgctactataaagacacatgcacacgtatgtttattgcggcactattcacaatagcaaagacttggaagcaacccagatgtccatcaatgatagactgaattaagaaaatgtggcacatatacaccatggaatactatgcagccattagaaaggatgagttcatgtcttttgcagggacatggatgaagctggcaaccgtcattctcagcaaactgtcacaaggacagaaaaccaaatattgcatgttttcactcataggtgggaagtgaacaatgagaacacttggacacagggccgggaacatcacacaccggggcctgtcaggggtttgtgggctgtgggagggataacatgaggagaaatatctaaagtaaatgacgagttgttgggtgcagcaaaccaacatggcacatgtatacctatgtatcaaacctgcacgttgtgcacatataccctaaaacttaatgtataataatataaataaataaataaataaataaataaataaacttcagggcttggcacagtggctcatgcctgtattgctagcactttgggaggctaaggtgggaggattgcttgaggccaggagttcgacaccagcttcggcaacatagtgagactctgtctctttaaaaaaatcaaaattagccaggcgtggtggccgatgtctgtaatcttagctacttgggaggctgaggtgggcagattgcttgatcccagaaagttgaggctgcagtgagccattgatcatgccactgcactccagcctgagaccctgtctctaactaacttattttagtactgtgtgttttaagtaatacagatatttgaattgagtgttgtgaagaacagaaaggtggagctaattctatgagaggtttagaaaagatgatgtttgggtggatcttaaaagaataatattgtgaatttttttcttggttggcaggttgattgggaggtcgaagggttagagtaggtgaaaaacataattcatgctaacacaagggattatgaaagagcattgttttcaggaagtaataagtatggcatagagtgcagttaggaatataaatctatagtgattaaaatagtgtgatatttagacagaaaagtaagtggaaagagtagaaagcctagaaatgtgcccatacacgcaaaaatgtaccatatagtagaggagatattacaaaccaatgaggaaaggatggactatggactattcaagactgttcaatattagaatgatgtattattcatatgaaaactgagtttaataataaaatctaaattatacccaaattcaaggatattttatcaaaaaaacctggtttataattagcgaaaatgtcaaggtcatataagttaaaagaaagactaagaaactgtttcagaccaaaggagacaacttaatacagtatgtgatattgaactggatccttttattatacatcattgagacagttattgaaacttacgtgcatagtgacaattgtgtgaaagtaatgcatcagtttaatgayctgattttcttcgttgtactgtagtctgtggaacatgtccttgtttataggaaatatacatagaagtttttggggataatgtagcatcagattggcatctatcgtctcaaatcgttcagaaaaacaacagcaacagttctttgtactatacgtgtagctttttcctatgtttgagattgttttttagaagttgtccagctggatgcagtggttcatgcctataatcctaggactttgggaggctgaggcaggaggatcgcttgagcctaggagtttgagaccagcctgagcaacacaacgagactccgtccctacaaaaaaatttaaaataagctgagcttggtggtatgcacctgtagtcccagctacttgggaggctgaggtgggaggattgtttgagccccagaggttgaggctgcagtgagccatgatcataccactgcactccaccctcggtgacagagtaagaccttgtctcaaaaaaaaaaaaaaagaaaaaagaaaaaagttgtctaaaagttaaaatatagttatcaaaataaaattaaaaattaaaagattatctgggaaaaatatttctaatacatgtgtctgaataaatgatttgtactcagaatatgtaaagaactcctcctacagtctttgccttctaattggagcgtttagatcatttgctgttttattttttttgtttttktttttttttcagtaggtttttggtgaacaggtggtgtttggttacatgcataagttctttagtggtgatttctgagatttcggtgcacccgtcacccaagcagtgtacactgtacccaatgtgtagtcttttattcctcaccaccccccaccctttcccctgagcccccaaagtccagtgtattattcttatgtctgtgcatcctcatagcttagctcccacttatgagtgagaacatacgatgtttggttttccattcctgagttacttcacttagaataatagtctccaattctatctagtttctgtgaatgccattattttgttccttttttatagctgagcagtattccatggtgtgtakgtgtgtgtgtgtgtgtgtgtgtgtgtrtatatataacatgttctttatccacatgttgattgatgggcatttgggctggttccatatttttgccattgcaaattgtgctgctataaacgtgtgtgcaagtatcttttttgtataatgtcttcttttcctctgggtagatacctactggtgggattgctggatcaaacagtagttctacttttacttttttaaggaatctccacactgttttctttagtggttgtactagtttacgttcccaccaacagtgtaaaagtgttccctttcaccacatccatgctaacatctattattttttgattttttgattatgaccattcttggtggagtgaggtggtttcacactgtggttttgatttgcatttccctaataagtagtgatgttgagcatttttccatgtgcttcttggccgtttgtgtatctttgagaattgtctattcatatcctttgcccactttttggtgggattgtttttttcttgctgatttgtttgtgttctttgtagattctggatattagtcctttgtcagatgtatagactgtgaagattttctcccactctgtgggttgtctgttaactctgctgattatttcttatgctgtgcagaagctttctagtttaattaagtcccatctatttatctttgtttttgttgcatttgttattgggtttgggtcatgaagtctttgcctaagccagcgtctagaagggtttttccgatgttatcttctagaatctttatggtttcaggtcttagatttaagtctttgatccatcttgagttgaattttgtgtaagatgagagatgaggatccagtttcattctactacatgtggcttgccaattatcctggcaccatttgttgaatagggtatcctttccctattttgtgtttctgtttgccttgtcaaagatcagttggctctaagtatttggctttatttaatgtagtttattgatatgaatgtatttatgttcacatcttgatttgcttctgtttgtctcttctatttttttgtgattttcttaagactaaatattttttattagtaaaaattttttttcacaagcccattggagattacacattgtttatatctataaatccagaagagagaattaaaatgtctgagtatttgggatggtagactataggagaacaaatcaaaagaattaattggtatctggaaagcagatgtattaacatggagggcaaattgttttctaactttactaaaagacaaaaagccaaactagcagaattgtttaggttaattagatataaattataagtttgtattgggcagacaattagtgaagatgtagaattctccttttccgaattgttttcaaagaactagtaattgtctaatatctgtttgtggacataagaaggtagactaagttgacctgaagggtataatgccttaccacattggcgacaatatgatttgtgtgtgtgtgtgtgtgtgtgtgtgtgtgtgtgtgtgtgtgtgtgtgtgtgacagagtttcagtcttgtttcccaggctggagtgcaatggcgcgatctcggctcactgcaacctctgcctcctgggttccagcaattctcctgytcactgcaacctctgcctcctgggttccagcaattctcctgcctcagcctcccaagtagctggaattacaggcatgcaccaccatgcaccaccatgcccggctaattttgtatttttagtagagacagggtttctccatgttggtcaggctggtcttgcactcccagcctcaggtgatccgccygcctcggcttcccaaagtgctgggattacaggcatgagccactgtgcccggctgacaatgtgatttttaaaagtagaaataaactttcaattaaatgtctgtactctattaaattcatcttgctacctttgttttaaaatgtttactttctcttttctctactatagcttgaaattttgacaaacttggcaaatgaagccaacatatcaactcttcttcgagaatttcaggtttgtgtacagtgctaattataaaaaacttctaaaacatatgttcagtcttaaatatgcatctttttctatctagaaatatgtaattatgtacataaaatagtgattgggacaagactgacaactaagaaattcataaatttgcaagaataaactaattacaatttataatttaaggaaaacatagtattctctttcatattttcatagactttgaaggactttggtgttataactctgtctttgtttgaaattgtatttctggtaagaatttcatctttttgtgctgccagcatcaatagtcctttctatattctgtggtcatgaaaacggtttcatttcttacctggttgttcccattttattgacctatgactatttttgacactgcccccttagcctcatatatagctcaaaaaaatttgtttcataattgccccactacgattttttaaattgctgttttttattttgatttgtttagttgtatttttatgccttatgagactcttcctagctgcatttccccccaaaatattattcaaaaattacttcatggacatgataccctttatgatggaaaggtcatctctgaagccttagttgtagagcacagcaatagaaaactttacatcagtattatgacttttatattccactatctgttttcttaacaaaaatataccacatactatgcactaatcacagagtttttcttttatcagcttccaacttttagagatgtattttttgccatagttctcctatatgccaatattaaatttcttcttggttataagacactgtatacacgatttctttttagctatgtgatttttaaactttttacaggaatagtagaataatatggcatgtccataatttatattttcatacctggattactccacttttatgttgtgtatctttctagacaaatttcttaaaaaattaagatgttctagaaaatatactattttatgttattattcagtaatcttatagctgcagatcattgcttgaatctgattttcacttcattcctataattttatttatttaaagtattggtctttgtgttttttcttgttcctttcctgttgtcctatctagtctctttgggtgtcctctcactgtccagtttttgcttatatcaagtctcctgggattgtaggaaaggagacttaggtaatgttatggaatgggttgtatagagggcacatactagacctgtttcaaaatattggtcatctagtcttttcatttaatatcaggatgtttaataaggtccatttttcagtcaaacttttaagtatttttttcatgtattcatttttatcactgtctaaatttgtaccttctgtctatgtttgtgttatgctcatagttacgcttttagtaactttttgggtaaaatagggaatgtttctaaagactcataagttcatatttttctttaaggaaattaaataatttatttgggaacacttttaaatataattggtcttgccttcatggaactaggagagtttaattaatttaatttatttgttcaatgtttaatcacctggttggtaccatttttagcaaatttgtatttttttagacatctttaggttttctcctccatttgtcatttagacaccacttaaatgtattgcatttttcatagtggtaagtctacattggatacttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtctctgaaaaagtgaccctttttttctagattcacagatgctgctggtaaatgaactgaaacctccaaagagagagctctcatcatctctttcaaccttgcacttaaactaattgctgtctttgggtgactgctcctactatctgttttggagtctcaagccactatggccacaggtgaatgagcctggcttgaaaatgtgcttcgtccataggcacattctttaagtaaaaaaatcaaaacaaaatgaaattaatctacatcatcacttggtcctcatattgtgcttatgagaagtttatgtattctggaattcttatatattgacaaagtttaatayaatcggagttttggttaactcaataataccagtgtgtaaactaattgaaataatatcttttagacctatgtgaaaagccaggataaacaatttgcagcagccactattcagactataggcagatgtgcaaccaacatcttggaagtcactgacacgtgcctcaatggcttggtctgtctgctgtccaacagggatggtaagtttacagtttcattttattttcaggtgatttaaatttgaatattcttggtattatttccaagttgtaaccttttctaactttgcattttagcttttccagttatatcagtagtatggtcacaataagtagcattttatccttgaatgcacataaatatgcatattctgggttcttttttttttagtaaaataggccattaactagcaggtagtatttgttttaccgcaacagatctaagaaaatttgttttacttctttacaatttaatcaccttgattgtatcttttccacctttttactgcattttaatggcatgtaagtcatgcataatattggttcacctgcagagggtgctaaaagcaggcaaatgactataacatggagaagtggctagatcaaaaaatatgttaactgtataccttcaacattctttttcctcagaaattcacctaattatattcaaaattaactagatttaaaagccatmaacttggagcagctttgtgtttttaagccaaacaatatctaagtgttcggtaaaactggataggtaatatccagtaaaatatgtaagctagatcccatattgttctgtggcaaagcgtcagttatttctatgggtaaggctttgaaataaatggagccatttagagaaagaaagaaaagccaactttacctttaaaataattttgtttaaagaacttttattataattatgtattaaaatgagacttttttaagaaaagcataattttctttgtaaaatcattgaaattattttgtggaatttaaaatatactaatgtctatgtcatgtctagatatgggcatatatgatatagcagcccatgaggtaaaacaacaaaattgattacattttatttgaaaaataactttttagtacaagaatcctataatctctaattattttttcccacatgtagatatctttagaaaactgtaacattgttgagagtatttctgatgaaaaaaattggaacaaaatttattcccagataacattgatttttgttgtgagcataaaattttaaacttgtacctgtaaactcaagatactatgactgaagatttttctacatgtagtattaaaactccaaataaatgccaaccaaaattatcaagacgataggtttaaaatttttttttatctctacaaagtagctagtggagataggatgataaacgtcatccattctatctctttctacttttaataataactaatccttttatctctgtttctatgtcacattttaaaatgtgacattaaaaatgtgttttaaagaaattttcctgtgcctttaataatgactttctattcaaccaaataaaatacacaccttgggaaaataactttgtaccattaaagattatgaaccaaggcttaccagggcaattgttcttttacattttagttacatacagaaagcaccggaaattagttagaacactgattagttcattcaaatacaaaatatattcaaattttctcaattttattttttgactttttttttctaatggaaaatttcaagctttggattttaaagcagttatttctgcttcagatttaatttctcaaaaaatatttttattgactttaaaagataaatattctacccctacatcacttttaagggaagactagattgttttacaattagaaaatgaaagactaatacatacttcctctctaaaagtagaaggatttagtttaactactttaaattttgatattttaatggttaggcttttgttttttgatacaactcttaatcatggttttttttttcctgcagtgtgaatattaacaaacttaaattgtattgtcagattatatttgcataatcatcattagcccataatacctgattaattatgtctgtatcacatatgctacactattttttgtagtttggaagtctggctcagtaaaagtgagaggtaaaacaaataaggagaatatttatatcaaaattagtaacataaaagaaagtcatagtatttttaactttaacatagccaccctgacaatagagccccttcctctttgtattaaaagatctacttttaggaataaatactgtgaatgaagactcagtttctttaaaatctgttaagatcttttaaggctctaggaatctgtaattatttgattttatattgaaatgaatacctcatcatctgttcaaataatgaatctttaaacctcagggacatttaggctcaattgtttttaaatatgtttaatatatttctcttggacctctagttttgtgtgtgtgttgttaagagcctttctaagcagacttgaagcttgccctaaaacagcctattattactctctaagattaatttgataagccaatttcttatagacctttagtaagagaaatctacatttcagttgacttaggtaatttattttaggtaacatattagcgaaatttacttttttgaataaccttattgccatctactctaaactaaaaggattggggcagaagactttgttttgtttagttttaaacaattcagtaagcatttattgaagacttaaatcagttgagatgtttaataaatgttgaatatattaataggatatttatttaacttataaaaggttcctatctttatagagctaatagtccattggagggagatagtaatataagacaaatatattatagtcttcccatatagtgaccacttactctcttgccagctatttgcttacatgtaggactataccacctatgtagaatgttacagctatcctgagtaaattacccagtctacctgtgcaccagattcttcatttgtaaaatgagtatgatagtagactgtactttttaaagttaggtccattaagatttgttgaggacaaggaggaagttaggaaatatctagaacataggatcattttgtgcttctgatagagtagcaccaaagtgctgaggtctttggaaaccaagaggtaccataaaggagaagtagagtggaattacctgaggggaatgagaaggcacttgtggtaggcagaattattgcgttccaaagatgcccagaacctgtgaatatgttaccttacgtggaaaaagagacttcgcagattgattaagtcaagtttctatagatggggagattatgtggttagacctaatgttatcatgtgggtctttataagggaaagagagacgcaggtcagtcagaagatgtcagaaggtcagggtgatgtgattgttggaagaggtctttgaaccaaggaatgtgggcatgcttgagaagttgggagggggaaggaaaagatttcccctagaacttccagagggaacgcagccctgttgagagcttgatgttagtcccataagacctatgttagacttctgactttagaactgtacaatgataaatttgcattgttttaagccactatgtttttagtaatctgtgacagcaacaataggaaactaatgtagttcctaaagataaatgatgccaaacgcatatttcaactgtagccaatcctgcgtctgcttgtagataattaaattatgcaacatttttttctcttacttaggctagttttgcaataatgtattttaaaaatataaatttgttatactatgcattctttaaaaccacacttaccaaattttgctttgcatagtaatcacataaccatttatttttctgctagagtgtaagtttgatgagggcagaatctcattctgatttacctttgctttcctcatagcaccaagaggtagtctttatagaagtaatacttgcctatgggtgggcgcggtggctcacgcctgtagtcccagcatttgggaggccaaggcgggtggatcacctgaggtcaggagttcaagaccagcctgcccaacatggcgaaaccccatctctactaaaaatacaaaaaattagctgggcgtggtggcgggcacctgtaatcccagctgcttgggaggctgaggcaggagaatcgcttgaaccccggaagtggaggttgcagtgagccgagattgcgccactgcactccagcctcagcgacaagagcaaaacatctcaaaaaaaaaaaaagaagtaatacctgcctatcgtaacatagaacgtatatagatagaatgtacatcctagttctgagtttgaattctgggtaaagttatacaattccagtgcatctccctttcttcatctttaaaataataataataaggtacctactttacattattgtgagaaggaaatgaaatgtgatgttgttttgtaaactgaagcattaatattagttagcttttagttaaatcatactaggtttttttttgttttttcttttctcactctgtcacccaggctggagtatagtgttgtgatcacggctcactgaagcctcaaccttccttggcccaggtgattctcctgcttcagcctcctgaatagctggtactataggcacgtgccacaactcctggctaatttttggattttttgtagacctggggttttccatgttgcccaggctggtctcaaactcctgggatcaagccatcctcctgcctcggcctccgaaagtgctgagccactgtgcccagtcaatattagttaatttcttattcttatggataagcaggtaaacagtttgaaatacatatatttactaatgattagaatgatgaattttgtttatattcttaaacggagctttataaaaaatacatttcagtgaaaaagagtaggccgggcatggtggctcacgccggtaatcccagcactttgggaggccaaggcgggtggatcatgaggttaggagtttgagaccagcctgaccaatatggtcaaaccccgtctctactaaaaatacaaaaattagccaggcgtggtggcgcgcgcctgtaaatcccagctactcaggaggctgtggcaggagaactgcttgaatctgggaggtggaagttgcagtgagctgagattgcgccatggtactccagcctgggccacagaacaagactctgtctcaaaaaaaaagagtaataggacacaaattatggtatttctaatataatattaaaataaacctttgtagtgtatgccaggggaattcctaatagccatgaagccctattaataaaaatatcaaaataataagtaaaggcaatgttgatttatttctttggcatcattagcattaataacacattatataagattcatttcataaggtcaggttctcaggtgagttatgttacgtttctttaccagtaccaccaaaaagagactggaccagtgattggccagtttagtatgataactaaatcccgtaatcccagtttgaggatctacttcctatccacctccagtagtagttactgtattagttaaggctctggcaagaaacagatggcacacttaaaagggatgattgaagtgaattaagtgaatgaactgtttgtaaactgtggtcaggattaagggaaaccaacaagatatgatgtaacaccctggagctaacaggctatcaacagtgggaggcctttaccatgcctcagattgaagggaaggggtgtgaggagcaggagcagttaccagaccctgcaggagtgagccacttgcagtaccttcagtaggggattgcatgtaataccagggagaggaggctggcagagtagggatccaggataacaaatatccccgccctccccccaccatctcctgctgaagctttctattgactaaacacagctataagccaggaccaagggagtctggttgaggcagactacaggtgggcctcttagggcacagtgctggggagagaaaggtagagtggactttatagaacaaatagagaaaatccatctcactctcacaatcccattctttccggctttgcactccatgctatttctacagtgacttctttactactaccactcatctttactactcacttttctgggcatttcacttaaggaaaaattttttttttagtttgctgttttctgcagaatagggaaaatgttgtttagattgtagataattgatttccactatataatttataggaatcaaagagcaatatttgaggactctggttaaaagccaaagacatagaacactatggtgagcagcataatccaacgtcttttgctttcttaatctaaagatgcagagataagaaaggaactacagaagctaggagacagcaacagaggttagaaattaaagttaactctcctagttaagacagttgttcacacctcaaatttggaagcgcactcatggttatgctttcacatagtcttttaaggcttgtattaaatagaatgtttttctaatttaagtttacattttaygaagcayattgcatttgaattgaattatacatatttagtatgaatratttctatctttttcagaaatagttgttgctgaaagtgtggttgttataaagaaattactgcaaatgcaacctgcacaacatggtgaaattattaaacatatggccaaactcctggacagtatcactgtgagtatcaattaagagatgtttgctgaattttattcagtaagttgtaattttgttaaaataaatggtcagcctaaagggtaatggttaggagagctgaagtgtctggattccaattctgagattctaagatttcttgctgttataggagggaattacaaatctgaataggggaaaggatagaatgagcctcgtggtattagattggaattggagatagcagtgtgagttttatatatcaacagctagatgttgggtgagtatatatgcatgttcatgtgtcatacatgaaatgaatatacaaacatctgtttcccagagctgtcctttgagaggagttagaaacaataccattgagcacactttgtgcacagattttgtttttttaattgagatattattttatactataaaatttactcttttgaagtgtatcattggtttttgatcacttataagttgtgcaatcaccagtatgtaattgcaggacattttcatcaccccttaaaaaaaaatccataactgagactgcccagtctcccttcactctataccctggccactactaatctacttttttttatctttatggatttgccttttctggacaatatgtagccttttgtttctggcatctttcacttagcatgttttcaaggtttgtgtatgttttcgaatatagtacttcattcctttatatggtagatcttagtttttaaacacaaatcttgaagagtggagcaagatggccaaatagagggctgcaatgattgtcacccctgcaagaacacgaaattttagcaactaattacacacaaaaaagcaccatcataaccaaaaatcaggtgggcactcacagtatctggttttaacttcatattgctgaaagaggcactgaagagggtaggaaagacagtcttgaattgccggtgtcaccgctttctcatcccctggcagcagcagtgtggcatggagaatctctgcactagggggagggagagcacagggattgggaagagaacaagagaacaagagtctctgcctggtaatctagagagttctcccagatttatccaaggcagtacctctaccagtctgcaagaaccacatcattattgggcttgaggcccaagtccctttgaataacctggaaagccttcccaaatacaataagcacaaacaagcccagactgtgaagactacaataaatacctaacttcaatgcccagagactgatgaacatctgtaagcatsaagaccatccaggaaaatatggcctcaccaaacaaactacataaggcgtcaggggccaatactagagaaacagagagatacgtgacccttcagacagagaattcaaaatagctgtcttgagaaaactcaaagaaattcaagataacacagagaaggaatttagaattctatctgataaatttaacagatattgaaatagtaaaaaagaatcaagcagaaattctagagttgaaaaatgcaattgatatactgaagattgcatcagagtctcttagtggcagaattgatcaagaagaagaattagtgagcttgaagacaggctctttgaaaatacacagtcagaggagacaaaagaaaaaagaatataaaagaatgaagcacagctataagatctagaaaatagtctcaaaagggcaaatctaagagatattggtgttacagaggaagtagagaaaggggcagggatggaaagtttattcagagaaataatatcagagaactcccaaacctagagaaagatgtcagcattgaagtacaagaaggttatagaacttcaagcagatttaacccaaagaagcctacctcgagacatttaataatcagactcccaaaggtcaaggatgggaaaggatcctaaaagcggcaagagaaaagaaacaacatgcaattgaagtctgatacctgtggcagcagacttttcagtggaaactttacaggccaggggagagtggcatgacataaagtgccaaaagaaaacaacttttaccctagaatagtatatccagtgaaaatatccttcaaatatgaaggagaaataaagactttcccagacaaacaaaagctgagggagggattttgtcagcaacagacctgtcttttcttgtaagaaatgctaaaaggagctcttcaatctgaaagaaaaggatggtagtaagcaggaagaaatcattcaaaggcacaaaattcactggtaatagtatgtacacagaaaagcagaatattgtaacactagaattgtggtgtatgaagtactcatgtcttgaatagaaagactaaaacgtgaactgattaaacataactatgacaacttttcaagacatggacagtacaatatgatataagtagaaacaacaaaaagtgaaaaagcagggtagaacttttattagtttcctttttgcttgattgtgtatgcaatcagtgttgtcatcagtttaaaataatggattatattaataagatagtatttgcaagcttcattgtaacctctaatctaaaaacgtaaagtggatacacaaaatataaaaaacaagaaattaaatcctaccactagagaaaaccacctgcattaaaaggaaaacaggaagaaaggatggaaggaagagaagaatgtgaaacaaccagaaaacaaataacaaaatggcaggagtgagtccttacttatcaataataacattgaatgtaaatggactaaactctccaatcaaaagacagagttactgcatgtataaaaaatcaagacctaatgatctggtgcctacaagaagcacacttcacctataatgatagacatagactgaaaaaaaaaagggatggaaaaagacattccatgctggtagaaaccaaaaaagagcaggtgttgctatacttacatcagacaaaatgtctgtctcttcctacacttataaaagacaaaaagtgtaggaagagacaaggtcattatttaatgataaagagtcaattcagcaagaggatataatgactttaaatatatatgcactcaacactggagcacccagatatataaagcaaatgttactagagctaaagacaaaggtagacctcaatacaataatagctggagatttcaacactccactttcagcattggacagatcttccagacagaataccaacaaagaaacattggacttaatttgtgctatgcaccaaatggatctaatagatatatacagaaaatgtcatccaagagctgcagaatacacattctttttatcagcacatggatcattcttaaggatagagcatatgttaggtcacaaaacaagtcttaaaacattgaaaaaaataataccaagtatcttctctgaccagagtggaataaaactagaaaatctaaannnnnnnnnnnnnnnnnnnnctcctgaatgaccaatgggtcaatgaagaaattaagaaggacattgaaaaatttcttgaaacatgtgatgatggaaacacaacatactaaaacctaagggatataacaaaagcagtactcaaggggaggtttatagctttaagagcctacatcaaaaaagaagaaaaacttcaaataaataataaataacttaatgatgtatcttaactagaaaagcaagaacaaaccaaacccataattagtagaagaaataaaaatcagagcagaaatgaaatcagagatgaaaaaggagatattataactgatactgcagaaattcaaaggatcattagtggctactataagcaactatatgccagtaagttggataatctagaggaaatggaaaacttcctagacacacacaacctcccaagattgaactgtgaagaaatccagtatctgaacagaccaaaaacaagtaacaagattgaaaccataataaaagttctcccagtgaagaaaagcccaggatccgatggcttcactgctgaattctaccaaacatttaaagaagaactaataccaagtgctactgaaactattccaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacatttaaaaaatcattcgtcatgaccatgagatttatcccagggttaccaggatggttcaacattcataaatcaatcagtgtgattcatcatatcaacagaatgagggacaaaaaacatatgatgatttcaattgatgctgaaatagcatttgataaaattcagcgtcctttcctgataaaaaccctcaaaactggggatagaaggaacatacctcaatataataaaagccatatgtgacagacccacagttagtatcatactgaatggggaaaatcttagcctttcatccaagctctgaaacataacaaggatgtccactgttattcaacacagtactggaagtcctacctcaagcgttcagacaagagaaagttataaaggcatccacattggaaaggaagaagtcaaattatccttgtttgcagatgatattatcttatatttggaggtattttggggtataagagcattcctacaacttacctttattggttaagaaaacaaaatgtgaccaggtgtggtggctcacgcctgtaatcctaactaacactttgggaggccaaggcgggtggatcacctgaggtcaggagtttgagaccagcctggccaacatggtaaaacctcgtttcttctaaaaatacaaaaattagctgggcgtggtggtgtgtgcctgtaatcccagctacctgggaggctgaagcaggagaatcggtggaacatgggaggtggaggctacagtgaactgagattgtgccactgcactccagtctgggtgacagagcgagactctgtctcaaaaaaataaataaataaaaataaaaaataaaattatatgtttacctggagagatagctaacacaaatgcagtaaaatgttaacatttggggaatctaagtgcagggtatccagaattttttttactcttcttgtaagtctgaaattatgtaaaaaaaaaataaataaataaagcaataaatattagttccaactccatcacttaccagctccgtccttatgttaaagtctttatgcctcacttttcccatgtgtcaaatgatgatcgtaaaaggacctacaatatagtattattataggtattagcttagttaatatggtaatgcccttggaacgctggctggcacatagtagtgctgcattatgtgtttgtcattctatcttcatgctcttcttccctttaaaaccaaagtttttgaaagaactatctgcaacaagttttattcctttacgtcaaactccctccccgtcacagttggattttggttctccagcacttcattaactatgccttttccaaggttactatctcctttctaaatccagtggatacttttctgtccctatcttccttgatcttttcttagcattggactacgctaactacttcgtcctttttgaaatagtctcctcatggcttctgtgatttttctcttctggtttttcttcaaactcttcagctatttcttctccattgtgtttgctttttactatgcctttttcttgagtgctggttaatgttttgccaagtgatgttctataataaatgcagatgtagtttagggaggagtatattatttccttttttgaagatgggttaatctgtattctcattctcttcagagggatcatttttgtgtagtcaagggtaatggatcacaagatttagaacctgccagtcaagaccaattttaaatatctctggtggcaaaattgtctttcccttagggtgttagtaaagcttgcaaggcagttacacatttatcttaaagctaaaaaaaaaaaaaagtatggcttacaggagtcatttagcatctgaacttccaccccatctctcagcggagagttactttgtattcatatctgttcttactgttgattctaatgatcaaagccaagacttctcatagagattgtgtatgagagatgtaggggttaagagagtaatttgaaaaccggatgacttggattcacagttggtctgtaccttttactagcttcatgaacttaagcaagttacttgacttcactatgctccagttttctcatctgtacaatggggatcatagtactgacaaccttagagctctgttgggtggaatgaatgagtcaatgcatgtgaagcacttagaacagtgctcggtgtaagctgttattaagggaatattgagtgttttttgaagaagacagactatggtaaggttttaattttgtaagctttcttattgcctcttttatattttacttatttaaaataactcctatagagcatatcatttgccaggcactattctaagtaccttaaaaatataaattattaatttttaatagcaacacttcaaggaaagttctcttaatattcctattttatatttgagaaaactgaggcacaaagaggttatgtaacttgcccaaggtcacatagcagcaggtctgctttcttaaccagtgcattatgttgtatctcacttccatttataatctatctgtttaaaaatttcactttatttaacaaatatttaaattgtcaccggtcctttttctgtattcagttcacatacctactcagtgacctagccaaggttttttttattatttccttttgcttccctcaagtcattgacaaattgggaattagagtgacatgatcaatgtctaccgcagtgtagaacagatgtttgacattactttgatgggaaatgagaggttaagctttttttctcaaagccgccgaaatggacatctagcattcctatccaccaagcatcaaaattcagtcgtgtctctagtcattgtaacactgctcatatttagttacttcctacgaagtgatacagcccccaggaagaaccacttgtctaaccaatagctaatgaactagcacagagaactctagatggaagaagacaaagaagagagatatataggtgactgtatatttacacatgattatgaggttggtgcaraaataattgtggtttttaccacaatggcaaaaacctcaattcctttgcaccaacctaataaatgtatagcaatagactaggaatgtctaaccaaagtgctaaatttgaactcttgataaagaagggggcatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacttgggctagtaaactcgttctggtcctgtttagaaaggaagaggcaattataagtactagggcttcaggagagtgcagctgctatacataaaacctgtaacagtgtatgaggcctgtatctggcaaaccctaggctttcttggaagaaaactttcttctatttgagtatattcatgtccagggatacagaagatactttcgatgtgtaaactttctttttctcgctcattctctctctttccctttttttttttaatggagtcttgctctgtcaccctggctggagtgcagtggcgcaatctcatctcactgcaacctccacctcccaggttcaagtgattctcctgcctcagcctctgagtagttgggattacaggcatgcgccaccgtgcctggataatttttgtgtttttagtagagatggggtttccccatgttgaccacgctggtctcaaactcctgacctcaggtgatctcaccccagcctcccgaagtgctgggattacaggcgtgagccatggcacctggctgatgcatcaactttctcaacagttgctggactataagccaaataagtacagtcttacagctctatatagcaaagcttatttttttcagcttttgtttttctcagaagataaccattaatagatacaaaaatatggtgagaattcagtattcacaaaggaaaataaaggaacaaatagcagttttacaaagccagaaaaaaawtaagaaagaaagaaaacaaatgtaaaataaataataagtatttaaaagtaataaagatggaagaaataaaatcaaatatttctcatcttgaatatgaatggactgaattttctcatcaaaagacagacttacaaattggaataaaaacaaaaactagctacaggccatttatagttaaagcaccttaatcaagtgataaaagttgaaaataagaaggtaaggaaagagatattaagcaaatatgaacaagaaagtgagatttacagttaattaaaagcatttaacaagataaaaaggaacattataaaatgaaaaaagggtaatttgtaaagaaagtaataagcacaaacctatttgcacaaaaaatatggcaaccaaataaatatgtaaaggaaaaatctattcaaaatgtgaggagaaattgataaaatagttacaatgtgtgactgtaatgtatttctctcatattagatattyctagtagacagatataagtaagaaaattaagtaatcaaaaacttatttagtaaatatagctaaaaccttatatctcttgaacagataatacccacttttaggagtatatccagtgaatattttcaaaaaatcaagaatgtatttaggcataaaggaagcttaaagattttgcattctttgaccttaagcaatgaaatgagacttaaataatttaaaagggtaccagaccagttgtaaagtaagaaatgtactttcagattaaagaatgcatttaaagaagaaatgcaaacttttttctaaaacccaggaaataaaatgctttatttcaaaacatgtaggacatggctaaagttataaagatcaccatttttaaagtatagggatataaaataaaagaaaaacgaatcaaaacagaagagggatcaatgctgattttgtaaaatagaatacaaaaaatatatatgagttgaaaagtacatgttaaatctggtcttttggaaagaaaataaaacaaaattcccttctaattattatgaagcagagagaggtaacaaaagtagacaaatctggaatatgataataaaagaaattaaaatacaagaaagctgtatggaattctacagcacacatttgaacttaaggagaatgaaaagctgataattagttgttactgctcatctaacgtatctgaggaaactgaagtgcttgaaggtgggacaagcaaggaagaatcaaaacaatttgttgtgcagaaccctcaaaatggtcaaccacaagttaccccaggagaaggtgatgagggatgtagcagacataacttcaaagtcaggaaagaagaatgattgaatccccagaatctctctgttccagtcaggagagctgtttatacaagaacaatggccatgtggaaataaaagcagtgttttattaatccgaccaagtacctgataactcctaaacgtaggcaagtgattttaaaatgtgagccttaaaataagagccttaaatgagacttctgtcctcctgaatctctacctatttcaccatcaaacccaggagtgtcattctaaaacactgcaattttaggaaaagccagtctgtccaatatctaaggacaatgggtcaatattgagcatgttttcyttcagtgcytgagccactttattagggcagaatcctgggtccatctttcttctggaaggagagagaacagaagtgatagcaagacctcttcccacctggccaccttacctatccttaaaagaagaggtgaaagaagtgggaaaatgtcccactatacacgggtgtgggaacaggcaagaggatggcctgggtctgccctgaaaatctggctcttggggaaatggcaggaggcactaagggagccattgcacaatgtggcagacaaacagaggatgaaggaataatccttcatctgattaataagtaaatatgaccccagtgaggtgaagttaattgcctccttgatgtaacaccatcagtgtgggatcagaaccggtctcaacagcttgctgaccagtattcttcctagtttaccacactcattttgtcgctacccagtgatccagtatgaattttggattcagatttggagttctgatcctagttccaccactaaccagctgtgagatgtgggcaagtttcttaactcatttgttacctagtttcctcatatgtctagtgcagatcatagtagagcatacttcatagggctttggcgatgaatgactgagaaaatacgtaaagctctcaaaaacagtgcatggcacatggtaagagctcaatagatattagctatgtaatttgttttaaaaagagaacatagattttatcatattgagggctttgttttaattggttatttagtaataattgaaaatataaaaactaaagtttaaatgtattttacattttgaattcggtcaaatcaaatagatttatgtctgtaatacagtcaacttacatgttctgattgtgagtattctgtcctttggcgtatccttcatttatgataaatactggttttggagttcttctagaataaaatgcatactatcagctggcatggtggctcatgcctgtaatcccagaactttgggaggctgaggcgggaggattgcttgagcccaggagtttgaggttgtagtgagcaatgattgcaccaccgcactccagcctggatgacagagtaagaccctgtctttaaaaaacaacaacaacaamaaaacaacccrtactacctgtggattgctctgacaggatttcacataatgtttaatgggacagatgggatttcatatcttaacaactgaaagatgttattctgtaaaaactgagtaatattgaaatagcactttgtatccttgttgcccagatgcctcacaggatgcctgccatttcacaagttacccaccctttctctggcaccccattgtaattcaggcttaggctttaatgcatattgagtccagatacagagtattagatctgatttgctgttggtatgcagtttgcttagatgtctactgattttgcctttgacaratttaaataaatgaaattgatgtttttgtagggtttactttggactgttgcactgtgcagtgggctggtgttgaaacacaatagcttttaaattgaactgcttacagagtgatctgcaaaatctttctagatgtctttctatagctgctgtggtgagctaggaatcattatttgtttttgctggcaaattaatgggttgtggtggccgtggaaactgccttctagtacaaggtttgaaaagtgcatttaatcactttctcagggcatttagaataaagaatcaggcaaagtcatttacaatccaatttgtctttgagaatattgaaaagcagagcttcataatgaaagtattatatcatatgtatgactctgtgtgtgtgtctgtacctgtgtctgtgtctgtgtgtgtattattagtttggttttatttcagtgttcctatttattttgtggttaaaaagaccatggggaacaaaaagtgactaatttacttttcttttttttttgagacagagtctcgctctgtcacccaggctggagtgcagtggcacaatcttagctcactgcaacctctgcctcctgagttcaagtgattcttttaccttagcctcccaagtagctggaattacaggagtgtgccaggctaattttgtatatttagtagagacagggtatcaccatgttggccaggctggtctcaaactcctgtcctcaagtgatccacccgcctcagcctcccaaagtgctgggattttaggcatgagccactgtgcctggcctctaaaaagtgactaattttcttacttgcctttttttcaggtgcttcaaatctttgaaagtagtggctgtgaattcatagtgtcaatggtgtataaatgagagtcctgttgcttaatgggaagagaaagggaaagctggaatccaaaaatcttagtattctgatcccatccacctgctcaaaaatgttgtctttgtcagtttcctaagctttgtaatacaatgccatcaccaaaagtttggtatatttatattgatattatttcttgtggtgaagttttctaagttttaaaaattcttggggattttattagctcagttctagaaaactacaaatcttattctcaccaccatcttgagatttttattgtgagcattgtgatttattgatttttaattttttcaaagagttgtattttaaatatatgtatcgtgagtgtttacagtattccaatattttaattttaattttagtatattcatgaatataaacaatctctttaaacattacttgtttttgggatcgtctttttaattgcaaaagattgttaccagaagaaaattacttaaaatgggataatagattatggtatgtcatagaattctgatttttatactagcaatatataataaaatatttaagaaaaataaatctagcataactgaaatttgaagttgcacatatattcttatttagaactacctttcattatggcaggcaacttgaattcctctatactggaaaatttaatgtaccactcaattactattctttagcccaatttaaaataatagattgggagtaaggtcttaatgcagtgtaacctttggaacgttagaaataacctcttttctttccagaaatcagtatrcagtaagggcatcagttttatcacactgcatgaatagatttttaatagcacttagacctttttctaattgcacaagtatatggatttcttstgtctcaccaaacatgctaaataataatttaaagacatgctgttacactgttttaaaatatatacctttttatttaaaagcttttttgatcatctcattctgattctagtgaaggactcaatattgtaacttaatatttttatataatttcataatgtgggtgttttgaaagattttgcaatggtagatattgtgataaaattttagctatggaaaggtccttattctcacttttttctttaacaatcctactatgtatagccatgaaactacagaaaatattaggactttgagaaattgtaaaaggacttcataaaaagaacattatctttcctcgtgatgccaccttttaatgatagctgtcagccttttcacttattataaaaaacaaattttctgtgcgaggtgaaaatgttcactgaaatgaatttacacaccctctcaaattccttttggaataggggaggatgcaaataagcaaatagtaataaaactaatttgcatactctaaattgttggtcttaatggtactgatggaaggtttccaatttgtcacaaagcagtgacttttaagaacataaattatattgaaatgcagtttatttaaaaatatagtgccaaaatgcaatattggacaaatttatccctgtttcttttgttgaccaaataatagactgggattcatgattttataagcagaccttgatgatcttatcagtttgatatrtttccagtgttgtagatgctaatacataaagagcaaaaacagttttgatttggaatcatagtacctaattgatctgtttctttttctgtattatctgtgggttctcaaatgggctttgtggaccacctgtctcaggagtcatctgtgatgctttttaaattaaaacatagatttctgggccccaccacagaaatactattttggagctgatcccaggacctgtctttttagtaagaaccctggatgatttttgtgggcattgaggtttgggaactgctgttctagagcaggggtcagcaaaccatttctataaattgctagacagtcaatatttttggctttgaggaccatatggtcttcactgtaactatttctgccattatagcacaaaagcagcaacagataatggagaaacaaataggtatgggcagstagactggcttctagaatttgttcgtctctgatagaatctagattctagaccatcggtttttgctgtatgaatattttctaagatattctcttygaaatcaattttaatgagatttcctatgtgtttattttttgataactgayraaaattcataaatacaggawtaattcctagatatacattaaattaattaatagctgtaaaacttttgtaatagttaaaaccttttctatgttaatattagagtatgattaacttacttctaactatgtaatctgcttctcatattaggttcctgttgctagagcaagtattctttggctaattggagaaaactgtgaaygagttcctaaaattgcccctgatgttttgaggaagatggctaaaagcttcactagtgargatgatctggtaaaactgcagatattaaatctgggagcaaaattgtatttaaccaactccaaacaggtgagaggcaaatgttagtcaacctatctaatacgtactttcctcttcactctgatcaaacagcgggggtctgtgccttcattagtctgaccattcaacaatttctaggtgcctgtttgtttcaggttctatgttagatgatactagtgcaaacagatgacattctagtctagtaagagagaaaacagattaaaaaatgaaatagtgtgtgttaatgctgtagcagaagtattgacatacagtggaattctagacgaattataaagtctgaagtcgatgtgaggtcagagaaaattttataaaggatgaaactcttgactaagggcttgtaagagtggtttactgtacagaaagaggaaagcacagggtcagagtcaagaaacagcttggtgtttctgggaaactttttgaaggtgagtccagaatggcaggtacaatggtctgaaagtttatatcccccaaagttcatgtggtgaaacctgatcacccatgtgatggtattaggaggtaggacctttgggaggtgattagrtcataagggtggagcctttataaatgaactttatgctcttagaaaagagatccctgagagctagcttgctgcttctgccatgtgaggacacagtgagaaggtgctatctgtaaattagaaaatgggtgctcactagacaccagaactgtgggtaccttgatcttggatttcccagcctccagaactgtgagaaataaatttttattattaattatattattaataggcttcccagtttatggtattttctaacagtagcccaaatggactaagacattttgcagtttgaacgcatggagtggcttgtatgctctgctaagtagtatggaccttgtcctgcagaggaaagggaaaccacttttaatagtagtataatttaccagatttkcagtttagaatattcattttttaagtccattgactttttgagcagctgttaataagaggaatcatttttgcttccatgtacgaaatagggacttttcctatatctgaattgctattctctgtgagtggacttacctgtttagtaaattggaaaaagattcttgctcatttgcagctaggcttcttgggaagctttatgctctgtgtcctatctatttttctctaattttcacttttcctctgactcttacttttgccttkgtgattttttttctccacctcccctctctttgtttttgtccccttccccaaaactctttctgcctagatatctctctgacatccttcatcccttcgtgccccgcccccgtactacagtccagtgtgtttgtcattgtctcctttctcttccatccctgtttgtttctctctttttgtatttgctgtgtatctctctatatgtgtctccctctctgtctgcctttcctgcttccccatagaccacacttattttctagtaaactaatgtttgcctttcagaatccttaggtcgattcctcaaattcatttctatatgctttgggattatcttcatccctaatcgtgatatgagttatcttattatagcttttgctgattcatctacaagatttgtaaccagataattgcaaataatggagcatatttccattatttagattttgtctttacattttaagtcatctttaaaaggaatcagttaatcctttccaagtgtctgtagatttcttcatacattgagatgctttctaaaaactgagtaaagaaagacctatgtttgctgttgagtttcatgtttcttgataaaatagagggagttttagcctgaaactccatggtgttcactaaatccctgtggtatggcaaaagtcaatatgatacctagactcttaggatttttttctgtctggtttggccactctaaatatatctagcttatggattgttgttaaagtaataccaaaatcaaatgtcaatcaagacttaatcaaactaagtaaagcttctttctttggctcttttctttgtagctgtgaataaccaataatgaaatgtagtactgtttattgtagagcatgtttcatgtctttttacccagtgaatttgaagacaactagtttgcactcaggtttttttttttttttcttgatctctattattaatggcagttttggagctcagtttctgaagtgttttttttttttttttttttttgagacagagtttccctctgtcacacagtctagagttcagtggcatgatcttggctcactgcaacctctacctcccaggttcaagcaattctcatgcctcagccccctgagtagctgggattacaggcatgtgccaccatgcctggctaattctgtatttttagtagagacaggtttcaccgtgttggccaggctgatctcgaacttctgacctcaagtgatctgctcacctcggcctcccaaagtgctgggattacagacgtgatattttatattttagaatgatacttctaggaaactacaataggcctcaccacctaatggtgaaaacacagtgattttttttaatcacaaatttttatgtagctcattgtttttaagtgattaaatatgaaaatagattaatagtgtcttgaagagttgttctctgtttttgaatatttctcaagaagaggagattgagagaattagcaactgaaaattagttgttttttgttttgttttggagcagagtctccctctatcgcccaggctggagtacagtggcgtgatctcgactcactgcaacctctgcctcccgtgttcaagcaattctcctgcctcagccccctgagtagcttattatgggtgtctgccaccacacctggctaatttttttttgtattttagtagagatggggtttcaccatgttggccaggctggtcttgaactcatgacctcaagtgatccgcttgcctcagcctcccaaagtgctgggattacaggcgtgagccactgcacccagcctgaaaattagttttaaagaatggttttaagcactatcaacttgatagaatttttaaaatttgtgtaatccattagatataagacagactaaaataattgttttgactgaaatactaagaattgttttctctacttatttattttagccatctttaaaactaagctagggagagtcgattacagtgatgagtagctggtttgccgtgaagtcttgatatttatttgtagatctgaattcccggtggcctaaatacctcagtgagcatttctataatttttattgaattatttagggttatagagaatgtctaaattgatttttataagatttagcatattgtatttatttgtatgtttgaagaataatcaaatagtaaatttctttatctgcctcaaactatttttgacctaatataaaaaataatttaaaaattagttagcagtctgttttgagtatatcctagactgaccctaccatagaaaacagctgtaaactccagaaaaatacaagaaacaaacgactttctgaagacacagaatagtaaagaaaagcaagagaatctggagggaaattcatacttagaagaaggaaatggcacagagttattttccctgtttttatggcttttatcctgaggacagtttgcagttggcactgtgcacagtggctagacctccaaaaggaaattcaaagtccttctggcttgaggaagtagagaagagagttcaggaaagctacagacattggaaagttaaggaaaaatagtagaaaggagagagtcagtgtgggagaatctcaaaatctgggagtaattgtacctaagtttttggctggcatctgaaccatacttatgcagggtggattcagagaaacacagctaggaattaaagaaccaagctgaaatttgaggtgtacccaagagactgagtttgtaccttgaaccccaacaaagttaattacctgctaaaacaaatgaaaatcctgtactcattcaaagagtttaactatgtccagagtctctaaaatacatggcattcttaatgtccaaatgtatcttgtatatccaaaattactcaacataagaagaaccaggatggggagttattgtttaatgagtacagagtttctatttgggaagatgaaaaattctagagatggatggtggtagtggttgcataatatggtaaatagactgcctggcttcaaatcatgttgtgccacttacatgattttggacaaatcatataacctatccaagatttcattttctcatctgtaaaatgggaattattataatatagtcaattttgctatattgcaacatgtatgcttctaaaatcattgtgctatacaaaatcacacaataaaaaccatagggattattagaaaaatgcagttagagtggcaacactcaaaaactatattggtgacatattttttaaaaaggaacctaaaaaaaaaaamcagaagtacaattttacacgtgttaaatggttaacaaataaatactacaatgatactgctctttatattgaaaaagacttgaggtttgcttatggaagaaaggctatacttgttcagcggtagaaagagggttaatctgaaattggatggaaagttgtgcctcctaatgagcatgaatatggcgcataacacatgtagatgttaacctctgaagtacatgtttgaggtatgtatgttttgtgtattcctacacatctctgtttagctgggtgcatttttatgccttcacctagtatttcttgcagaagaaatcaccacaaaattcatgttatgcccaaattgttccctaatatgccaactgagttggaacaaatgcacattttcaaaacaagcattagagcagaactgactgtacctacctcacaaagttattatgaggataacatgaaacagttcatgtaaaatgcttagatttccttgcacataatagtgcctagttcattttagttatccttcttttgtaaccctagcgagcaactgctgtattcttcttagggaatatgatgatttacagtaaagaaactagtctagttactgacaaaaagtgtattcttattaggaaaaaaaactactgatttgggtttatcctactgagattttctaagtaggatgctgaaatctccccgcccctcttttttttcagtctgtgaagaaaaaaatggttagaaataagtatcaagagtagaaaacactcttagaatactctcacacaggagtaatttcacttttatgtggggaaaaagttgaaagactgaaaccagttgaagttgctgaaatctagaactgttaaggcagtataaagatttagcatgagttcgttgaaatagtctactgaagtttgaggaagaaaggatttaattaaacaaattaataacaatttaaaagttaatgaataaaagatgcttttgattttaaactctaatagtatgtcatcttttaaatgtagtgataagtgctataarttaatgtttttcttagctcattttgatttttagttatgaaatattgcaaacctatggaaaagtacataatagcataaatacatatgtgtatatctaccactaggattaagttgatattcacatttgcctttatttatttatttatttatttatttaatgtaagatgtatagaactagaacctcaagcttctgttcacacgttcgtttcttccccattggtaaccactgccaccttgttggtgtgtttcattcaatcatccctgttttatatttttattatatgaatatgcatccataagcaatgtatggttgtttttgtgagttttcaaattttacataagtagatattctactttatgtatatgtttgcaactttttttgcttaatatcatgtttttgaaatatggatatgtgtagatataatttaattactatctctgtcagacatttaagtttctacttttctgctattaaaaaagaaagtgcttccttgagttcttttttactcttagtgagagattttgtaaatcacactgatgttttagggattcctcctaaagttaaaagcagattctctcttgcccgtgattcaggtctttggagaaatctccttcccccaaagcctctttaatgtgatttaacaaaaggagacttggacactctgaagtgacatctctatcctttctttgatatgttttcctggcattgaaaaactcaagtaaatataatacagaaaggaagaccttacagaaaacttttcaagttgacaaaaaggtagatactattaaattcagaaattacatctaagtcacataaagaatcctgtttagtcatgaaattaagaaactaattagggctgggcacagtggctcacgcctgtaatcccagcactttgggaggccgagacgggcagatcacctgaggtcaggagtttgagaccagcctgaccaacgtggttaaaccccgtctctactaaaaatacaaaaaaattagccgggtgtggtggcacatgcctgtaatcctagctacttgggaggctgaggcaggagaatcacttgaacctggttggcagaggttgcagtgagctgagatcgcgccattgcactccagcctgggcaaccagagcgaaactccatctcaaaagaaagaaagaaagaaagaaactaattagatggaacaacggtactgcttaggtttgcctctggtgtaagttaagaattctatgtagagtttacttcatttaccaaacatatttgtttgtatcatcctgttaaaaaataacagcaatgtagaaccaatataaatctttactatgccgaatgcagacttctgtgtcctttttatgtaatagtaaagatattattagaactatagtattaatagtaaaatatatattaggactatattttaagagacctttttagttatttgtactgacttataatctattagaagaaagctattgtttgaataaatatttcccagtttattgtcagagtattttgagaagtcttttaaataatgtatttctttttttttttttttttgaggcgagtcttgctgtgtcgcccgggctgcagtgcagtggcgcgatctcggctcactgcaagctccgcctcccaggttcacgccattctcctgcctgagcctcctgagtagctgggactacgggtgcccgccaccatgcccggctaattttttgtatttttagtagagatggggtttcactgtgtaataatgaatttcttaatttttatgtaacagttcttcaaattcatttttcctgtgtcacagtgacttagagtcaatctgaagaaaatgtaattgatataattagtgtctggatagcattagccattagttggtaccaataatggttccttaaatctaagcaggaaaattagtctgaaaacaaaatttaataaatagctgtatatatgatattgaatatttttgttaatgataatacattatactgtcattgcttatcttgtgtaatttgtgaataaaacaaatttaaaagtactatttaattaatatcccatctggttttggattgagcctctggtgatattaaaatgtcatgattgtacttaaatgttgtctgttttcttcctaacagcttccctggacagatctaatttatgcctgttgtctccatgccatctagtttaggatttgtcccaaatttttaatgaagtaatatcactaatatttgccttaaaatagcacagttaatttgtagacctccgctttgaggtcttctatcttctgccataattttgtctagtggcatgttaagacacaagtgcagtgaacagagatttcattttaatatgtgagccatttaaatctgaaagactgtatctttttcccaccctttctagatgtaacataactaacttcttccttttagaacagcaggcaggatttgtgctgataaatgaagtatactctgacaaagcaggtgggaaaagctgtcttttgctttgctggaggtggagagatgagtatttaacaatgcttcatttgccagcaacttgatataccagcaagtgttgccatggcctatgagatgcatgaagctccaggctgccagtgggtggaattaaaggaaaacatgggaagttagaggttggttataggtgaaatatgtgcaggagtaaagactgaatagtcctgtcctaggtcattaaagagagtggtgaaagcactcttgctacagtagttttgtcatttattgtatagtgtaagtctaaagtttgttttattatttggcagttctttttttatcttgttataaaatcatcagcaatatattttttaaagtggaagtgtacatttaacaaacaataaagtgctaaatttccacttagtacttaacatgcataaaatatttgtcgacatttaccaaccatcatgagagtgctggtgatctcattgaccacacaacaaccagaagacacaacaatctgctacaaaaagatcaacatccatttaaaaagctagtagttattttaagattatgcattaaggtaatttaatacgtacaggtgcagaagatgtttatataattctgtgtgaaacatgacctcatttagatcaaataactttttgaaaattagttttttacttttattctatgttttcttatgcacatatgaaaaatgaaacaatagctgttaatgtggtggctccattagtagaaaaaaggcccaacactgctggttttcaaacagaaaatcagttaattccaaaaatagacttttttcattcaatgtatttgtatatttgtttggtcagggctgcaaatgggaacaaagtaaagcttttggaagtttattctgtcaaaaatattgcaaatgctgttgtaaattaaaaagctcaactttgaagataaaactgtttttgatgaaaggacgttgtcatggtaaaaatcaatgttcttatttaattaagaaaactatggaagagaaatgttttaggaattggttgttgtgcatgcgaacaaactgcttattcagccagttgaaataaaaccgtagttgtcacatttactgatattagtatacacagtttgaccgaactataaaattcttgtgatgaaactgatgttgaaaaaccattctatagcataacagtacacactgtctttaatgcatattagcaacagaattttagatacatgattttgtgaagaactgctttgtaaattaagtttcttatattggcttaaacattttttattgataattgagtcttctgtatattggttaagttttggttcacaaattgtttggattatttaaagtgtcactagtaaatgccaaaaaattttaccttttgaaaaattttagcaaatagcaatcattagaaacaagtcttgcaaacagaaagactttgaaagttttccctgtacaggcaagggaagaactgaacaggttaaatggtgagagctcaagatttaatcaagaggttgtcatttgcactatctcacctatcgtgaagactcttttgatggagcacctgtttttaattagaaaaatttatattgtgtagaatgaaatgaaattgagaaggcagttggttttgtagtatctaaattgatgacatatttttaaaaggataaataaaataattatttgaaaatgttgtcaatattgtaaaaactttttattgactacatgggggaaaagctaaatatttgggtttgaaatattgacagtttttaacataaaagcaaggattggtactattcttcattcagtaggattttctctgagattacatgattgtccagaaatactgtaaagagggtattttctccattatacccaaatatggtctacagagaagaaagttgaaaatgtcaacaattttataattactcactgcagaatttaatttggaaaaagattgcaattttatttttttaaaaaaacttaggccatataaaaatgtattctccagagaaatactaatgccttgttactagatacatacactgaagaaactgattaatgtatgtaaatgtgtggtgaataactattctgcttatggttttagtgcatcattgtacacaaatttgtttttatcttttagaaagaatgttatttttgaaaatacattttaataaaacttatttataagcttataatataatacattttacagtcaataaaaatttttaaattatataattttaattactttaaatgccctacctaactttcaaaattgttaacatattgaaaatgtttaatttcctaaaaattaattttgggctaagaaatataagccaaatgtatcattctgctagctcaaaaaaatcattgcaattaagagactctttctttattttagttgcagatttaaaatctcagcactcaaatggactttagagttaaccaagttgtaaattctaactccacatttgagaaaactaatgattaagtggatttcccaggtttttccagcaaattaattacatggtttagtgtaccacattttcttttaagttggttttgaattgtattcctcatttggtgaatactttgcaaattgtcttaaaaaatgaatcatagaaattttcttacctgtacttgaaccagcatggtctagcaattagtgaatagcaattgttggtaaccaaattcagaatagctctattaacattttcacttgtattttttataattctactttaataaaactgggttaatcctttttaactactctgctactgaaataaggttgctttctatcaaatcaattatcttaagcaattattgtaaaagagtttaccacaccatttctgtactttgacttattgttctagaattgtctttagctctgcctaacttgattgattttattttttatctgcttctaatgtgcataaaatcttctaatctaaagtaaatgatttagtgtttctyggtttatttttcccatatattatgaattctatttggcttatagttaaaattgtacacatgtagccttcttgttaaaactatgctttttcaataaaataactgtagtttaaaatacaaacctgttttgttaacatttcaattttggtttaattattaaaattatttcaatatatgttaatgtagtacattcaaaaattgacttaggaagtcttattatggtgtaaaagctactataataagttgttcccttacataaataaataaatgaccaatattactagaggctataagcagcwtgggggaaaaatggaagaagtcttttatcctagttttcagagggcatcagcagcttgcttttatgaaaaagtaacagctaaatgcactgcaaataatttgcagtaatccagttcagtgattcatgtgtctgctttaatgggtcataattcagggtaaagtaactgagtgcagtcagagtgcagacactgcttatgccagggacagtatctcttcataaaacacacctcaggagaagcagtttgccagccccctaatactttctgatgttttgatgtcctgcatatttttccrattaagttttgagtgccatgtttttagttgtatttccacattcattattctcacgtagaccccttcagcgggtttgccatatatgattatttttttaatgatgcctttctttccacttcagcagtttaataatctagcacatggctgcttctcaatactcagcattcacctacccagtacagaagaggacatgtgctttggcttcaaaattccatttgcagcattagaaatgtgtattccctatggaacaacatttgtttgacataaccattcatttttattacctctttaaatatgtttatccagagttatcgataatcataaataactgtattctcatcttgatctgtttttttccaacagacaaaattgcttacccagtacatattaaatctyggcaagtatgatcaaaactacgacatcagagaccgtacaagatttattaggcagcktattgttccgaatgwaaagagtggagctttaagtaaatatgccaaaaaaatattcctagcacaaaagcctgcaccactgcttgagtctccttttaaaggtattatcagaatataactccaaaatatatgttatctaaaaaattatgacaagatgttgccatttctaatgtgcttaaaatttatctcttaggaaatataaatgattcrcatatataaatatataagaacagcatgctttctactcattcatctgctctcaaaagcaagttttatattaaagtttatatttttgtagaccttatttactaaataattttaagcgttctgactttattctaacatttaaactgggcaatagatgaaaactgtcttattcttataaataatgacttcatttctcttttaaatagttttataagaaatataattccttttaatagtgagttattaagtaaatattctgtgtacactaatatcagtttttctaggaggaattattttataaaaagtatccctctatatttaaactggtttttcaaagagggaagttgacttacgtgtcccagctttttaaaaggagtaattaagtattttaccaccttacaagtagccattccagttggaatcaaatagttacataccttggttttcatattgtttcttatttaatgttcttattttaaagcgataaaaagcaattcagttttgtagaaaaactattaaaattctggatgtgtttgtgccaagacatgtatatggattgtttaactgtgctgtcattcttaatattcacagtaaagtaatttttagagaagctacatttcagagcaacacctctaaacacactgactgattagcttttttattgaccattatgggggagattattgtaatctatggactgaaatcagttttttgacctatgaagagcttcctagtctatatttattccttgacatttgaggtaatatgccaattaccttgagctctgattatgattgttctctgttatatacagctcatattgtttattttatatktttccctatttttaatagatagagatcatttccagcttggcaccttatctcatactctcaacattaaagctactgggtacctggaattatctaattggccagaggtggcgcccgacccatcagttcgaaatgtagaagtaatagagttggtaagttgacctttctgaaattaattttgccaaagcagtggaagactctaggatagctattgttttatataaaagcttttttggagagttgaaaattgaaaattgttctagtatttctaaatgtaatgtgttagatataccttgcctttatagcaactaaatattatagtattcctatgccattgtacatgtactgttccttttcttcaaggaaatagagaactgaattctctgcatcagtgccacccacatttgtgctattgcatttgtagccgcgtagattcaatttctaaggtatttagtttcattggatgaagttttttctactttgtttagagatttgtaagcttcctgacaatatccttctgaataatttctgctgttctctttcagaaaaaccacacaaagtgttctagattttttgatgaaccatttttaagtgaagcctgaacataaatagggagcattgtgtaccaaaaatgtcctttgacaaggtcacaaagtgaataatatggtgctttctcatcaaaaacaaatttgctatataaatactctttttctcaatctttaaaaaaaatgctggccattgagataaaagaattaacattcttttctaatattatctgtttctttctcatatatacaagaaaaagtgagagaggccttctaattgtatttagcaattatgcaaaatatatttaatactttaaaatgtggagttaacaaaaaaagcagttaagaattgtattctggatacttttctggtggaaaagatacattgaattaggattcagataactggggttctttactaattcctgtgggaaagtgagttaacctccttgctctcaatttttctgtatacagtggaagaaaacctttattactttaataaatagaatttctataatgatcatggccatgtaatttgattcctctgagaaattattaaatgtttctcttaaccactccaacttatcctggctttgaagcatggccggaattaataatagcactatttaggaacccctgacagtgtacgatgataatgttttataaaaactatcttgtttaaacctaataatgattgtaagggatggttattgttattcccacattgcagatgaggaagccaagtcttagataacttaaagtaaatcgcctaagttcacatggcaagtaagtgatagaaccatattccaacccaggtctgagttcactgtccatgctgttactgtattttattatgtaatatgagaagaggaaccttgagcttgttcacaaatctgtattatccttagtacttagcaccattatctttatgttttgacaaatgatctgtacttagagacagccaaaaatttgtaacagtagtaatatgtaaaaatatgagaagcaattacatgtctatccctccttgcagctgagtttgttgatttttactcaaatctgcatactcttaagtactctycaaaagagttgccttatttgtgcaattttttttttttttttttttttttgagacagagtcttgctctgtcacccaggctgcagtgcaggggcatgatcttggctcattgcaagctctgcctcccaggttcaagcgattctcctgcgttagcttcccaagtagctgggattacagccacatgccaccatgcttggctaatttttgtatttttagtagagatggggtttcgccatgttggccaggctggtctcaaactcgtgacctcaagtgatctgcccgcctcagcctaccaaagtgctgggattacaggtgtgagtcaccgtgcccagcctatttgtgcaacttttgatcagatactagaatataaagagagtgttctttgttatggttcctcctacggacatactttctctcctaatttcttattatgcttgtttgttgtttttatggttcgtttttttttttcattatggggtacatgatgttttagcccaagtagaaccatccttttaaccttcccctgcttccgccttatctctccctccttgctgcccccacccaccaaaaagcattatcttctcagagttgatagcaatgctatgcaatttaatttggtctcagcagtattctttattggctgatagattggtttgttggctggcttcttccattttcatgtgctcttctaagcattaactaccttatagggacagtacttaaatataacatattatgttcgtttcacctgtccaattcaacagagacaaattaatttctttttcattttgctgattatatttatgaaattaataattggtaacttasagagaatcattataactgattgaacatggtttgataaaactgtcactgtctgttgatgccatgcagaaaacagcttcagtctattggactctgagacaattggcttaaaattatactatgagggacacaattaaatataaaaataacgtagatagttttctttttaaatgcagctacaatacaaaaaataatgtccgtattatctttcttgtctctcactctacttcatctcccttccaagtcatgtcactgtatttcatgcatataatatactatgttattctagttttcctgtaaagtgatcttacatggtcaagtcctgtaactgtgaaatataacttagtaagaaaaatgacctaggtttagataatctgatattttaatcaaaatgactgggaacctagtcagattgacagtagaagtcactttgaattacacaccaccatttctaggatataggatataatatatatttatattatgatcccagtaagttttgaagatccttagttaataatttatttgcttagttctagaaagtcctttcttctctactgacagaaagaccgccttctgcatatgaagggtattttgcttcataaacacatctgtcaatattttatcctttacagaaactttcaaattagcgtctatgttctcttcttttcttttcttttcttttccctattattccttttccttacaatgataatgtggtcttttagtcataaaggaccacaatacaaattaagatacttttattgttcgtctttggccttttaaaacctgawactccatagaattcatggccatgtcaagaaaaaatgcacgtttgagcatagaagtctggttttccgaaattgttgatttagtgttattaaattaatccaacaaackttttatcagacctcagagaaatatgtttggatttaagaaaaatrtggacttcagagtttaccaaatataagagagctttgtttatagaatactatctttgtagacagaagcattttaaataaatataaaagaaagccatactgctgatcktatataagcatcttattcaaatatattcaagcttctctttttaagcaacataccttaaaccctctagatcagtggttttatttttatttgcttttatttatttttttgagacatgattttgctctgtcacccaggctggagtgcagtggtgcgatcatagctcactgcagcctcaaactcctgggctcaagccatcctcctgcctcagctcccaaagtgctgagagtacaggtatgagctacatcacccagccttagactagtggtttttaaatgtagctgcgcattataatcatatggagattttgtgtgtgtgtgtgtgtttaatttttattttattattatacttttagggtacatgtgcacaatgtgcaggtttgttacatatgtatacatgtgccatgttggtgtgctgcacccattaactcgtcatttagcattaggtatatctccaaatgctatccctccccactcgccccaccccacaacagtccctggagtgtgatgttccccttcctgtgtccatgtgttctcattgttcatttcccacctatgagtgagaacatgtggtgtttggttttttgtccttgtgatagtttgctgagaatgatggtttccagtttcatccatgtccctacaaaggacatgaactcatcattttttatggctgcatagtattctatggtgtatatgtaccacattttcttaatccagtctgtcgttgttggacatttgtgttggttccaagtctttgctattgtgaatagtgccgcaataaacatacatgtgcctgtgtctttatagcagcatgatttataatcctttgggtatatacccagtaatsggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggtcaktgatgacgagcattttttcatgtgttttttggctgcataaatgtcttcttttgagaagtgtctgttcacatccttcrcccactttttgatggggttgtttgtttttttcttgtaaatttgtttgagttcattgtagattctggatattagccctttgtcagatgagtaggttgcaaaaattttctcccattctgtagattgcctgttcactctgatggtagtttcttttgctgtgcagaagctctttagtttaattacgtcccatttgtcaattttggcttttgttaccattgcttttggtgttttagacatgaagtccttgcccatgcctctgtcctgaatggtattgcctaggttttcttctagggtttttatggttttagatctaacatttaagtctttaatccatcttgaattaatttttgtataaggtgtaaggaagggatccagtttcagctttctacatctggctagccagttttcccagcaccatttattaaatagggaatcctttccccgttgcttgtttttctcaggtttgtcaaagatcagatggttgtagatatgcggcattatttctgagggctctgttctgttccattgatctatatctctgttttggtaccagtaccatgctgttttggttactgtagacttgtagtatagtttgaagtcagatggcatgatgcctccagctttgttcttttggcttagrattgacttggcgatgcggactctttcttggttccatatgaactttaaagtagttttttccaattctgtgaagaaagtcattggtagcttgatggggatggcattgaatctataaattaccttgggcagtatggccattttcacggtattgattcttcctacccatgagcatggaatgttcctccatttgtttgtatcctcttttatttcattgagcagtggtttgtagttctccttgaagaggtccttcccatcccttgtaagttggattcctaggtattttattctctttgaagcaattgtgaatgggagttcactcatgatttggctctctgtttgtccgttattggtgtataagaatgcttgtgatttttgcacattgattttgtatcctgagactttgctgaagttgcttatcagcttaaggagattttgggctgagacgatgggttttctagataaacaatcatgtcatgtgcaaacagggacaatttgacttcatcttttcctaattgaatgccctttatttccttctcctgcctaactgccctggccagaacttccaaccctatgttgaataggagtggtgagagagggcatccctgtcttgtgccagttttcaaagggaatgcttccagtttttgcccatgctgtatgatattggctgtgggtttgtcatagatagctcttattattttgagatacatcccatcaatacctaatttattgagagtttttagcatgaagggttgttgaattttgtcaaaggccgtttctgcatctattgagataatcatgtggtttttgtctttggttctgtttatatgctggattacatttattgatttgtgtatgttgaaccagccttgcatcccagggatgaagcccacttgatcatggtggataagctttttgatgtgctgctggattcggtttgccagtattttattgagtatttttgcatcaatgttcatcaaggatattggtctaaaattctcttttttggtttgtgtctctgccaggctttggtatcaggatgatgctggcctcctaaaatgagttagggaggcttccctctttttctattgattggaatagtttcagaaggaatggtaccagctcctccttgtacctctggtagaattcggctgtgaatccatctggtcctggactttttttggttggtaagctactgattattgtcacaatttcagagcctgttatcggtctattcagagattcaacttcttcctggtttagtcttgggagggtgtatgtatcaaggaatttatccatttcttctagattttctagtttatttgcgtagagatgtttgtagtgttctctgatggtagtttgtatttctgtgggatcagtggtgatatcccttttatcattttttattgcatctatttgattcttctctcttttcttctttattagtcttgctagcrgtctatcaattttgttgatcttttcaaaaaagcagctcctggattcattgatttttttgaagggttttttctgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcattcagtgctataaatttccctctacacactgctttgaatgtgtcccagagattctggtatgtkgtgtctttgttctcgttggtttcaaagaacatctttatttctgccctcattttgttatgtacccagtagtcattcaggagcaggttgttcagtttccatgcagttgagcggttttgagtgagtttcttaatcctgagttctagtttgattgcactgtggtctgagagacagttcgttataatttctgttctattacatttgctgaggagtgctttacttccaactatgtggtcaattttggaataggtgtggtgtggtgctgagaagaatgtatattctgttgatttggggtggagagttctgtagatgtctattaggtctgcttggtgcagagctgagttcaattactgggtatccttgttaaatttctgtctcgttgatctgtttaatgttgacagtagggtgttaaagtctcccattattaatgtgtgggagtctaagtctctttgtaggtcactcaggacttgctttatgaatctgggtgctcctgtattgggtgcatatatatttaggatagttagctcttcttgttgaattgatccctttaccattatgtaatgrccttctttgtctcttttgrtctttgttggtttaaagtctgttttatctgagactaggattgcaacccctgcctttttttgttttccatttgcttggtagatcttcctccatccctttattttgagtttatgtrtgactctccacgtgagatgggtttcctgaatacaacacactgatgggtcttgactctttatccaatttgccagtctgtgtcttttaattggagcatttagcccatttacatttaaagttaatattgttatgtgtgaatttgrtcctgtcattatgatgttagctggttattttgctygttagttgatgcagtttcttcctagccttgatggtctttacattttggcatgttttttgcagtggctggtactggttgttcttttccatatttagtgcttcctttaggagctcttttagggcaggccgggtggtgacaaaactctctcagcatttgcttgtctgtaaagtattttatttctccttcacttakgaagcttagtttggctggatatgaaattctgggttgaaaattcttttctttaagmatgtggaatattggcccccactctcctctggcttgtagagtttctgccaagagatcagctgttagtctgatgggcttccctttgtaggtaacccgacctttctctctggctgcccttaacrttttttccttcatttcaagtttggtgaatctgacaattatgtgtcttggagttgctcttctcaaggagtatctttgtggcgttctctgtatttcctgaatccgaatgttggcctttcttgctagattggggaagttctcctggataatatcctgcagagtgttttcccacttggttccattctacccrtcactttcaggtacaccaatgagacgtagatttggtcttttcacatagtcccacatttcttggaggctttgttcgtttctttttgttcttttttctctaaacttcccttctcacttcatttcattcatttcgtcttccatcactgataccctttcttccagttgatcgcgtcggctcctgaggcttctgcgttcttcacatagttctcgagccttggctttcagctccatcagctcctttaaggacttctctgcattggttattctaggtatccattcgtctaatttttttttaaagtttttaacttatttgccattggtttgtatttcctcctgtagcttggagtagtttgatcatctgaagccttcttctctcarctcgtcaacgtcattctccgtccagctttgttctgttgctggtgaggagctgcgttcctttggaggaggagaggcactctgctttttagagtttccagtttytctgctctgttttttccccatctttgtggttttatctacttttgatctttgatgatggtgatgtacagatgggtttttggtgtggatgtcctttctgtttgttagttttccttctaacagacaggaccctcagctgaaggtctgttggagtttgctagaggtcaactccagaccctgttgcctgggtatcagcagcggtgggtgcagaacagcagtggctatagaacagcggatattggtgaactgcaaatgctgctgcctgatcgttcctctggaagttttgtctcaggggagtacccggccgtgtgaggtgtcagtctacccctactggggggtgcctcccagttaggctgcttgggggtcagggacccacttgaggaggcagtctgcccgttctcagatctccagctgcgtgctgggaaaaccactcctctcttcaaagctgtcagacagggacatttaagtctgcagaggttactgctgtctttttgtttgtctgtgccctggccccagaggtggagcctacagaggcaggcaggcctccttgagctgtggtgggctccatccagttcgagcttcctggctgctttgtttacctaatcaagcctgggcaatggcaggcgcccctcccccagcctcactgccgccttgcagtttggtctcagactgctgtgctagcaatcagcaagactccgtgggtgtaggaccctctgagccaggtgtgggatataatctcctggtgtgccgtttttgaagcccgttggaaaagcgcagtattagggtgggagtgacccgattttccaggtgccgtctgtcacccctttctttgactaggaaagggaactccctgaccccttgcgcttcctgagtgaggcaatgccwcatcctgctccggcttgcgcacagtgcgctgcacccactgtctggcactctctagtgagatgaacctggtggtacctcagatggaaatgcagaaatcacccgtcttctgcgtcgctcacgctgggagctgtagaccggagctgttcctattcggccatcttggctccaccctcctggagattttttaaataaaacaaaactaggtcaaatgtgcaccagactaattaaatcagaattttaggaggtgaatctaggtatttgtttttttagtattaatatttgtattgtttatattagcgtttaaaaactattctcaggtgattctattgtacattcagtgctgagaaacattcttgaataagaaattctgtcatgctgtagactcctttacaataaaataggtactctagcaaagacttgcacataggaaaaactcaaaggtacaatcaataaatgagtctcaactattttatcttttcagaagtatacatttccctgctttttaaaaaatcatatatgaagcatgatttaatttcttcttgacaaatcaaggccatgactataaaagcaaactaatactctgtattaaagtggttaaaggggctcatattagtaaatgctgttactaatacaatatttagtaaacactaaagtcagtatttttcttaagcatgtttctgaatttaatattgaagtctttaagaggctaataaatataattagtatttattgtgtcagccacacttaaaattgaacaaaataggctggacgtggtggctcacacctgtaatcccagcactttgggaggtcgaggcaggtggatcacctgaggtcaggagttagagaccagcctgggcaacatagtgaaatcctgtctctactaaaaatacaaaaattagctgggcgtggtggtgggtgcctgtgatcccagctacttgggaggatgaggcaggacaatcgcttgaacctaggaggcagagtttgcagtgagccgagatcctgtcaccatactccagcctgggcgacggagcgagactccgtctcaaaaaaaaaaaaaaattgcacaaaatattttaaattccctgctctccagaaacttacattctaccagggatagaccaacagttaaaaaaacaagtagattgtatagtatgttaacaagtaatacatgctgtgattaaaaaaaaaaaaaaaaaaaaggtggtggggaatggtgttggaagtgccaagagctagggtgaaggccctaaactgggagcatgcctgggacgtttggaggaacagtaaggcatggccagagcagatcaggcaagagggtgagcagcaagaggtgagagaggcaggcgacggggacagttgtggaggggcagtcatgaaaggatggttgtattgggctgtgcagactgttgtagggacttcggctttttctctgagtaaaatggggagccactgcagggtttcaggccaaaaaggagcttgctctcatttaggttttaatataatcattctagatgctgtgttttgcaaagtttgtttgctgggggcagggtggaggggcagtagaagcaaggtaacgagtagtccaggagagaagggtgggtcagaccagggtagctacaggatttcttgatggcttagatgtttaggatatgagaaaaaaagagaagtcaaggattactccaggatttaggctgttgagatggttagggcaatttattgcctacactaaatattttcttttctttctttttttttttctctcttttccctcagtgtcaagctatcaacttgtgtttgttattgctgttattgtatctgcttctagtttcgctcacctattttaggatatattacttttgtttaaatcttctgtgggccaaaaaacacaaaagttttaaaaattgtatatttaaaataagattgttggtttaacatagggcctctgagtgagagtttgtgttgttgtatttaggagtaaagtgaatcagccttaatgccaggacttctaacagttgcattccctgtggaggccttaagcttgcttttgaattcagttatgttgttaatgattaagtttgccagaactctaaatctctgaatgagaattcatttatatttactttatttrtttaaacaggcaaaagaatggaccccagcaggaaaagcaaagcaagagaattctgcyaagaagttttattctgaatctgaggaagaggaggactcttctgatagtagcagtgacagtggtgggttttataatttattggcatatrttatttacatrgtagattacattctatatctcagaaacaaggcctaatccataatattcagcaggtagttttaagtgaagtttgtattatcaaaataatccctttcatttatatatcactctttagttttcaaagtaatttttaattactaaattctctttttactttacaatatctcttggatagtagctgatacattggtatagctgaaacaggaactcatacttttctgaattctaaaccacaatgcctaatatatctattgaaaaacataattttacacttgatgaacttttagtggggtctttaaaagtaactttcttttacaaaaaygtaaagtttattttataccttgaagagtctttttctctttcattttatacttatctytttctgtgaacctctatagagataaagctaaaattattaagtctctatatactataaaaaaatcaaactaaaggttgagggtaactatatgcagtgaaaagaatgcttaataggaaggatttagaggccctggcttttacctatgcaaattgaataaggcacctacttttctctatatcagataaatgaaggggtacagttaaatatttcttaaagtcccttcattgctaaaattctgtgagtgatttgcataatgaaaaatagattgtagtcactttctgatgctcttattaacacttaagctaataggcaaatctgacccaagaccaaacgacacccaactttctctaaaatctttattccttggagaaccagggcctgtcactcttacatggttatctgctaccctactgtaaggtaattcactcttcttttctctgtcttccttatcaaaaatctttgtttttagtatctgataaattaatctgtgatacattacctgtaatttctttcattgtttatagcataagccagttatctgacttaatatgtatgtgcgtgtaacttggatattaccacaaatctaaaatgtccttatttagtagctttattttagtaaaataaactttcctgtttgtaaatgatgataatgatgagtgccttaccctgtggcagaccctgttgtgttctaatctcctttgtatgtttcaaatcatttaatcttcacaacagctctgaaaagtaactagtgttatccccatttgctgaaaaggaaaccaaaacccagagaagttgaataacttgttcagttttacaactggcaagtagaagagccaggatctgaatccgaacactaacttgagaacccatgcttgtaccccttgtaagccgtcttaaaacaatacaggcagtcctaggttttcactgtgatggaccttcctgatgttggtattatttaaccattagaatgtttaattaaaggttatgttcctgcctaagagggcttcgttacatagatcacaggcagggcaacagtttgtccttttgtctgggacacaactctgtagttatagtcattttaaatagtaaaaattatgcttcacttaaaaaatacacatatattcttcatgtattctcttctgcgaacagtcctagcataccataatttacacataaaacatttaaaagtataattcctcagtgtaacttgatcatctctttgacctatggaaaactcgtttactagctcgaataagtaataactctttaattagtcattttgcctattgtctttgaatttggaggtctttccaagtgatttgaatggctcattttcctctcaaaatttgttcctaagaagattcaactrttgccttcttttactctaaatagaatttcccattacaagcagaagaattcaaaattatttctttagccttacatcaatccttacgtaattctttaaaagaaagtttttgacatagctatatactttggggtttgaagtgagattccctcaaatttggtttacttggttcacctttgcttagcttttctctcctcgttgtcagagcatcctctgtctgcctccctccaagctcacagtgctaaaggaatccatagagctgaaagaatggggtgtgggaataaaatgttaaacaagtggtgtccactgaactaaaattcaacatctggtttcatttgtgatgaatattgacagttacaggtgtccgtgtgtctaattaaatgactataaatctaagaacatctggttctgtttttcagagagtgaatctggaagtgaaagtggagaacaaggygaaagtggggaggaaggagacagcaatgaggacagcagtgaggactcctccagtgagcaggacagtgagagtggacgggagtcaggcctagaaaacaaaagaacagccaagaggaactcaaaagccaaaggaaaaaggtaacttattttgtcagaatttccttcaaaaaatattctgtgaaagtttgccccaggcagagatgtttcttattaatcaaaaaatggtgagagaaaaaaagtgtgtatttttttccagatattaaatctttttaaaattaaagtgctagttgttcacattattttcctacttgtaatgcttagctttcattttgaacttgaacatatcttggggttacattttgaaaattggtataaccttggaaggctgagttaagtgatcaagcaataggtatgaaacacttaattaccttttgtagcgattttgctgagggctaaaattaaatccttcaacactttgccattatgtaaccaagacaattgatttttctaaataatgttatattaaaaagattatgatccaaatattagagtcaagggctgtgaaggaagacggtcataagatctttaagtgttagcactttttaagatctcccattatcaataacattatcatgtattaaagtgtcattaaaattttgagtaattgggtctaatatcttggattgtgcaactctgttttccccgctgctgtcagcgagtggcctctgccgacatgatggtcctttccccgggagcctgctgcccgctcacttgatgagcttgcagcccggctcagtcgtggctgacagcactgattggggcgcagtacgctctctgctccttttattacagacagtaattaaagcagctckccctgccacttccataacaaacacagcataatgccctaattatgactttattaatttaagtcaggatttaatgattttaaaagtgatttatattgtttttcctgttcagaacaaatgaaatctgtaggttaaattaatacaggcttttcatcattgcaaagttaaaaacctagttaccagtaaattcttttcattagattaacatctgaaactctaagcagtaaggtaaacaataattaccatcaaaattgagtgatgcataataaaataacacttttacttttaaaatcttatcttaaaagctagaagttgaatatatttagaatcattcacttgttgcagcaaaggagctacttggtttataatagccttgtctttgagagaaatcctgtacttctgctttaatatcagcatgtctatgatgatacgagttataaaacatgtcctgtttctagaaagggaaagttttgttcagtgcatgaaatgtcctttcagatggcaaaagtcagtatactcaaaatttgtagtcatgtattaggtttattattcttttcttcagaaatggatttttctctttacccatgtttgaatttaaaagaattgtttattacaaagagaaccacaaatacattctaaaccttatatttttaagtacacattttaaccagtgaattggggataataaattgccatttttttgccagggaaaaacaacaacatatttttcagtcttcaaatataattacatgtgctctgagatgttaccatggctccatttttaataaatagcaatcatatttcctccacaaaaatcaattctaggaaatattgattctttccttgtctcactcctctccctccccctgtatttttctgtctcagaattttttttaactttgccagtatgataattttttaaagctcctaataagctttaaacatcttcaaaaaccaccctttagtaatcataaatatttatgaccaaatttaaattttacactccaaggtattttcatttgaagggagatagtatgacatagtggaaaaaatacggactttggaatgagacaggcttgagttcagattctagttctgcccctcttgttatgtgcccttgagcaggttatttaacctttctaaatattaatttcattattgtaaatgggataataatgtacccaggaagagtgcatttaaattagataattagtatgattggtatgaagtgcctagccctttctggcccacagtagattcttaaaaaaatacacacacatgtggtagagagaactagacctttagtttccaggaaaatataaagcaccacaaggcatttgtcatcccctgagagaagggtgtttggtcatctcacatgttattccttctccttggagaactgtttccctgcccatctgccagccttactcctatatcttggcttatatgtctctttctccaggaagcattcctaattggatcaagtttttttaggtgtctctccacatgttctcctgacacgctataatttattacttattacttattatactgtattatcactgcaaccttatctgtatcctccagtggaccgtagaccctgtagggtagacacacagagatcctctgtgtcttactaaccatcgttatccttagcacctagcataatgccaacatgtagtcaataattaataaatatttgttgagcaggtgaacaaatgaatggtgttaagcacttaggtatgatcatttgatattttaaaagtttatatttgattagcttaaatttttagcaagatagtactttagaagaatttcctttgaactggttaacattttctcatagaatgtgtttaaggtcacatttgggaacttgtgtaagtaattttcttgggtagaaaatgtataaaatacaagtctattttagcagaagtagatatataaatatttaaatatattactaaaccaggtgtggtggctcaagcctataatcccaatattttgggaggtcaagttgggaggactactcgagcccagaagttccagaccagcctaggcaacctagtgagaccctgtctctacaaaaaatataaaattagctggatgtggtggtgcatgcctgtagtcccaactacttgggaggctgaaatgggagcatcgcttgagcccgggaggtcaaggctgcagtgagccgtgattgcaccactgtacaatgagaccctgtctcatatacgtatatatatacgtatatatacatgaatatatatgtatatacgtatatatatacatgtatgtatacatacatacacacacacacacacacacacacacacacaggcacagtattttgagatagcgttttaaaaaatcagcctaaatatctttaacgttgttactggtagtacttaattcttggtaaatcaaacatttaatgttttctacattgcttttgattatattgtttagtgtcattttatgactttttgcatttgaaatttgtatgacaggatagaattgaatttgaatgggttctaatttatttggttatgggtaataccttttttattacctcattaatgtattctggaatttaaaaacaatttttktataaactgcttatataaaggagttaaagttcatatttcaaaatttactattatgtgtagygattctgaagatggggagaaggaaaatgaaaaatctaaaacttcagattcttcaaatgacgaatctagttcaawagaagacagttcttccgattctgaatcagagtcagaacctgaaagtgaatctgaatccagaagagtcactaaggtaagagattatacatttgttgtaattgaaggtaaatattcttatagcaactaaaatagacaacaccatcctcatctactcctgtgattttattttttctagataagcctttcccttataacccaactctgcagaaatgctagaaactttaaaaaatctcatcccttgccactgaaatcaaggaactcttacgcatatgaccttttttgttcttggctaggttgtgacaaggggggggttttgctgaaggggaagtgaaaggaagtcacaaaaatagtattgagcaaagaattataagtgtacatacatcataagaaattgagactattcaytttttaaaaatattgggcattttgcataatagagtgtgttttaaggcttcaattaaagagtatacattctttagttagtaagaatttgcgtagccatttatttaaaaacaaatggaaccacttatataataaaataataatgctttttggtaataacatttttaacactgaattttgcctgcttagcaggaaaaaaataaagtataaattgcaaaaatatagttattaatataaaatgtattctatctgatttcaagtctagttaaaagaataaaaatatagaattcagacctaacgataattatctttttggtctttaataatcacccccttcctataactggaccatgttcatgctagacttcaagtatagtatttttatatacaactgtgttattctgtttgttgaaaatatggccaaactctgcctttgattcagttcaatttcttcttaatccaatattgttttcgtttatttgttctgttaactggaatctcttcaatatgttatctgagtaggcaaggatgaaaattaatttattgaartagacaattgccctcccccatccagagatttattgttaaagaatgttttaaaaattggctagtatttgtcttgccttatttcacattttcttgcatatattaaaacctatcttaaacttgaatttatatttaaaacttgtgtctgtatataaaataacctgagatttttatttttaaaaaattcacataaaatcttaagagattttatggtttattaatctggcctcatataaaaacttatcacttagtgagtctgatgtactctcatttcatacttacatcaaattaccagaaagtttaaaatgttattgaaaataaagagagttacaaatcgacagtaaatacaacccagagtaagaagtattttttaaaaatgacagaacaagaaatcagtgagtgtcaagtggtagaagttattcttaggaaattttgtaacagttgaaaaattatagacttcagtgcctctgtagtattagaagcagagctttaggatcccattaaaaagccacagtggttgaacatcatgttgtgttgtaccccttcctccccctgaaaaaaacaaaagaagataaaaaccacaggggcactccaggtcagtgattctgtttgtttcttctttgtcaaagactttcagtgatcagattaaatctcttgatagttaaaaatattttcctatagaacgtcagtataaaaaacctcaaactattgcagtgaaccaaggcctttgagaaattcgggtttcgctcacattgttgatagttttgtgttcatgtgtttcccttaggtggcttattttctttatattagaatgccttttcccatctataataggcatacaggactgtggagttttttgctttagtttagcaactggaataagtactctccaccttggagctaccataactacttatttatttctgtttctttctgaatgatttggtgtataccatgcaattacagaatatacctattttctaataataggtgactataattgtggaaaagtcctccttgcaccaagtgttgtggcttctgccctaaattatgagtaatgaaggcagatggtgggtactttactttaatttagcatgacaatatgttagtgctgaaaattcatatgccttatatctgcagcctaactaaatctatatttttactctttcttttcttttttttcatccagacaatgtgttttgagggcactgagcatgaaaatgcgacctaggagttaccttgaatatatggctttcaaaacagttaatttttatggtagtcctatgagataagcatagtgttctacttgttgggagagaatatctttgtttcagtttcctcatctgtaaagcagacatgctagtacctaccttacttctttcaagtgttatgttaaaaataaaatatgaaagatcaatgtaacacactatgtaaytataaaacaacagttttaacatttttaaaaattccataaaagatcaacagtattggagaacatcaaatgctaaaagtaacctaaattttttggtaactcttaagtatcctgctctttttttttcactctttttacactattcaagttgtaaggcaacatttaattctgttcccttacctacagcctctgagcttagccactttccttagaagacagctgccatccacggtcagtgtttctgctctctaactcacaatctccatttaccctacttttcctttgaacgcagctctgtgtaagactcgcatccacttccccaagggtaactcctacttccttttggtcttgttttgttaataatcatctgtctcctttgcacctttaatctctttctccattcattccttttctgccaactgtggcattcaggttttttcagcatttaaagagagagagagggagcatggagtgaaaaaaacagagtgtgtgtacatgagtgagagtgagtttagaaaaatattctacatatcctccatcttgtacttcttaacccagttatttccaactctatcctacacatactgctctctgaaaaggcagctatgatccttccccaaacccagtagccttctcttaatcttgatctttttttatgactattcccctactacttaaaagtctctgcatcccttttgttcttacttttttgacctttcattcttttggttgcttcactttttacacgcctctgacacccaagtgtgaatgttgaccccaaattagtacttagtacacattagtcttttgagatattaattgatgtgaatgaatttttctttaatcttcttttttccctctaaatttttcctgttgtgagacctcattcactcctatagcttcagctaaaacatttatattaattacttccatggtaacatctttcagtctttacattaagtttcagcttttcttcccaaattcataccaaatttttagacctctctgaggctactggttttccaaacctaatacaatcaaaagacatgctctaccatttgtcaccagcattcttttcattctcccagatctgaagccccagaattatctctgactactctgtcattctgtatgtttagatagttaccaactcctatatgttctgtrcgttatttctcatgtctgtttcttctttccctactgccactattctagattagctcttcattacctgcatagaccattgccattggtcatcctctgaccaatgctttcccaaccccaagtccttctatacaactgccagatggatattaaattcacctgtcctgatggcccactgccatttgagttcagtaaactcaggctagcttgcccaaacctaccttgtcttaaccctacccaccttgtgttctttctttctttctttctttcttttttttgagacagagtcttgctctgtcacccaagctggaatgcagtggcatgatcccagctctctgcagcttcgacctccaagtctcaggtgatcctcccacctcagcctcctgggtagctgggactataggcatgcactaccatgcttggctaattttttgtatttttaatagagaggggtttctccatgttgcccaggctggtctcgacctcctgggctcaagcsatccacccacctcagcctcccaaagtgctgggattacaggcatgggcaaccgtgcccagccacacacactaaattctaatcccagtggaatatttgtggttctattaacactctgtattctttcctatttctatgcctttgttctttctttttgcatcatttactacacaaaataaaagctagggagaaagtggcctcatatcactgtgaccctccacttctcctagttgggaatggctgcagggaatgaaaaatgttactgatgatggggtatcactcatgtgaatgggatagtcaaaagggtgagaaccacaggtggattatttatgttcttaaaatgccccagcatattcacgaggcacaaaactatagtcacacattcaggtgccatgtttgtttgtttgtgttattgattggaatatgtcctcatttgaggtcagatgttgttagtaatgaccatagaaaatttccttgttttagttataattatgttgattgataagcgtattttatgtgtaggtgttattttctgagatatatttaattgagaaatatttttagtatagtcctttcaatgaagtaattcttttgttccaaataacacctataacaaaattacttttagtaattccttattttaagtgatttcacatactttacacaatgtaaaggggaaawttttttttatatgaaacagtggagagaaaattcagtgatgtagaccacattgtgtcaggaagagattcacatttatatcactttatcctgtttttgaccaatataattaagttatattctgcttgtagttaaaattatgtgaacagatggtgaaaaaatttatttaaaataatgcttttaaagtttccaggatttttatccttcatgaaacctaggcttcagtgttcttayaactacccagtatattagagtgctcctccacaccatagttatttcagctacgttgttagtccactattcgcaccttattcatgatgcaatattctagttatatctgtagtgtctgtgtactaatggctgaagatttagatactctatgattaaaatgataaaaactttaaattatgattgtaatttattgtgagtaaattttatgtattttccttatatgaacattttaattacataaactatataaagcataataatctaccaatgtgaaataaatattaagtatttaatgtacttgcacttaataatacttaatattaaaagcatttcagtatttgaattaaaactaagattaaggtacatactagctatgaagaaaatagtaccaactgtatatacgtagcagtgtttgagttgctcttgtcagttgtttttatctcaggttatatttgtgtctcaaaactttgctaattccttttgggaggtgcaaagaaactgagtgaatctcttaggtgctctaacgatcagtcactaggatttgactggtgtctgaatgtcagtaaatgttaagatttgccttaataaaakattttggcaataaagatcttttatttgaaagattcttggggataaagtaaatttggcatgtggtgtgaaataaatcatggataagagtgaaaggaacaattttttgattggttttatgttctatttgaaaagtaagcaagttttagttatgtttttacaactatttttgtatgttgcaattatataacttttataaatattgaagaatattgggttttactgttataatgcaaagccttgcctctcagtttatgtctttcctgatttcatttatattttaagttctctaaaataaaaatattattcaattgcagttgagacctttgaaaggaagtgaatgccattaagcaggctttcttattgaagtaggcgtactctaataggaaaagatctgttttagtgggttagacttctttttaacttataaagaagtctcaatttactagcagtgtacttttgttttaaagcacaagtttaagtgttagcctcagatttttaaaatcatatttgtcagttaacttgaaggaaaaaagtcattaaattatctttggttgataattctaattgaaaatatttcatgcaaatatcttgtcctgtgaggctagaaattagctttgacttcttgttgatttcaaagcacagtatggctttgacagactttacatactgcttatcctattttatagtttcaaatttcaaacctctttacaatggtttcctcttagaatgcatatttgatgcttgtcatgtcagatcttttttgctatttgccttttttttaatcagcatgaaaatgaacatgcataatacattaacaaatcttttcaggtgtattgtaacatatttttgtttgtattatttggaggttaataagtatttccaggatcttttatttattatttgaagtgaaatacattaaatagaaatcagtttttttgaccctgtgactttgtattgcattttgaaaatgttgatgtgttgaggtgtataattgaataccatagaaacaaaatggagatttgaggatgatgaattgataactaggtattttttgtggtgagattctaagatcagttactgttgtccttataaaagtctaatacagtcactcagctgttaaaagcctaatcctctatttaaaaaaatatacaaaaacaaattgtctatctttctgcctgatctcttctcaagtactaacacaatggaaacagtgggtgatctgtcaatgtgtttggtttgtcgatgatggttttgtataaatattgggagggtaagaaataaaatcgcacagtaaaatatgatttcatctgccttttctctgcagctccatggctcatgctgcggtgtgaaattctcattttacacactttgcaggcggagcacatgaattatgcattgagcaagaaaaatctcctgcctcaagtcctatatgcatttacccaggttctgtctctattaccaagatgaattgcaaatggagaaatgtttgatggaatagagctcttaacttcttygtttagaattcagaattttatttttatagtagatcctttaagtatgaaaatgttttgaacttactatggattttttaaaatgaaaaatgaaatataagaggaataccaaacacatcatgaagcattttatagcgttgattcagaatgcaagggttttccaattcagtagaaatgaccattatctattgctaatgttatatttcagtcactggttatttgctgttctcagaaagtcartgaaattctgtccttttgaaagccttttttctctctgttctaggcttctaataagagattatgccaatttcacatgcagctctgttctgtgttatatgtgacctgatatgtatttaatagatattgttacacactcttggctgtgaagtagaaattaaggtatagacttgccttcagctttaaytttatcttgatttgataggtttctaatttttcaggtggggaggttacagttccataaagacagtcatgcaccattgtagcttataggaagctacacccattgtgctcagcatagcattttgataagtcacatgatggtatgctctttttgttatatgttctttcttcacaggaatgatattctagttgagacagcattttcattctgcacttgttttcatttacttgcaacttttaaattttagcttcaaaactaatgtttcttctatttttttcaccatcttagacattgtttactcatttgagaaatggagagagggacaaatactgtttcgttcatttttaaataaggaatgaaaattaaaacaactagatgatrtggagtgttcagtgataaaaataattactttgaagaataaaattagtgcctttttaagtgtattaataatgtatattattatgtggtccttgaagtttctgagtatcaggacaagggaaaaaacaagtgaaatttaaattattttaaaatgttacctatgtataattttacgtaatgcttttgttcatgtatgtgcactgttgtaggagctctaacactgtgtaaactttaaatagtgataaaatatattttgctttagtggtaccgtctcgtggctagaggaatacttcaaaaatatttattagcacattagcaataagctatagacttttggtaaattataagttatttgaaggcaggactatatctatcttggctgttatttccattgcttggcacagaatctaatatatatttaaaattctatacatacctattgaatgaatgaatgattaaataaacaaaaacattttagtagaaactttagttttggtctgtgattgagaaaatttaatgtaaaaaatagtatagattagaaagataaactttgactcaattatatttaacgycctactctttgttggcctttagttgtttgtaatgcacttaatactgttttctttttaaaagatttacaawttttttctgaatatctaaccaaactgtgaacagttcaggcttaggggcactgtattctagttcatggatatatacattttgtaagtacagtagaccgaataagcaaatctctgctgggggaagccctagttatatgcagatatgtttttgaaatatttattttctcaacaaaacagtagatcaagtgagtgagtcctttcaactctaaaaagaaagagcctgggaatgtcatttatagattttaatgaatatctttggcaaagaagtttgatacaacccagtatagaaacataaaatatctagtacaatgcctgtcacaaactatatcagaaaaggctgacctatcacaagcccatcaaaaatatctgagctatgcatatgttatttctttttcttaagtaaacctgtttaaaagttattttcaagaatatttgtggactttctaccaaagagccactttacgtttttatgttagcaagaagttgtccgattgtagaataattacatacctttaaattttgttctgacatttataatttttaaayacaaaatagtttaagagtttgcatagtgggtaagaaatactatatgctaattgagacaaatgttgattcaggaaaacattttatataaccatacagaagtttaatttgttggtaccactaagcagaggaaaaaaaagtttgttttggaatattaaggactactccacagatttttaaaacagaacgtgtgataaatgaaatatttgttattttataggagaaagaaaagaaaacaaagcaagatagaactcctcttaccaaagatgtttcacttctagatctggatgattgtaagtattgtaatttaaaatatttcttctgtgtttagtaagagtattttttatttttatagtacctttcatttacatgtcccaaaatatatcaatatttattgtgaaagacttatagatgaataaggcaagaaagttttggaaatcagtggtatttgtttctttcatctattcagcatatcacttcattatcacatgaacaaatatagatggccaaatacaagtacacaaaattcattttaaaatcttttgctttagtaatttatacttgtttgctaaatagtcatccataccttataacttctacattgtgaaatgtggatyatggggattgacacatgtaacttaaggaggtagaggattaaggaatgtaaatmaaaatggaaaggacatcaccatcttccacttggcacaatttcagtaggaatggaaatgggttacaaagcctttggaggccagtttggctatacctctcagtcttttaactgcaaaaaatctttgtcccagcaaatctaagaattcagaatcctacaaatatattcacccaagtgtacaaagatatatgtatttaccacctccccttaaatcctcctgcatagtgagagagagatagtggtactttgttgcactaggagaagagtaacaagaagtgagatttcatgaatattaaactactatcatttttgatagagtttttctatgctgagagtgagttatgttttaggttatctcattctgtcatagatctgttctgtttatactgttacctgccctgtccccagtagccatggcatatacttaatatagagaaattaaaatatataatagagagaaataacagagaaactaaaaataaaattggagttaaatttgaatcatgttttacacattggctaagattttgaggtttggtatcatccagtgttgctaagatttggagaaacagaagtacatgtttttgataggaatataaataggtacagctctttggagtcattttagcaatatctatcaaaacttaaattgcacataccctttcacctagcagttcttccccgccccccgagacggaatctcactttgttgcccaggctggagtgtagtggcactacctcggctcactgcaacctccaccttctgggttcgagcagttctcctgcctcagcctcctgagtagctgggactaccatcaygcccagctaattttttgtatttttttttagtagaggcgggtttcactgtgttagccaggatgatcttgatttcctgacctcgtgatccacccacctcggcttcccaacgtgctgggattacaggtgtgagccaccacgccccactgacctagcagttcttttccagaaatttatcctactgataaactactgataaaatcagatcttatttctttcttgttttaaacccttgaatttaatggcttaattttgcatttagatgaaagcccatactcctttcccaggtttctcagactgtagatgatctgacccctgtcttcttgttatccacatttcatcctactctgtttttatgcatttgtcacacataccaggctcatttctgccaagggcctttctactgctgttcccctgctgagaacaattgactgatccttacttccccaactcagaagtcacctactcttacacactgtcctagtccctttgagctggcataacagaatacgttagactgggtaatttataaacagcagaaattagttgttcgtagttctggaggctgggaagtccaagatcaaggtgccagcgtatttgatgatwggtgagggctagctctgcttcagagatagtgacttctgtttcctcatgtgacagaaggaggaaacaccatccctcataccacttttataagggcaataatcccattcatgagggtagaacccctataacctaattacctactaaaggccccaccataktctggattaggtttcaacacgaattttggagggacataaatgttcagaccatagcacaaaccttcttgttattcttgttattcttgtcattcttgtcttcatggcatttttcactatctgaaattaccttaaaattttggtacttgattattgtctctttctcccaactaagatgtaagttccatgaggacagggtctctgtgttgctcactgctattcctagtgtacagagtggctcctggcagttagtgggcacccagtaaatattgcttgaattaataaaacatataagggcatatacaaaartttcattgcagcattgttcagtggttagctctggcctccttgtgatgtaggactaacctgggaacagacaagaataagactttcattttatattttgtatctttctgtgacatttgaatatcttacatatgtatgtttgtaaccttcataatttacaaagtttaaaattgtaaaagaataacagtaaagtacatttaaaagggaactaagagtaaatgttacaaggtactagagtgtactaattacaactttttcttcttatattcaactctggatttcctggcaactacggtaaaaaaagaaaaacctataaaatgacataattgttatagttccattctataaaaaagtatatttttatatgttgagatacaagctttttttttttattttttatttatttatttttatttttattgatcattcttgggtgtttctcacagagggggatttggcagggtcataggacaatagtggagggaaggtcagcagataaacaagtgaacaaaggtctctggttttcctaggcagaggaccctgcggccttccgcagtgtttgtgtccccgggtacttgagattagggagtggtgatgactcttaacgagcatgctgccttcaagcatctgtttaacaaagcacatcttgcactgcccttaatccatttaaccctgagtggacacagcacatgtttcagagagcacagggttggggggtaaggtcacaggatcaacaggatcccaaggcagaagaatttttcttagtacagaacaaaatgaaaagtctcccatgtctacctctttctacacagacaccgcaaccatccgatttctcaatcttttccccacctttccccgctttctattccacaaaaccaccattgtcatcatggcccgttctcaatgagctgttgggcacacctcccagacggggtggtggccgggcagaggggctcctcacttcccagtaggggcggcctggcagaggcgcccctcacctcctggacgaggcggctggccgggcgggggactgaccccccccacctccctcccggacggggcggctggccgggcagggggctgacccccccacctccctcccagacggggctgctggccaggcggggggctgaccccctccacctccctccgggacgggatggctggccgggcagggggctgaccccccacctccctcccggacggggcggctggccgggcagaggggctcctcacttcccagtaggggcggccgggcagaggcacccctcacctcccggacgaggcggctggccgggcggggggctgaccccccacctccctcccggacagggcggctggccgggcagggggctgacccccccacctccctcccggacggggctgctggccgggcggggggctgacccccccacctccctcccggacggggctgctggccgggcggggggctgacccccccacctccctcccggacggggtggctggccgggcagaggggctcctcacttcccagtaggggcagctgggcagaggcgcccctcacctcccggacggggcggctggccgggtggggggctgaccccctccctccctcccggacggggcggctggccgggcggggggctgaccccccaacctccctcccggacggggcggctggccgggcggggggctgacccccccacctccctcccggacagggcggctggccgggcagagggactcctcacttcccagtaggggcggctgggcagaggcgcccctcacctcccggacagggcggctggccgggcggggggctgaccccctacctccctcccggacggggcggctggcctggcgggggctgagccccccctccctcccggacggggcggctgccgggcggagacgctcctcacttcccagacggggcggctgccgggcggaggggctcctcacttctcagacggggcagttgccgggtggagggtctcctcccttctcagatggggcggctgggcagagacgctcctcacctcccagacggagtcgcggccgggcagaggcgctcctcacatcccagatggggcggcggggcaaaggcgctccccacatctcagacgatgggcggccgggcagagacgctcctcacttcctagatgggatggtggccgggcagagacgctcctcactttccagactgggcagccaggcagaggggctcctcacatcccagacgatgggcggccaggcagagacgctcctcacttcctagacggggtggcggccgggcagaggctgcactctggacgctttgggaggccaaggcaggyggctgggaggtggaggttgtagcgagccragatcatgccactgcactccagcctgggcaccattgagcactaagtgaaccagacacygtctgcaatcccggcacctctggaggccaaggctggcggatcactcgcggttaggagctggagatcagccyggccaacacagcgaaaccccgtctccaccaaaaaaatacgaaaaccagccaggcatggcggcgcgcgcctgccatcgcaggcactcggcaggctgaggcaggagaatcaggcagggaggttgcagtgagccgagatggcagcagtacagtccagcttcagctcggcatcagagggagaccgtggggagagggagagggaaagggagagggacagggacacaagctttttaaaaaaatcaagtttttaagaattgaaatgaaagtttttttgaattttaagggaactttgatcccaacctacattttttaactcaatataggatatagtgtttctctttgtttttaatacccaagtgctatttctttaaaaatctttcatagtcctgcttttgtcagaamcgacacttgaaactctcttgttaacaagtcagttcagcctgtgttttctggattgtctgctaagtgcaaggtactttagtaggtgctgtaatagataaatagaatttagtcattcccttccaaaaactaaaatctagtcagagacacagataacaggacaaataactattgcatacgagagaaaatagagatgcaaagtatagtgaagaaacagagagggagatgaaaacccctcttcagggttttcattaaccccaaattaaaaaactacaaaaaccttgtgaaggaaccatgatctgagcttagagataaagacaagcagagtgccaacttcactgtatgcctcctattagcctgcaatggttctccattgcccatggcatgcagtttgttgctcagatactaaaatgttactctccagtggctttagttctcaactgtgagaattagattaatcttgaaagaaggccagacacattccctgtggtttatctaagaggcacatcataatccacacaggttgtttgctaggtacacagtgcataccaggaagactgcaagtactgaatttcttcatttcttcattcaggaaatgttaatttaatacttgctgtgatctttgtaatctgctacatactggagattctaaatgaataaaatattgtccctacccaaggaactctcaaagtgtaatgggaaaaacagataaactggcaattagattgccgcattatagatgaaatgaggagaaatgcacaaaatactgttcagtatcaaggttcctaatccacctagcrgtatcaaaatttaacttttgagttgagtttaagaaagcatcagttggccaggcctggtggctcacacttgtaataccagcactttgggaggccgaggcgggcagatcacctgaggccaagagattgataccagcctggccaacatggtgaaaccctgtctctactaaaaatagaaaaattagccaggcgtggtggtgcacacctgtaatcccagttactcgggaggctgcagcaggagaattgcttaaacctgggaggcggaggttccagtgagccaagatcacaccactgcactccagcctgggtgacagagtgatattccactacaaaaaaagaaaaaagaaagaaaaaragartcagtcaagctgttagaggcatgaggggagggtatactaggcagaataaagttatggaggagggaaagagcttgctactaccagaaataatgattgtctgtctctaaggcagcaaccctagcaatagactgactctactacaaaacaatttggttatttctcttactatttctctattatatctgttgagggaatgttatcatgagcacaggtattagtcctatgcttttaatcggtttagtggtttctttgtgtctcattttattcatttgtaatttttttaaagactataaaacttccacagtttctttagatcattaagttatatgactctttttcatgggggtcagttaacaatacataagaaaacatttgttctaggataatatatgacctaacagtcttttgttagacttagagatatcaatatgctttctatgtttcaggcatattttatattcctggaaattaaacaatatattttaggaccccataccatgtgctctcagtaggacgatcayaaatcagtgatcatattctagtgttcttttataggaaatgtaaacctatgtcattacattgttagtacaactgacagtgaaatatttaaaaaatctctgtcagccaacaataatcatacttcaaataagccttatgatatgtgatatcacattgttgagtgaattttggtcaaggcagtagagtggagtcactaagaggacagtggagcaagctgtctgagtttcaatcccagctctgttactcactagttgtgacatcttgggcaatttacttaatctctccatgctttagctgctttgtctataaaattgggatggtacaaatacttttgggagtcatttaattctcaaaggatgaaatgacttgatatacgtaaaagcatttagaactgtgcctracacatgataggcattactgggtttagtgatgatgctggtgctgatgatgccaatgatgcagatgatgcagcaaattacaaattaaataacaacatattaagccattatgtattcagtttttcttattcttaaatcttaaggcaaagctttgatcagaagaataattgaataattactgtattagatctacttttagaaaagaaaaaagttttatagaaagtttttaaaataaaaagaagaaaataaaattaacctgtaatccaaacaccccaggttaacattctgacatatcagtttagattctcttcatatgcaaatccccccttccaaattggattctactgagaaactgttttatcayttgctttctcctctgtttaaagtacatgttcttagttggtgtggtggctcatgtctataatctagcactttggaggccaaggcgggaggattgcttaagccccaggaggtcaaggctgtagtgagctgcaattgtgccattgcactccagcctgagtgacagagcaagaccctatttccaaaaacaaaacaaaacctacgttctttataactgtatggttgtcctttatcctgttagaacaaattctgtttaacagatttactgttgttgggaatttagctgttttccattttttgctatcataattagtgaagtaacattcatcattgtaaatatatttttcaatatctctgtaactgtttccttaagataaatttccagaagtagtattgctggaacaaagactttgaagaatttgtttgtccaaaattgccttttaggcttggcatggtggctcatgcctgtaatcccagctacttgggaggctgagacaggaggactgcttgaagttgggagttcgagaccagcctggacaacaaagtgagactcctgtctctacaaaaagatagaaaaattagcggggcatggtggcatacacctgtaatactagctactcaggaggctgaggcgggaggattgcttgagtccagaaattcaaggctgcactgagctgtgattatgccactccactccagcctgagtgacagagaaactcctcaaaaataagtaaataaaattgcctttcagaaagcttgtaccagcttacacagtattaatatgagggtgctatattccttgtaccttcaccaatgctagattttgtattttaaaattaccttttctaatttgccaggtgggcatgatatttcattttaacttgtatactatgacattttttttaaaaaccccatagagtcactttgtttttacacattactaattaaatacttcagcacagtcacctagcctcagaattcactttagggtaagctttcaatgccaactttcatcttgccatacctgcaaacagatgcataatcatctctttaataccagagcacacatcttctgaaattatattaaaacccatccttttttaaaaaacagcagaacttgcttgtggtgtgaagtttcttctcttgtctcttgatggtatttagccaagccacagttgaaatcagaggctgtttcttattcagttttttattcgttacatgggcattctaatattttgaaaggacagatggtggacgggtgggtagatagatgtacaaaggaatgaataaacatgcatttagaacttacctgaaaagttacgtgttgcatgggaaggcaacatattatgatccaagttagmagaagcagtttctaattctatagtggttctaccattcactttttatgaccttgtcaatattaatctccctgtggctcagtttccagtgtcttcaatattaaatgctctttttaagccttctcattgccattggcttactttagtctttttcacttcattcctaaactattgtaaattcttccctactcccaaccctgccttcagtctgtgcattgtactgccatctgattaaccatcctgcaggaccatattcattgtcattcctctgtttgatcgatttttgactgttccccttggtctataggataaatccagtccccttagtttttcaatttcctacctctcagcctttgtttatagcattctgttatccaacaattaactggcttctttctttcctcttattcaaatctcacycttacttaaaaattggacttcattccctcctgttcatgaagcctcctcttccactccttctccagtgatccttgttttgcccctgactctgtgacacttgctaaactgtaccggggttttcagtgtgggtctaaggaagcctgggggtttgaagctgtgcttcagccgtactaagtgagcgtagggaagaccaagagctccactccctccccatccaacctccaggctgctttctctattatatatgttgagattttgtttagtgtttcctttgaaatttttcttctttggccgtatcatttatggactgtattgttacttttttttttttttttttgtcaaatacatgtatctctttttcttaattaggttttgttacttgaggatcttgaacttttttgtctctcacttgctacctttcagaataaatatttgttgttaactttayggattaatatttgttctgccttgttcactggatattgtgagactgaaatgagaaaaagatgctttgaaaagtaatgtcacagctgggtgtygtggcacacgcctgtaatcccagcagtttgggaggccaaggtaggaagattgcctgagcctaggagttagcgaccagcctggacaacatggggagatcccatctctaaaaaaaaataaaataaaaaataaaaaaaaaaggctgggtatggtggcatgcacttactcaggaggctgagattgcttgggcccaggaagggattgcaccgctttactccagcctgggcaacagagcaagaccctatctccaaaaataaaaataaaaaaagaaatgtcaaattaactaaatgttattccctttagggtattatcttggaatgagaatttgttggaagctaaaacttgaccacattgtaatgtattttattcaaatggtttagaaacaccaaaaattaatgttattgtctgttcacacagactagcagaaatgcaaacatgtaaagacacaaatttgtattacatgagaagtacagttatagaagtttgttcaagtatatctgtggaacaaagaaggcacatataagctgtttgcaggtgagccagagagtgttttccttttaaagggtagcttgccagatcgaagttgcaagatgagcaaggcagagaagtaggcaaacagagtagaatataaaaggctccaagacgtagaacaagatcttgggaactattatcccatagagctagtgcataacaatgctgaaattggagataagctggacctgaatagtccagtatggcggccacaagccacatgtaattacttaaattatgcaaagtttaaaatgcatttatttagtcatactagccacatatcaagagtatgttaggcatatgtggctagtgtccactttatcaaatgtagaacatttccattagcataggaagggctgtttgggctggggcagaccatagaggactttgtgaacttaattgaggagttgggcttttatcttgtaggcagttatgagcctttgaagagtcttaagcaggggagtaacatgaccagacttgcatttttagaagatttccaaacttacaggtatcagttctcaagtatatagcagttttagaatcagtcaaacatttctatctagcacatagcttttgctgaaaaagtataattacaagggaattaggtagcctgattagagtggagaataaaatagatataggatttgaacatctttcaagacttctaattccactgcagcattctcttgraagcggttgttattcttatgatagtctggaaaaaaaatgtttctttacttttttagggagattactgggtgataaatgttagtgataatgttatgtgataaaaattttcacaaactattactcaagatatttatatccttattttgttataggatttgccattatgttttgaaagctaagactaataactgccatgacttgataataagttgactaaatcaagatgttaaatagaattgtcatacatttattaatcaaagtaatttaattagatttactaacaaaataaaaatgttgcttttaataatttgaattaaacgttcatgcacatttactaatttgggccttttcttacagttaacccagtatccactccagttgcacttcccacaccagctctttctccaagtttgatggctgatcttgaaggtttacacttgtcaacttcctcttcagtcatcagtgtaagttatttttaaaatccaccagctcggttttcttatgttgccattgtatcttttttattaaaatgtaaatacttgaagtggattcttagttttgaacagattcttctctaagaacaagcccaatttagctaagaccttttaattttttaaataatttactcaaaccattatcttctcaatttttttcccttgttgtccacacttaattatcatctgtatgtttttctctggtattgttatatatctgtaacatacaaaggttcttcaccacattgacgcagtacatatacctgaactgtgccacaaaaagttgtctacattaacagactttcatttccgtaatcgttttattcctaccacactattttttcatagactattaaaaattcatgactgtttttatttaaaagttcaagatttttttttctgtcttatttttgtacatttatttacatgtgttggtgtctttaaaattattctttaatgttatttatagaatgtgatgtgaagtgaggctagaacctacctgtcacaaaataatgcaaaaaccgtcaacatatcatggtatttgaagctgcaacaactgtttattgtgttagcatattatatccactaacttttcactgtaaatcaagcacgctgcgcctaagatgtataatctgttgatatgcttgacctcctgttaatttgttgtcagaaatctgacagactaagagacagaatagtaagctttgatgggcataggtagcttcaatagatctggttctcagggctggcagggtactacatggcatataactgatcatctgagctgcctgggagcatagagctgcttctgccaaaagtgggagaaaagaagtgtttaattcttgtgtgttattatggaaaaaattcctcctttaaagcaaatatgctatcagggctatgcaatgaaatactaaaaaaagctatctgcatttctgttcaacattggtcacctcgctcagaaagtacaggtgaaaagttttaagctacaatgttctccttaagcatagaatgagattatctcttaaccacccagaaatgagtaagaatggtatttgtgattttaatttgcccttgtttctaaaaggaaaagacacattaaaagatatgagggagaagcattgaaaataagcagttaagtcttttatttattcaggtaataaatatttattgagcatttgtggtagtctctaaagaaaaagtgttaatcaaaaaatcaatagtgaagcagttagttccttgaatggaacaggaggtccctaaaaccttggttggcagtaaggtagtgaataaataataacttgggccctgatatcagatgtccagggtgcaaacccctgctttgccacttaatagctatgtgactgtgggcaaattggtacttttacacctcattttcctaagagaatactatctaccgcataggattgttatgagattaatgaaataatatatgcaaagctcttagaacagtgactgacacattgtcattactcagtaaatattaacgaatattctccaaagtgatacgatatgtgataatggactctgagtgtagactcttctactttattaataataagaagaaagcagttgagattagaaaagcttgtagtaaattttcattcatcacaaagtaattgacagactcacccttttatactaaggaaagtatttattgagatggtctcttcaaaggaaagaaaagcactccatctaaagttgggcaaaaaatgaccgccagttgacacggctgagtgaagcaggaccacaacactcactccccaaaagctaacaaaatgatcaaacaagtagcgctaaaaagaatgacaaccagaagttcaccagcaacaataaaatatggacaggaatagaactttaaacaaagaaaatgctagaactctgaaaaatggaacgtgtagaaataaactgaatattctactgcagaatgtcatggctcctaatagcacatccagccctcagaacagtactgagaaaagaagatgaatcaaccagagtttaagcttcctcattatgtgtctgaatttggaaagaagtggacagaagacatcagaggaaaataaagaaaacccctcaagaattacaactcccatataatgctgtgagatctcaacaagtctaggagcttttttggatcctgaaatgaagttcatagatgatagagtacatctataattttaaagtcaacatgttgtcctagttgaatagaaaaaataaaagtaatatataataaactaatattttcaatgatatgtaactgtttgaccatgactacactagaagtagttaaatgatgctggcactcgtatatagaactcatgaatgtgagaactatatgtgcagattgatataggtgtgttattcggcaacgcaaatgctacgggttgtggtatttccatcagtgacataattttccaaacactgaacagtttttctgcaccaaagtacttgcatccctggaaaattgagcctgttaaaatcttgccaaagaaaaaaaaaacttcgtattttatatgaaatgttctaggattgagtaattttaagcacgttgtccaacgtgtttaacgtgtctaatgagacagttgaatgttartagtttcattttctcatagtaggaaacagagcttttgtgagggacatggtacagtctgtatcgtcaggatctgccctattcattactacgaacatctagcattcctggccttcactccttaaagctagtggcatcttttactgtccctccctccggttgtgttctagttgtaaacgtcaaagcattatgtagcagtgaaaaccacaggctcttgattcagaccacctgtgttcaagtcagagttctgcgctttacaaattagagacttcgggcaagccagtttacctcccagtgcctccattattttcatctgtaaaatgatcatgctacctacctcataggattgttgttggtattaaatgattaacaaacatgaaatgtttatgacagtacctgatatgtactaataactaaatatttcctgttatcattttcattacacgtacatcattagtgcagctttataaaggaaatgaagtgtgacccaagaaaactgtgttttcttcttactattaaggctgtacatagatatgctgaaacatgaaaattactatggattctactttaaagaaaaaagagtggggatactgctgattgttgaaaccaaggaaagggtgattcaaagtaatagaatcagtagctataaaaattgtgatcatgtgattgagtataaatgataaaaataagaaaccaaaactagaaggtggggaaagatgacaggatgcatggtaattattttttcgatgtaggtaggaaaacactccgtaatatgcaaaattgaaaccgcttttgtttttgtttttaatgaaatgcaaacctcttaatgatttgtatatactcaaagaacatctatctgatgttttggagggttttttattttttggttttaattccatttctttttcttcaaagtaagattatagtcccattctaagggataatttgtctgtttctctgtgtatctgtcagtggttacagaaatgtcacgttcaccatggttaacagttactttagatggaatggtttcagaatgacttgttgattgttttggtwcttttctgtaatgtttaaatgttttataataatataatgataactttttaaaacaaattattactataaaaatgagcaaaasgacwagaactggaaaaattaatttatggtataacaaatcagaatagtgcttactcgtaggagaattagtgcttataaggaaatacaagagtagcttctggggtgctgataatgttctgtcttttgatctgggggctgttacatgggtgtattcagtttatgaaaaatatcattgagctttgcacttaagatatgtgtactttatgtatattctacttcaataaaatatttttaaaagtggacaaatgatataaacacattattcatagaggaggaaatatagatgataatatgcgaaaaaggttcagtggtagtaatgaaaaaatgtagaattaaagaaccatcttgcctgtaacattagcaaaaattacaaaaaccaacatctgttgttgctgaggtatgcaatgaagcaggcattatacactgctccactggtaaaagtataaattatgacatcattctggatggcagttgggccatctgtataaaaagccatcaaaatatgtataccttttgaccaggtaatctcatgtctagattcttcttctaaggaaataattagaattacacagatttatgtgcatggttgttcaaacctaaatgtctagtgatagtagtgatggttacaaaaagtatgcaaaaacaatttaaggaattttgtacaattattaagatgtttttattacatattttaataagataaaatatggtataatgtmagatggaaaaaaggatacaaaatgttatatatataatctaaattttgtaaaattgtacaattgtactgttttcaaatacaaggaaattgaaagagtagaagaaactgcatcataattttaacagcttttctgaatgatgagattatggatgttttatatttaattttcttctgcatatttttaaatattttccagattttctctaatcaagatgtaatacatctattacccaaaaagcaatacttgtaaaatagaaatggaaagcacatatatgaatgacgaggattcctttttatttgtttgggtctttttcctttccttttccttttcctcttccttttctcttcttttctttttttttttttttttttttttttgacagggtctggctctgtcgcccaggttggagtacattggtgtgatcttggctcactgcaacctctgcttcctgggttcaagccatccttctacctcagcctcctgagtagctgggactacagccacctgccaccacaccctaatttttatatttttgttggtagatatggctaatttrttggctaattttttaatttttgttggtagagctagggtttcaccatgttgcccaggctggtctcaaactcctrggctcaagtgagccaccacactcaaccagattcctttttattgacccatctgatatctgtctttctagatcaccactactaattaattgggtgatattgagcaaatcacttggttttttttcaactatgaaatgatagcaaggcagatttccatgtttccttttaactctgatattctatgtgtgtatgaacctaagatggaatttcaaattaatgaaaataatttcactgggataatttgaataagtttgttaaaataaagagatgaaacttttttagtttawatgatgactttctagtccatctataatttttatttattctagtaaatgttatttgttttccttatgtatattagattttttcaattaacaaaatatttacagtgaaacccaaagaacaattgctttttcacagcaaatatttttctaattaaaaaagtcactatttgttcctatccttttaattatatattcagaacacagagattttaaaaaataatgcctgacaaacattattatcattataaggaaaggctttagtttttttaataactctrtaataaatattatttataaacacagcatgttttagtcttgccagagactggccattggccaacagatagctctattgagggaacattttatttcctgctgtagtatctgagtgaacaaaccggttaacttagtaaattttttttaatggattattatttggtcctgagtttaaatcaagacctgcaaacacataaacatcaatccttaaaatgtatgcttcttgcagggatgaaaaaagaatagggggaaaaaagacaattttgtgtgtaagaataaatgtgaaataagaataacttgttcacctctggtattagaaatgttgagtgaaactttgatctgttgtgctttaaattactttgtatatttgggtcacaaaaattttaagtgaataaaacagttaaagttaactattttagtgtatgttctgctttaactggtaaacatcaacatgaaaccttgactcatcctttgcgttttttgtttcttatcaaactagttgtgtaagaaaatatatttatttactcactatttaagattatgtttttatggaaaaatcagagtctgaccttcctaggttaataggttctcaacgtggccgggcgcggtggctcacacctgtaatcccaacactttgggaggccgaggcaggtgggtcarctgaggtcaggagttygagaccagcctggctaacatggtgaaaccccgtttctactaaaaatataaaaaattagcctggggtggtggcgtgtgcctgtaatcccagctacttgggaggctgagacaggagaattgcttaaacccggaaggcggaggttgcagtgagccaagatcgcgccactgcactccagcttgagcaacaagagcgaaactccgtctaaaaaaaaaaaagsgttcccaaggcaatccccaaatgtcataataccataatggagatatactatctgtgattctttaacacctaataacaagtcagaggttttctgtggaaatacacttttagagttccaccttaaaatgctaagaactcatttagaaagacagagtgacatttgtgaaatgcattgaatctggagcccaaagacctggttttcacccttgcctgagctgtgtttattatcattgtgactttgagcagttctttgacttgcgtaaacttccgttttttaatttacaaaatggagataatacttttcccaaacactttttttgttatgaaaatcaaatgaaataatgatcccgaaaatgtttgaattctattctgtagctgtaaaccctgaaatctagtccaatggcaaaatgaaataatgatcctgaaaatgtttgaattctattctgtagctgtaaaccctgaaatctagtccaatggccgtggaacaagtggaatagtgatttggcaacagataatagattcagatttgaggatcttggcctggatgtagactataggaggaaggattcagtcaaaattgggattgacagggtagagaggctccaaggcctttatgttcagtaataacatagggttgatgtcacctattccatttytttcccttcctcccgccctcaaattggatactagaactatgcaggaaaagcgactcagtgaaacaaaaaacataaggtcctcaggaagcaccaggatctgcagaatcagggactgaaaaacccttattgtacasaaaggattattgcttagtctgcccagcaaagttggccatttttgtactgggcatatctaaatcaggcagaagtcactgcacgccaaacctgaaagcttgtgatgggattataactgttttttttttttattgcaaagaattcatactaaaagtaaatatcagtttgctctaaaatgtttgggattgatttcataatttttctgttcctcagaacttaaaagggaaaagaaagttaaatttcttgagtaccttcagtgtcttaccgagttaaggaaaaaactacagatagttatattcctaaagtaatgtaaaaggagcagtgagtggtacatgctattccttaataacaaactttttttgtttcctatatacctctttaatacaaccaaggatagtgttacagtaattcacacgttctataaaataatgaagtatgccgggtgcggtggctcacgcctgtaatcctggcactttggaaggccgaggcgggcggatcacgaggtcaggagatcgagaccatggtgaaaccccgtctctactaaaaatacaaaaaaaattagccgggcgcagtggcgggcgcctgtagtcccagctactcgggaggctgaggcaggagaatggcgtgaacccgggaggcggagctagcagtgagccgagatcgcgccactgcactccagcctgggcgacagagcaagactccgtctcaaaaaaaaaaaaaaaaaaaaaaaaatgaagtaatgctgtgaaaaataggctcggcaggaatttgcacgtcttgcatccaagtatgtctcttccttgtgtcgtattctgtgctgaagaaaacattagcatgccatgaactgaagccaaatatcagtgggttaagccatctctcatcttgttctttgccttctcttctttaagactagggaattggttattggataatgctcccaagtctggccaataataactcaagagtaccctgaatcaacatctatggcttttccctaaaccctgatcttagggccatccatttgtattttgaaatgatcaagctatcctttactccagctgaaaacttacttacctgatacttcatcaggtctgctcacaggtgtatcaaagagagacggtacctttggtgaaaccattgtttagctggttttcacttcatccagttaccagccaatcaaaagtttttccaccgatcatattttcrtaccattgattgtattaacctagtttaaatcaaatctaaaatatgtgtgcttattacaattattgaatggttgcatgtgagggttgttgggttttgtaaaacaggaagcttatttttaaaatttttaaagtggtgaaaagtaggcttctctaaaaattagttttaacagtgtgtttgcaaaaaaaaaaaaaaaaaaaaaaaaattggaggcatacccagtgggtatttcagagagtaatttggaaatattcactctagttgaataatgtattctccatgactcactaatcgatgtggctacacatgaaaacatgcaagaatgttcaccgacacattgtaagagcaaaaaaaaaagaaaaagaaaaaaaaaaaagaaaattggaaactacatctatcactagaatagatacataaattgtrgcatgcatatacaatggaatactgtgccagttgttaaaatgaatgaactggaaatacctgttagacaaatctcaaaaacaatagtaagaaacatcacaggctgggcacagtggctcacacctgtaatcccagcactttgggaggctgaggcaggcggattgcttgagcccaggagttccagaccagcctggtcaacatgacaaaaccccatctctataaaaaatacaaaaattagcagggcatggtggcacacacctgtggttccagctactcgggaggctgaggtgggaggatcacttgagcctaggaggctgagattgtcaagagccaggatcgcaccactgcactccagcctgggtgacagagtgagacctgtcaaataaataaataaataggaaaattacaaaagaatacataggaagccatttgtagaaagtataaaagtatttagaattatttaattgatggatgcatacatatgtggaaaatgtttaaaaccatacttgcaactggcgaacaccaaatccaaattctggttacctctgatgccagaagcaaaaaggaaagcaatctgggatgggtatacttgtgattgtcattcagatktttaaagttttactcatgatgctcgatgggggagggatgttggattttgtttttgttttaatctattctttatacttctttgcctgaattattttatatacaggtttttataaatgtgagctacattaaatatatactaaaatccaaagtataactaaaataaaactatcaatagtacacttaatacttgagtccgggttttgtgcttccaaattctattccttttcttccatatctttctgctttcctttagaattatatactaaatcaatctttgtatataccgtatgtkgtaaactccttagaattatttaattaatgaactgcatttatatgtcctgtaaaatsttatttgctccatggtaggtcttttgcttcttagatggtgcaaacttagtccatccttcattccatgcttaattttcttaaattctcaattagagttcagattaatgagggttttatttctgtaaaattcttttgtaaaaaagaaaatgtcttaagattcctgttccaaggaattatataagaaaattgtaatgaaatagaaatatttcaaccctttagattttatttcaaaaaaaaatgttaacttatgttagccatgtagttgattgtggatggtacctttttaaaaaacattcagtaagaagaattgacagtattctaacatgagtttaaagcaggatttgcctttgrcaaagccagacacagatggtctgactttcagatggtggaatactagctgtattacttaaggcttgcattttgcaatgtattcatgaatatagtcaataaaaatttgcaatacctaagagctttcatatctgaaatctgtaaggcaggtaacaacacatgttcccctaatgtttatgttgttcatagataccagtgagattctctagatatttgcattctaacatacatgcagactgaaaggctttattatagcttaatttcatttacttaaaagctttattgaacacagtatgactaaatcactatgctaggaattacagataacaggttaataaaacatagtcccttcctaagggagctcacagtttagtgaatgaaaaagactagaaaacttcattataggagtacagacaagggagcaagtaattctgcaaagagtgcctatcaatatggacttggatagcgatatttgtgttgggtcttggagaatgattgagtttaccaacagggaagaagaggagatgcgtatttcagcccagggaatggccagatgaaagagagaagataaaatgtatattatgtttttgccaaattctgtagctagatatagctagtgtacaaaatgtatgttttgggggagagagaagtagctactggytgaaagccatattgtgaaacagttgaaaggagttctgaagattttagagcaggttattgatagtgatcagatctttgttttataaagttgtgtgaaagattaattggataggaagagaacaaaggaagaatttggtaacttttaggtagataactgagatttgcaccggaatgattatctggatagtggtacccagttaaccaagatagaaaataaggargaggaaaggacaatgacattgaaattttctttggaacatgttactctgaggtgcttttggaacatcaagttagagatgtccagtaagaaggtaaaatccattctggattttagtgaaaaattagggccaactaattagaatacaagcatgtgcacatgtgtgtgcatacacacacatcctaaagccatcaggttatgggtaatggtttaaggtaggggaacagaagggaaaccttgtgggtgagaagagacaactgaagatggaatcctagggaacatcatgctttagaagacaacaaagaaaaaagccaaataaaagcagtgaaagaaggaggtgagtcatagagcagcgtgttatgaggaaactcacaggttactgagggaaatagtcaaatcattaatgtagtaagtgctgaactagagacaaatccaccaagttctcctgggtgacaaagatctcttagagaagatatacatatgtaaccttggaactgagtctggaagatgagtttgcctaggtggctggagtagaagaatgacgctcctagmagaggaactagtatacctgaaggcttggggtgtggaagaactggagtattgctgaaacagtatttcaatgtagggtttaagtataacatgtgtaaccagatctgatacttgagaagtatgttggtgacgcactgtcatgggaaaattgtagtaatgattccttaacttgttttccaatctttttgtgtgccggtacatgtagaaaagtggcaatacctgtaatgcattctagggtaaacaatgctgaaggaggttggaggcacccagtctaggagctccagctaccacagaccccagttggccttggggattcatggggggcagtatcgcagcacacctctgacccatttgtggcaaattagtgagggagctctgacttagctaccataaagataacagatttgatccttgtggatcacaaaccctaagtggaatttaattttggacagtacaggaaggctcattaagaaaagtgatcatttcaaaatgcaaaagtggtacactgaggaatagtaaggaatttcaagaacaatccatgaaacaaacaaaaaggcctaatttgttgttgtatgcctcttggaggtagccaaactcaaggttaaaggcacagtcctccagactaagttggcccaagatttctgacaccarctgtaactttacggatttcccaaaaccactctctagttcagtaattttctagaacaactcagagaactcagaaaagcactgtgcttaggattacaattttagcaaaatgattcaaattagaaccagccaaacgaagacacacctagggcagattctaggagggttccaaatgtgaaacttttgggttaccctactggcatgaaaatctggcaatatgcatggactattgccagccagggaagctcactgaaccttgacatccagagtctttattgaggcttcatcatatagccttgattgtttgaaatattgccacatggttgaactctagccacatagttgaactcagtctccagccctcccctgtctctagaggtcaggctgatattaagtagctcaacgccccaaccctctaatcacatggttggtctttctatcttggccagccttatcctgagttatctccttagcataagctatctgagggacctgtcatgagtcacctcagtggcataaattatcaggtgtggtcccaaagggcccaccatgaataacaaagacacttttatcactggggaaattccaagggtttagaggtcgccyctcaagagctaagagaaagtcctaagcctctttaggttaggtcaaattccttactacacatatgccaattaagtgttttattcatccaacatgtatttattcagaccagaatatgaagccatggatatagtggtaaacaagatgggaaagcttcttgccctgagaaagtttatagttgactgggaaaataaagaaaaattgcctcaaagtatgtaattacagtataccaagtgctctcctttttgtaacagttttgcccatttggaagtatccgtagatacaagttgtctttatttgtcattatttctctggttatgaacataaacactattatttgatatttgctaaattccacatttccaccttttttcctctgtaccattataacttaaaacctaaaagagttactttcaatatttgacacagcttaagatttagatayctgaactactcttctcctttagcaagaagtagaaggatgattttcatagtccgtactcttcgccgtttgctttccttgaattaccattgaggaccatcactttgtcacttgatgaccatgccagggtgaagctagcatggaatatcagtagctagcatggaatttcctatgaccagcaaaaagatgacgttaagtttggcagcatgaccaagaagccctgtactcatgcccctcagctccccatggatttataggccgaaggataggaagaagcaaccccatttgtaatccacttgaatttgggcacccagagtggtacaaagaaaagccacaaagcaaatgtagcttcygcagtttttatcatttgtcctatcaggttccttatcaaaggaatatgggaaattggctagcaagtagtcttacggatttttgctattgtcgaaaattggcagccagtggagttacaactcttccgtgagttagggataagtccctgacccagtttgtgttgtaggaactcaactgggaaacagaagactcttatcaggcctttcctttgttttggtatggaagtcactctgttggttttaaaacaataataagaaaaaaacaaaccataattcatgaagaagtatctgattcactccatctgaaatctactaaaacagtatttggaattattaggataattgtgcattataatagtaactattgtgattgaagttagttgcattgtatttaggatttcagtttctcttgagtagtcttatcttagatatatcctccccaaccacccccctaccagttctcctcactctcttttaattgctactagggtattttagttttgttttccaatstcttatattggcagagtgctagacttttttcaagttggtctgcaaggagagattgctttgagggacgtctttgttgaatatgtacgtttactaagttatatgccagacatttcatgaatatgtgatctcattcaaaaaattatatgataaagtttttctaatatagtagaagaatcatcttttttttttgagacagggttttgcttttgttgcccaggctgcagtgcagtggcgcaatctcagctcaccgcaacctccgcctcccaggttcaagcagttctcctgcctcagcctcctgaggcatgtgccaccacgcccggctagttttgtatttttagtagagatggggtttctccatgttggtcaggctggtctcgaactcctaacctcaggtgatccacctgtctcagcctcccaaagtggtgggattacaggcatgagccaccgtgcccggtgaagaactatctttaaaaaaattttttttttccattttataaagttaaggtatattcaggccccaggctaagagacaagtccagctaagatcaaattcctttgagtttggaagagggagaaattgtaagtcaaaattaaaaataattttgtcattttaaatttaggaaaaatcctttatttgttctgatgaaaatgtcagtagtcatggaactgtggtaaaaataatgaaaaatcactggcctgggtctgcttcaattgaaaacatttttaaattaaagtgtgacagtattttgtgcttccattgcctagccatgccccatcttattcttttattcaattctctgggtatgaggttgctttaattcttaaattaaaccttaaggtatgtcatcctgctgcttgatctttctatttctatgctacttctgaggtactcataacagaccattttcatctctccttttcctagattactaaaaggagctactttttaaaaagagattgttattaatttttagttggaatttttttattgcaaaatatttttaattggcttaagcaaatatgtgccagtttgtcctaactggcggatagtactcataatgttagttgttagtattttagtaaaattccccacagtgacaaatcygctgaatcagatgctaattatagttattaatgaactagcaattatttgtggcaaaaaacccaggtcacccaaaaaaacaaaggaaacatgcacacagatctgcaagaaattgaaggattaaagaggttgtgataaagaaagccttaggcctttcgacttcccttcctcctcctttgtggtaagtagttctgctggctgtgagttcacttgtttcagagctgagagttcactgaacatctatccacttttccctaagattatgatttttagcttttaattattattattaaatataccacagtaggaaataagatgatttttaaaatataatttatttaaaaatgtaatatgtttttaaaagattcatcttttatggcagttttgtcatcttcggtgaaaatatgtaaataaatgartttctgaaattctatcttttaaaaaacagttcatagtctgaaattatgcatttaaaaaaggcagttcatagtcacacaaatttgatggaattttgtgtgactatgaattgctatatttcaaattttgttgctactgttgaattgtggtattgaaatgaaaaatatagtttttaagcattatggtatcttagattatgcattggtcaatcatatagcaaatattatttaattacatgtcagccaagttaacttctgttaccactgttccccttaaaaacagtgccaaatttttttctgaacacagggcagggcatggtatggaaattaataattcttattctaatagtattaaatctcttaacatgagaaacctgacctaaacatggaagatgttatgatatttacaaaacctttatttctcttcgaaggaagagaaacgaatttagctgtagratacatgtccaatgaacactaagaattgattaccactgacaagagagtatggagtaaaaacaagtacagtatataaccctaatatcaaagaaaagtaaaaaccacttaacttagaatatatcagacgtgggctgggcgtggtggctcacgcctgtaatcccagcactttgggaggccgaggcaggcagatcacgaggtcaggagttcaagaccagcctgaacaacatggtgaaaccctgtctctactaaaaatacaaaaatttgccgggcatggtggcttgtgcctttaatcccagctactcaggaggctgaggcaggagaattgcctgaacctgggaggtggaggttgcaatgagcggagattgcaccattgcactccagcctgggtgacacagtgggactccatctcaaaaaaaaaaaaaaaaaaaaaaaaaaagaatatatcagacacattgttactcaaatcattcagggaatataattatatacagcttttataagcctatcagtaagtgtttttccttaaatttgcagctgtttttcattactgaatttatgacttttcccctccaaatgttaatatggaaaatctgctttacacctctgtacaaataatactccccccaaaaaacaaaacagaaaatttcagcaaattccaattcagaaggcatatacctttagattaagagagatttaaaagcgataccagccaaatgtgttcatcttgcttgaattgtgattatctctaaaatgatatgcgtgaaatggccaaggaaatgtgaatactgtattttaggtgaaattagaggaatttttgttttatatcatttttagatgtgataatattgtatgttttctttcaaaatctttatctgttacatatacaaaccaaagtatttactgatgaaataatacatggaatttgcttttcaataattcagaagttgagtaaaagattasattaaacaagattggctaatgttggtaattttgaaatttagtgctcagtatctagttgttcatcatatcagtgtccctgctcctgtatacatttgaaaatttttcataatgcgtttttaagtgcgtaatttcagaaactcattcatttacatattttcactgaagatttgacattcatgcttcatagaatatgtgacctgacaaaatatcttgtaaatataaactagtacatcaaagtttacattcakttcaggctgttagctatgaaattagggaacaggattctagagtcccttccagctctaaaatttctagaaatctaaagaaagtaagtggagagacttcaaatggcttcagtaaacatcatcagcataggggaagggttgccttgtcttttacattagaaatatagatgtaataatattggagtctgggtttctggaagatagaacaggacctttttttattcccagtgcttaatacataataggtgctcatcaaatgtgtttggaatgaattaacccttcctattttccagagtcatcagtatagaacccattaacactgctgtcagtttaaagaactccattggtgtttgagtgtttatttatttttattttatttattttaagttccaggatacatgtgcaagatgtgcaggtttgttacataggtaaacatgtgctgtggtggtttgctgcagtatcaacccatcacctaggtattaagcccagcatgcattagctatttatcctgatactccccctcctcccgtgccccctgacagrccccagtgggtgttgttccattccctgtgtccatgtgttctcattgttcagctcccacttataagtgagaacatgcggtgtttggttttctgttcctgtgttagtttgctgaggataataacttccagctccagccatgtccctgtgaaggacatgatcttgttcctttttatggctgcatagtatttcatggaatatatgtaccatattttctttatccagtctatcatagatgggcatttgggttgattccatgtctttgttgttgtgaatagtgctgcaatgaacatatgtgtgcatggatctttataatagaattatttgtattcctttgggtatatacccagtaatgggattggtgggtcaaatggtatttctgcctctagatctttgaggaataacctcattgtcttccacaatagttgaactagtttacatttccaccaacagtgtaaaagcattcctatttcttcatagcttcgccagcatctgtcgtttcttgactttttaatygccattctgactggcatgagrtggtatctcattgtggttttgctttgcatttctctaacgatcagtgatatggagctttctttcatgtttgttggccacataaatatcttcttttgagaagtgtctgttcatgtcctttgcccactttttaatgtttttttttttgtttttttcttgttaatttgtttaatttccttttagattctggatatcagacctttgtcaaatggatagattgcaaaaatcttctcccactctgtaggttgcttgttcaccctgatgatagtttcttttgctgtgcagaagctctttagtttaattaaatcccatttgtcaatttttgcttttgttgtagttgcttttgacgttttcatcataaaatctttgcctgtgcctatgtcctaaatgatattgcctagattttcttctagggtgtttacagttttgggttttacattttagtttttttttttttttcttgagatggagtcttactctgttgcccaggctggagtgcagtagcgtgatctctgctcactgcatcctctgcctcctgggttcaagcaattctcctgcctcagcctcccaagtatctgggattacaggtgtgcaccacgatacctggctaatttttgtatttttagtagatacggggtttcaccatgttggccaggctgttcttgaactcctgacctcaggtgatccgcctgcctcagcctcccaaagtgctgggattgcaggtgtgagccacggtgcccaatcacatttaagtttttattccatcttgagttaatttttgtataaggtgtaaggaaggggtcyagtatcaattttctggatatggctagccagttttcccagcaccttttattaaatagggaatctttccctattgcttgtttttgtccgttttgtcaaagatcagatggttgtagatttatggtcttatttctgagttctccattttgttccattggtctatgtgtctgtttttgtaccagtaccagkctatttgggttactgtagccttgtagtatagtttgaagtcaggtagagtgataccgccagctttgttctttttgcttaggattgtcttggctatacgggctctttttggttccatatgaattttaaagtagtttttactaattttgtgaagaatgtcaatggtagtttaatgggaatagcattgaatccatgaattactttaggcagtatggccattttcatgatattgattcttcctatccatgagcatggaatgtttttccatttgtttgtgtcctctctgatttccttgagcagtggtttgtagttctccttgaagagatccttcacttcccttgttagctatattcataggtattttactctctttgtagcaattgtgaatgggagttcattcattatttggccctctgcttttctgttgttggtgtataggaatgcttgtgattcttgcacattgattttgtatactgagactttgctaaagttggttatcagcttaagaagcttttgggctgagatgatgggttttctagatataagatcatgtcatctgcaaacagaggcagtttgacttcctctcttcctatttgaatactctatttctttctcttgcctgattgaccagaacttccaatactatgttgaataggagtggtgagagagagcatccttgtcttgtgctggttttcaatgggaatgcttccagcttttgcccattcagtatgataattggcagtgggtttgccataaatggctcttaattattttgaggtatgttccatcaatacctagtttattgagagtttttaacaggaaggaatattgaattttgtcaaaggccttttctgcatctattgagataatcctgtggtttttgtctttagttctatttatgtgatgaattatgtttattgatttgcataggttgaacaagccttgcatgctggggatgaagctgacttaatcatggtgggtaagctttctgacgtgctgctggatttgatttgccagtatttaattgaggatttttgcattgatgttcatcagggatattggcctgaagtttgcttttttttttgttgttatctctgacaggttttggtatcaggatgatgctgtcttcataaaatgaattagtgaggaatccctccttttcaattgtttggaatagtttcagaagaaaggttatcatctcctctttatatttctggtagaattcagctgtaaatccatctggtcctgggctttttggggttggtaggctatttattactgcctcaatttcagaacttgttgatctgttcagggattcaacttcttcctggttcagtcttggtatttacccatttcttctagattttctagtttatttgcatagaggtgcttatagtagtctctgatggttgtatttctgtggggtcagtggtaatatccccttcattattttttattatatctatttgattcttcctcctgctcctcctcctcttccttcttctccttctccttctccttctccttctttcttcttctttctgctttcttcttcttcttcttttagatggaattttgcccttgttgcccaggctggagtgcaatggcatgatcttgacccactgcaacctccacctccggggttcaagcgattctcttgccttagcgtcccgatagctgggattgcaggcatgtgccaccatgcccagctaattttgtatttttagtagagatggggtttctccatgttggtcaggctggtctccaactcctgacgtcaggtaatctgcccactttggcctcccaaagtgctgggattacaggtgtgagccaccacaccaggcctcttttcttctttattagtctagctagtggtctcttttattaatttttttcaaacaaccagctcctggattcattgattttttttttttcgaagggtttttcatgtgtctgtctccttcaattctgctctgatcttggttatttcttgtcttctgctaggtttggggtttgtttgctcttggttctctagttcttttagttatgatgttaggatgtcaatttgagagctttctagctttttgatgtgggcatttagtgctataaatttccctcttaacactgctttggctgcatcccagagattctgttacattttctctttgttctcattggtttcaaagaacttcttgatttctgccttaattttttacccaggagtcaatcagtagcaggttgttcaatttccatgtagttgtgtggtttcgagtgaatttcttaaccttgaattccaatttgattgcgctatagtctgagagactgttaagatttcacttattttgcatttgctgaggagtgttttacttccgatgatgtgatcgattttagagtaagtgccatgtggcactgagaagaatgtatattctgttgttttgsggtggagagttctgtagatatccatcagatccacttgatccggagctgagttcaagttctgaattatcttcttaaattttgtgtctcgatgatctgtctaatattgacagtgggatattaaagtcacccactattatcatatgggagtcttaagtctctttgtaggttctgagagcttgttttatgaatctgggtgctcctatattaggtacgtgtatatttaggttaattagctcttcttgttgaattgagccttttaccattatgtaatgcccttctttgtcttttttgatctttgttggtttaaaatctgttttgtcagaaagtaggatttcaacccctgcttttttctgcttttcatttgtttggtagatttttgaagcttagtttggccagatatgaaattctgggttggaaattcttttctttaagaatgttgaatattggcctccattctcttctggcttgtagggtttctgtgagaggtctgctgtcagtctgatgggcttccctttgtaggtgatctggcctttctctctggctgcgcttacactttttctttcatttcgacattggtaaatctgacgattagtgtcttggggtcgatcttctcacggagtatcttactggggttctctggattttctgaatttgcatgttggcctgtcttgctaggctggggaagttttcctggatgatatcctgaagtatgttttccaacttcttccattctccccatctcttttaggtaccccaatcattcataggttaggtctttttacataatcccataattcttggaggttttgtttgttccttttcattcatttttctctaattttgtctgcctgtcttatttcagcaagatagtcttcaagctcagaaattctttcctccggttggtctgtttggctattgatacttgtgggttgcattgtgaagttctcatgttgtgtttttcagttccttcaggtcatttatattcctgcctaaactggttattctggttaacagctcctgtagtgttttatcacggttcttagcttctttgcattgggttagaacatgctcctttagctcagcaaagttcgttattacccaccgtctaaagcctacttctgtcagttcatccatctcagcctcagcccagttctgtacccttgctggagaggtgttgtggtaattgggaggagaagaggcactctggctttttgagtttccagcagtttttcattgattctttctcatctttgtgactttacctccaatctttgaggctgctgacctttggatggagtttttgtggggacttttttgttgatgctgttgttgcttgatgtttgtttttcttttaacagtcgggcccctcttctgtagagctgctgcagtttgctggggcccactccagaccctattgtccttgctccctcctatacctggaggtgtcaccagtggaggctacagaacagcaaagatggctgccttctctttcctctgggagcttcatcccaaaggggcaccaatctgatgccagcaggaatgctcctgtgtaaggtgtctagcgacccctgttggaagatctcacccagtcagggagcacaggatcagggacctgcttaaggaagcactctggctaacccttggtggaggggttgctctgtgcgggggcgggaatcccactcatccagactgcccggattcctcagagctagcgaggggaaggactaagtgcactgatccaccaagaccatggctgcccytccccagagtggctttgttccagggagatcagagttctgtccctaaacccctggctggagttgctgaaattcctgcagggaggcccagctcagtgaggaggaatgggtccatgttcactctaaagaagcagtctggccatgatctgccacagccactgtgctgcgctgtggaaaattcctccggggtccaaaccgcccagtctccccggcactggcaggggaaaacggcagcctggagctgcagtgatggctgctgccccttgcccgggagctcggtggtcttaggcagcaggcagccacagtgatggcagctgccccccttcccctgccaaagctcagtcatcttaggcagcaggcagctgtatgatgatggctgcccctcttgaactcacgagtctcagggagtctccagccgaggggccactgagagtctgcacagctgtgcttgggacccaaggccctggtggcatgggctcacgaggggatcttctgatctgcgtcttgcacagatccatggaaaaggcgtggtttcctgggcgggatagtacaatcactcaccacctcccttggctgggggtggaagctcctcttgccccatgtggctcctgtgtgggctgttgctccaccctgctactcctcactctccgtgggtcgtgccaaccacctagtcagtcccagtgagagatacctcagttgccggtgcaggattcactcaccattttcattcttcttggtgaaagcctctgaccacagctgtttctagtcagtcatcttggcccctccccactggttaatatgttagtttattacattactgagagaattattcccatcaagcccatatctagaaagtggttgtgctacttacacattccttttattacttagcatgtaatatttaagacagtaaaatggggattaagttattgctttaaattatttgactaaacgtagcttaatattccattctttatatttcttaaatgctctctctaaaaatacagcatggtaagctgaaaaatgaaaaataacattttgattttatttttctgtcaatagagcagatctaaaaatttaaagcacatctttctaaggtaacatttacctcctcacatctttagcagctatcagacatgacatgggacatattcattgaccctaaaaattttcatcagaatcatgcactgaaagggggcagccccagccagacaagaggctcatttcaattttaacggctgtaattaaaggttaattcactgagtcaggattaacaaggaaagtacaaatgataggcaagcagctgcctttataatacaagattagaacaatgcaattacaataagaattagaaaaaatcaacttccagaaagggtcttttaatgaatgaattaaattgtgatctctaaacatgcgtatataaggtaatgcttcttaaggaatcatataaattgatactgtatatctaagcatattatgttaaatgtggaaacaacagttaacactaaaaactttcattattagtaagttgcccaaaaatgtacttgtatatatctgtacatgatctttttaaatggcaaaattttttccctacttcatgctccttttttttttaatgtccactgtgtttacctgaattgtaattgatctttccctcttcctgcccgaccccccctgcaagtacttcttatgtttataccttaaatccatttttcttatagaacgtattcctaaaactccttttccacctagtgttaattagaaagttgacaagtgtcattttcaactttattatgttwacatattttatcatttttwaaaaaaattaagctcagtactatattttatgcagatcctgtttattttttatttgatgtacactttaacctcattgatccaagcttttataggtgtcgtagattgctagaaaactactagactacgtattatattaaacattcctatgtgaaagtcttttcatagtgaatggcacatagtagggcttcagcaaatgttatcacttcaatctgtttttgtgttactgtgattgaggccatatactatttaagaatttgttggatcctgcattcaatcaaatatttaccatgtgtcataggattcaaaaaagaagatgtaggcacttaggcttatagatgtaaagaaaataattgtccatcatgaatgcaggctgtggaaattgttcctcaaaaactgaggttccataaaaggagtttacattttgtcaattgctgttgagctgatttagtataataaatctgtatgctggggtaaatctgagtattgatgcctagaagctaataatccagtagcatcgttcctgaaaaaatatatagtgctatttgaagattatgtagcctgtgatatgcaaaactataagcaccgaactgctattactgtggaaatgagytgtaggtataatatagatttacttgatgaaatgatctttattttgttgttaagctgacaagtgctggagaatttgctttatgtatacattgtgggaaacctgaggaaaattgatagtgtttcactggtatttacattaacccaagcattgtatttggagtgggacagcatgctgttttgaacaatattttgacattaagaactctacaaaatagtatttaagccccctttggtgtgggcagttgataacttttcattcataattagctcatagagaaccgagagacatttcagggaaattgaactgtcagtgggtagaaacaagcatttgacctcatcacattgagtggggcccatcataatttgttcatttggtgcccatcagcccagcctcatctctcatacggcacctcgctgaccttccctctccaattccgctcagttcagctttaattatgactctgcagacctgaagaaatattgcagcttgctctcaaaaaccctgaactgccactcaccaaaagattggtttttaacaggtaataaatgcccagaggaaatggtgctatgtccacaaagagaactgtggcttcttttgagattttgctggctctcaagtgtgtccctgttgcctagtgaaatttttatttctaacacagtaagcttatgactaaattcactgctatacggaaatgtcatgagttttttaagtaaacttttatctattcacagaagaaattcttagttgcttggttacctagtgaattcacctattgaaagttgagagacaactttaggtcttttagataaagtgttagtaattttagaatacttcatttttactttttaattttaattactttttgagctactggccaccccaaagagataaaatgagaaattataagtacctcttctagcaatataattaatttggattcatcaaatcacttggcagaaggaatcctgctgagttaacaatgttgtctccactaacaaaaacaaaaacatgaagtttaaaataaacattcaggttacctaccataccacatctaactaccctgtccacaccatgacggtatttttgcagagaaagttgatagcaatcagagactgtgtaggaggaaaatacaaagcttcaaaaattataaagctaaacttttgttctcaaattatatccctaaagatttcactgcaaataaaaatattgaaaactgtagtctcatactgtgtatccttgtagtgagtgttaaactgtcagcaggattttcaggtcatttgacaaaaaggatacaggtgcagtagctagcagtgaaggtgactgctggtttcatcaatcactttgcctttctttaagttgatacataatggaccccttcaatcagcttccttgttctttgtcacttgtttggaaagaagaaaaagaagggtggaaaggctggatggactctaaaatcaaggttaggaaatgaattgtaagttatttactcagggtacagaggatgtmagtgtgaaagaggggctcttcataaaatgtcgagtttgtcaatgggtgataatatgcagttggaagcttcatgccagccttgcgcgctgacagtgctgctgaaagcagtgatcctaaatatgagtttgaaattaagaaattgtgttgtggcagagacatgttttataccagaaaatgttcacaggttcattttacttctaggcattacatcaagtgcttgatcataccagcatcatatagatggtgaaaacatgtcagccactgacaacttagtcttgtaccttctgccatacttaatgtgtgtcgtgtgtcagaattttctcaaattccttgataagaatttgaaatttttacatagctttatttactagaacctgtagacataccactcaccaagtttgaatgccttgctagttttaaatgctcagggaataggtaaaacagttgaaaggaaactatcagaaattaatgtctgtcttttttttatctggttttctcttagaaaacaataccttttcactgatttttaaaaaggatacatacctagagaaggttatcaattcatcagtcttttgatcaatgagggatgtgggaaatcataagagaagtgtttttttttttttctatgtttgaccagattatttgtattctgagacccagcggtgtgctttctggaagtatgtttatggatatgtggttcagtacttcttttttcaaaggtatcaaccaaagggtgccactatatgtcaagaggtagtgtgatgatctgagcaggtgtcagattaaacataaaaattacataacatgattgtttgaaatttctctcttcttagtcctccaagaaaaatttgggtagaatcgtggatataggttaatgccctttattttctttgcagacttttatccatggatagagcaaattctcttttgctttctagtaaaactttagggattatggtacttgtgatgaaagatttttttttttcaaaaacctgaatatttctgttaataagcatggatggaatgtctactacattctgatctttggtatgagctgtggcaaataaaaaaataagtcatgatgtcagttttgagtcctatcttatagtcttatggaaacagaaatcatgtaaacacaagagttcagtagcgtatgagtcgggctgcagtggacgtttacataaggtgtcttgggatcatgacagaaggaattactaatgctgccaaatacacagagaaaacattcttttatatttgtaatatattcttgaattataatgtgcatgccttctataatatgatttacccatatggaatatccacaaagaaacattttgtccttctacatgtgtgtttctatcagaccgatacagactgaattaaattttttctgagcagcatttgcttatatgttttgtggttccacttttctcacatagacctgattgcataagcgttcactggtgcacctgtatttattccagcggttataatgggttatagacaccttaacttgacacaaatggttgcagaatgcttaagagtcctcattcagagactcggtataacttttataaacatctgactttttgtattgtgcttattttagagagaggtaactctagacaaaaatagcacattttagagttttcaggatttccattcttttttgatacctacttactattgatatttttctaacctaggtattttattatcctgaacttgttctgccccacccagaccccctcatgtttttgttttccttccttttccccattgaaacatgtctgtttgtatttcttcaaccaagtgtctatatctatcactactacttctaataataatcccctttgcttatatgcaaaatgcttctttatgtgtattttaccagaaagattcatactaaataaagggggtaaagagggagtcttagataataagcagtgcattaaattgaagcctcaatttaatgatggcagttcatttttatttttttcatttgttgccagcacctgtctggcaactacagatagatcaaaaccaacccatggcgcttattgaaagcatagaaggagtgttaggggaggggagtttttttaaaccagctgtctaaactgattctgacaatttgagagccactcaaatttattagtgtctataatagttggagtttaagttcaatgagaaaatactgcggagttttgttgcttctcagatcacagatcagccattgaaaaagttgcatgcatacaaactatactataaactctgaagataggtttcacaacataagaattcagaacagkggttttcaactaggcaccgcagttacctttattagtttccagtcactgatgtaacacattaccacaaacttagtggcttaaaacagtgcaaatttattattatttttcaaggcgtcagcatgaccatgttccttctggagctctaggggaaaatccaatttggtttttgttttttgacttttccagtttgtaaaggcagcccacattccttggttcatggctcttttccaccttcaaagccagcaatggccaattgagttgttttcatgctgtatcactctgacactgaatctcctgcctctctcattcacttacaggatctgtgtgattacttgggccctcccagaaaatccagaatgacctccaatctcaaagtcaacttattggcaacattaattcccttttgccacataatgttacatattcattggttctgtggattaggacctagacatctttgaaggggctgtttttctgtataccacctcacttatagaacctgtgggaagaaggaggtgactcagatactcatgtctcaccccaaccctatcaaattgcagaggaacaggagggcagggtgatggcactcatagaggccatttccatgaagagcagaacccggcaccacacccaggcttgtattctctggtcatgatgttgattgtaccatggggataactcactagtcatagagttcagatgcagccctgctgtagagattatggccatctgcctaatgaagcaattcgtatttgaggcagttctgcttaactacagttaaggaaattaagagaaatttgaaattttcagatcagtcatattaaataaagtgtcatatcttcctagtactgtctctttgatgcttcaggtcaggaaatttaacacttatatttaaaaatttttacttactttactttagaatcagaattataataacatttttttttttgagatggagtctcactctgtcgtccaggctgcagtgcaatggcgcggtctcggctcactgcaacctcygcctccygggttcaagcgattctcctgcctcagcctccggagtagctggggttacaggtgcctgccaccacgcctggctaatttttgtatttttagtagagatggggtttcaccatgttggccaggctggtctcaaactgctgacctcgcgatctgcccacctcggcctcccaaagtgctgggattacaggcgtgagccactgcgtccggcctataatagcacttctcagtgaaacatttatctcaagataatggagatataaatctcaaatgaaatgaatttttatcgagatgttttaaaatattttaaaatatttatttaccatcaaatataattacaggcacagataactaaccggtgctattaaggtagtagagaactaaaaagtaatttacatttttcaaaaatcatgcaaaaacatgattcgcatactgtgattatttacctggctaattcttttttgtttggtatgaaattattatgtaataaagaaattattcttatctaggcttagcactttgttagttacatgggatacaagattacacataaagttagtgtgaaaattaaattataacatgtcaaatggaatatggttaagatcataatgggctggagtagggccaggaagagttgaatagataaattgggacttgaactgagcattgcattgtgggtagtaatatttaactaaatatgatttatgatagtagatcacaagtaaataatgatttactgtgatttaagtaaatcatagaataaacaagtgagttctgtgtgcaagattggcaaaaagtaaggggagcactaaaatttaggattaaaatacagtgtgtttagagggctgtacatttagatgttttraaggcttattttttcatcaaagtgttatggatctatgaaatcctgttcttaaaatgaagggacacttttctgaaaatacccagctcaagaagagacgggaaattgtttcatatcatatgattatctccctggctagttctttttttcaaagattactgtctatcagactttgtgtcttaaaccaaacgggcgacttcatttttcccctccctgggaactaagtrtggaaaggaaccctaagkgtccactgctgtctcctagtggaytaaactaaaatgagaggaacagtgggaagaaatagattaataaagactacagaagaggagctaaaagttagaatttgccataaattggatggagagttcactgaagcaaacctcagtygattgtggaactagattcatgccgtgggaaatctcggaatgacttagccgtgacttctttcctgttggcatggtgtctttttcagtaaactcctaaggaaaacaaacaaaaagtactacaagttgatgataaggtgggtgggcaatatcctgtataraaatgaaactatgttctagaagagttggatttatttctggacaccgacctttttaaaagcaatgcatcattctccatccaacaaatgctgccatagccaataatatgttggcttgtccattttcggcttgtagtacaaaataaatgaaagccaaggacattacaattgggagggaaagaggactattatttaaaaggcttttaaatgatgtcactatatattcttttaacaacatcctctaaaagcctttgaaaaaatagtcccttcctccctcagttgttaacaaagaccatactggggactgctctttaaaaggctgttaaatggtgatactatattttttaacatcaacatcatttagaaaccttttagagaacagttctcttcacccacaactaacagaggagggaaaaacagatgcgggggaagggattacttttgtaaaggcctttggatggtactatcaataaatacagcaatgttgttataaaagcatttttccaatggtgattcagctttttgayatgtacttttaatctcaggaccctgcgttatctgacagattggtgttttaacgtgggctgaaaactcaatttactaataatccaaataatgccttttattgaactttctgcagtttaaaaatcagtttcacatatatggtctcatttgatcctcaagacaactcagtgaaacagacaggatatgtatgattarccccattttacagaagaggaaaacagaagctctgaggttgtggtttagctaaggtctcaccatttaatatgtggctgagttcaaactataacccagatcatttgacatctggtctcataccccatgcagtttcctgagggtaccttcattgctttttttaaaaaagtggtattcatcattagtcttttcagcatgtccaaatactgagttaattccttacaattagtataaaagtgggattctgtcattttggtactgaaggtaggtatctagtagaaattttattaacaaataatcctgaggargtaaagaagtgtaaaatattgtctcaaggtgtggttgtcccctgtgatgtagcattcagacttscccttagattcctttgccttatgatrtatgcttatgaaattatcacttgaaatccactttcagacatgcagtttattaaataactgatattttaaagacaattctaatctcagtttatggatttgtttttaaaagttatttgttaaggatactgattataattaagatcacattcaaaaaagtttccatgctagttctttccacytctctccttgaaggagagaaaaaaatctccccatgagcttgcrtgactgacctttactttcctttatcataaggaccattttgtgtttattgaaaaaggaattatagcttattgcttgacagaaatgacactgaagaatattacatttcaatcttagctctgccactattttttctcttatgctaataaacattgtctttaataataattaaagaaggagactttcaccagcaacacactgtcacatgcagtgtcacactgactcctcaaaagaatcctatcaattagatacaaatacaagcacagagaagttaaatgattttcttctcatcaaatagcttgaaggtcttctaacttaaaatccagtgttttccttcgtaccactgccagctgtaattctgcctcatgagaaggaaactaaccattcttacttctgaggaaaaatgtttaatatgttaaaaatacgtatagcctgagaagacctggccagtgccacagtgcaggagtgaggctcaatcccaggacttgacccggaacagccatgcagccaggtgcctttgccatgaagaaaaccaggccttatgtagtaaatcacgttctctccatccccacctccttactgaaaattttaaaatatttacacacagatcaaggggaataatgtttatataagtaagtgtgtgtgtgtgtgtgtgtgtgtgtgtgtgtgtgtgtctgtaggtctgtctgtctgtcttatggtctcagggaacccatttccccatcctttccctgcatcaggaaattttcagcaacttgtggtacctggaactggcatctaggatgtatgaggatccttttcccttctgtcagattcaaagaaagcatctgtagtttaaaatcactatacccataataaaattccctttccaatttgtacatctcctaagacatacttctttccttatcgccaggacctcttctaggtgacatccgcatccttcatcaaggggaatccatgtccctaagtcacarttcacttaaatgcaaggcaacacagccagcttttagaggccacagtcccatctctgaaatatgtagaacagcttacggtttccctcatacamttttgtaaggttcatggcctagcttttctctgggaatctccatttggatcttgaagtcctgttgtaaatctgttcagcatggccccattcataatggctgataattctgtcttgacgaaatcatygttactaccaagattgtttgtgtgaagctcacctgttccttttaggccattctgttttcatcctcattttccttcctcttatggggcccattccatcttcctattccttcttcccctccttgtcattcttatctttggatctcttaatcacttatccatattcagtgaagatcttagtatttcatacataatctctctggcccaccatcatcttggggaactgcagtgttcatattcataacctgtgcaacatgtaacctcacagtctcttgatctgttcaattctaataacttcacctccactgaacttcagtttttcgtcctttcaattctgaaatcttaactcactcccttacttgtgcctatcmtgctcctcaggcccttcatgcctccagctgtttatgtttagcctagattaaaacaaccctgaaagataggtgctagtgtccccatttcacagacttgaaaattgagatcccttcagcttcagtaacttttctggtgttacaaggctagtaaracatgtgctatgtataaaaccaatttcagctcaaatctgtatagtttcaaagccctgtgtttcccacsacacctcactgctgagtgtakgaaggagttacaactccaagagaattattttgtgtagcagcttgtggtacagctcagagtaaaacgaacctaatgacgggggcaaattagagagacctcgtatagtataagcaagagaagtcataagggagcaaaagatcggaagggacaccaaattgttatggttacctgagggggacttttcttttctttctttttttttttttttttttgagayggagtcttgctctatcaccaggctggagtacaatggtgcaatctcggctcactgtaacctccgcctcccaggttcaagtgattctcctgtctcagcctcctgagtagctgggattacaggcatgcgccaccatgcccagctaatttttgtatttttagtagagatggggtttcaccatattggtcaggctggtctcgaactcctgacctcgtgatccaccggcctcggtctcccaaagtgctgagattacaggcgtgagccgctgcacccgactgggacttgacttttcttatattttcatactatttaaattattttcaataaatatataatgctgttgtaatttgaaaaaaaagatttaaaagtattttcagtgttaatgaagacttgaattaagctggtggtagagggacagaaaagaggaaatgaatgcaggagacagtgaatttgtttctaattaatgtgagggtgtcaaagataatgccaaggttctgagcttggttataatgggagaagacactagcattttcttttttatattatgtttttaatcttgtgaatgaaaaagcagtagaactgctaagatcacgtaattatcacatctttcaaatcacagcttaacaatgcataattgttttgggcttctgtaaaatgctctgggttctaaagaaatttgttataaccagttactgagaacttcatgctgaacactttacaagtcaaattcagtctgtttttattagtactcttaagccaaaagtcagaaaagaaatataaaaagaataggagaacatatgtatgaatagtataacatatcagtattcatggttctggtgctatttaccacgtacgtgatatataaaacaatatagacattattctggctttcagatatatagaaaagcagtaagtgtattgatagtgaagtttattgatctgtctttggggaggagaaagaatgggatattaatttccttatatcaaaaccattgtaaattgaatatatcctataccagggatcggcaaacattttttgtaaagggccaggtagtaaagatgttcagctttgcaggccacaaccactcaaccctgccattttaatgcaacagcagccacagataatacataaataaatgagtgcatctgtgttccagtaaagctgtatttatagacactaaaatgaatttcatatcattttaatgttacaatcatattacttttgatttttcaaccatttagaaatgtgaaagtcattattagtgaacaggcattgcaaaaayagacagtggaccagatttggcctctaagcatggtttgctgktgcctgcttaataccgagcatgaaataagatgctcattaaatatttgttcattatgtgttcamgtatttccacaaatatatttttaatatatattattaccaaaataagaggtgagaaagtcttgtgtgctttataatgtatagtgattactaaaataaaatatgagaaattatcataaatttgtatatcaaaatttatatacataaggaagaagttatctttagtattaaaaaccatttatttgaagtaatatttsctggaagattcaaatatatttcttcgagtctgtkcttatatgtaagagttaaccaaatttgccstttacttttttaaatcytattctaggtcaatactaggttaatgctagcctcaatgaaatggattgaaggtaaaatcaagacccactttctacagtttataggataaatgagacaatactgtgactttctgcattacaaatcttatcaattgagacatacattggttttaaaagtactaattttaaagatgaagctgtgcctctgtttatagctattttcttacctcgtcatttttataaattatatatcaaaatagatactgatgtaaagtaagccaaacaaaactagatacaaagagcattttatatactgcagattttcatatctttgaaattcaaaaacagaatggattgataatacttaatgactgggtaactaaatgtggattaaagcataaaaggctgggaaacattgttttcataaagctttacgtggaaatgtcatctttgaatagtaatgtggatgctgaacaaggcttattccaaggcacttacttgctattccatgttttatttttcgaatctcattttaaattttataattcaatcattttgaacagctatgttcaaaagaagttttacaactttaatcttaataatctcaaaaaaaagcagacatgctatgtcataaaataactattagtgactagtttgtatcctataaatctaacttgagttgataatatggtccattaccagctaactgcacagagtatttttcattttacactcttcagttactttttagtgaagtgttaaaaaatatgaagcttttctcctctctaaaattgcacgctgtctgtctgttattagggagataacagctcttataaatgtttcagtaagcgctaagtagacagttatgtgcactctcattccacgcttatttgcttactgtaataaactgataaaatatrtgtggtttgtctctgtgtatctacaggcatcatgagtcacatagatttcctttagaaataatgttgtgtctgcagaattgattgcttattttcataaaccatctaaaggtacacaaacgacttttattatttaaacatatgctgtgtaaagatttgtagaggattatctcattgttactggatgctttttgttctgttaactcttgggggaggcttgttattttacagttactgcagttactgaactaattacttcctcacgagccatagtraagatgacctatatcatttgcttataatgcatctaagtttttaattctttgaatgttagtcgttaaacaattaaatcaaaactaatgttttcaaactttgtctttcatactcttgtttatataagttttaataaaataatacacttataagtagacatttcaagaattagtgtttgaattatagaagtccctcaataagctgttctttgtgcatttaagaaatgtacttctttatttgttcacaattttatgtaatagaaaattcaagttatatcataaaaccaacaaatattaatatagaagatctccacatatcaccacagtgtgttcctataaggctgtagtatttttaaggacactgttataattgagcactcagcattaaataatgtatagttatgaccaacactagaggtatattatttgcaaatttccataatcatttaaaatagtaaaattatgctttgagttctgagaaagggtaaaattaagtttaatacattgagcataaaagtgggaagtagatgggaagacaggtaataaacataacaaaaaagtaaattatatattgtgttagagaaggtattaagtgtctataaaaaaggaaaaaggaaatcagaagggagggatgccaatgggttaagccttactaagatrgtaatatttgagcagacatactagagctgagccatgtgggtctctggagaaagtgccttccaggtagagggtcccagggaataacctatagtgggactgttactaatatgcaaaaggaatagcaaggaagtcatggcgatgagtagaataaacaacgagttcaagagtaataggaaacaagatcaaggaaatggaacaaggatcctggccattggcgggttttgagcagaggggtaacatgatacaacttttctttttcttttaacttttattttaggttcaggggtacatgtgcaggtttgttatacaggtaaactcatatcacggagtttggtgtacaaattatttcatcaccccagtgcatgatgtaactttaactgatacattctagctgctgtgttcaggatagactaacatagcaattcagtctatgttcaataagatgcaggggtaggaacaaggaaaccaattaggaggctgttggaataatccagatgataggtggtggtggctcagaccgggctggccacagtggcagtagtgagaaatagccagattatttcattaaaataactgggttttcatccatgatgactccctcaggtgtcagctatgacttttgtgttcttctagcctactgagcctgcttctgtcatgacatttatcacactagttgatttactctgttttcccaggctaaacaataaacttcttgaggactaggatactttggctttgtctctgtatcatactccttagcacagggctggtacaactcattgaataaatgttatttacatgaaagaatgaattaataaattaatggtgagtaatgattaatgatttgtagttactttgtgtttgaaataacggtgttcttattggacagagagctgtgaaatacctaattcttgcacgttaccacctttctccccaagatgcccaagggagacatagggtcagaggacaaagaaaggcaaagccgtactttgttgttattgtgggccttgctctctaaccgcaatacagaactccagtgagttaggttggcccacatcaaggactcaaagttcttttctattaaaggtagaattaagtagccttgatgcaaaacaaattattagttgagtcacatgaaattgatagtttgactgtttttgacctacagatatggcagatacatatggttcagtctaatcaaaagccttacctgagtctgtgatctcctggctccatatctaccaggactttagagaaagtgggggaasggggcattctcccattacaagcttatttccccttctaattagtgtcctgaaatctgactaatcccaaccagtagtagagtgggggagatagatgatagaatcccaatttgaactaggttaagtagtaaataaataaataggaaattacagctacagttcagagaaaacaacttcagcaaggacagtaatgtgtctgggcatcaagaaccatccagctcaaagttaccagctagtttctctgtctctcatctatgcttttctttgaaatttgctttattatttttttttctcactgaacaatgtggcaggaaatgtggccacagacaaaattagagttttaaatctcagaattttagctgcttgagagagtctggctcaaattactaggtaccaaatccaaaaatcctaggaaaggaactcattgggccaaatgtccatccctgaaccagttaactgcagccagtcatggggaggcataagaacttgccagctccatcatgggctgaatgtgtttctagaaaatagtagggcatgttgggctgacagtctcatacataaccactatagggtaaagaagcattgggggcaaagcttcctcaaaaggccagcacttagtcttgaaccaaataaaagcaattctgaaacaatgaattcttattctgcattgtcattggacttactcaacactttgttgtcggctatcagaacatttctgatacttcagaaacccacaggaataattaaagtcataacatggattttcataaaggaaatccaaaagaaaaaagtaacctctactttgtraagttgtattctgattagtaaagccactagcctgtatggcaccattgcgcagattccaaaaagtttcccttgaatgtaagctggattttagctcctattcaccctttcagtcagttgccactgcacagatgtatatggtggtctaagtgttagctgtttgaaataagcggctctgggaattgttaaattattttttttaaatcaagcatcaagaactgtgaagagtctgagatgttaccctacttacaagctaactagttaatttgcaacaatttcatgaatgctggtagaagacacaagactcctggtcagagacaaaggacagtttgttaaagcaatagaagtagccagagtagcatcatttgcatcacttctctgagccccacatgctgaaggctaggtgaagcctgcacatgcattgtgttgctttacaggagaggaacctgatcagagtaaacagacaacctacagaatgggagaaaaattttgcaatcaatccatctgacaaaggtctaatacccagaatctacaaggaacttaagcaaatttgcaagaaaaaaaatcaaacaaccccatcaaaaagtgggcaaaggatatgaacagatacttctcaaaagaagacatttatgtggccaataaacatgaaaaaaagctcatcatcactggtcattagagaaatgcaaatcaaaaccacaatgagataccatctcacaccagttagaatggggatcattaaaaagtcaggaaacaacagatgctggagaggatgtggagaaataggaacacttttacactgttggtgggagtgtaaattagttcaaccattgtggaagacagtgcggcaattcctcaaggatccagaaccagaaataccatttgacccagcaatcccattactgggtatatacccaaaggattataaatcattctrctataaagacatatgtgcacgtatgtttattgcagcactatttacaataacaaagacttggaagtaacccaaatgtccatcaatgatagactggataaagaaaatgtggcacacatacaccatggaatactatgcagccataaaaaaggatgagttcatgtactttgcatggacatggataaagctggaaaccatcattctcagtaaactaacaggaatagaaaaccaaacaccgcatgttctcactcataaatgggagctgaagaatgagaacacatggacacagggaggggaacatcacacaccagggcctgttgggggttgggggagtaggggagggctagcattaggagaaatacctaatatagatgacagggtgatkggtgtagcaaaaccaccttggcacgtgtatacctatgtaacaaacctgcacattctgcacatgtatcccagaacttaaagtattttaaaaaaaaaaagattctaggcttttataaggggactgttagcaaatctattcagcctttgccccagagggagattttgtctttctaatcctggacaatgaacaaacaaatctatcacctgccccagagggaggcattacctctgtcttccaaaggctgtttgctgtggaaacatctttgaaaagagcttcagaagcaaagttgctaatgtttctgctcagaagacgtgagacctgtagagccctttttggcaccagggacccgttttgtggaagacagtttttccatggaccgttgggaatagggggatggttctgggatgaaactgttccacctcagattatcaggcaggcgttagatgctcataaggggcgtgctgcctagatccctcgcatgcgcagttcacaatagggtttgcactcctatgaggatctaatgccactgctgatctgacgggaggcagagctcaggcggtaatgcttgctctcatcagccactcacctcctgctgtgcggccggattcctgacaacccatggcctggtacaggtccatagcccagggactggggaccctctgctgtagagaattgtttccaacaacaagggaagggaagtggaatggcaaggatctaacatttgtgcccttagatcgggggtcagcaaactttttttgtaaaggtaccagatagtaaatgttttaggtattacaactactcacctctgccattgtagagtaaaaaagcagtcaaggacagtatgtaaatgaaagaatatggttgtgttccagtgatactttttaaaaataggcagcaggccatatttggcttgtgggttatagtttgcaacctctgccctacatgtattgtgtttagacttattaaatcttccctttttcttaaaccctcattttcacagcccaaatctagatcactttataattatgttttatctttttttgcatctaataaaatcattgttgtctataaaatatgaagtcaagaacgccatttgcaatgttgagcatcttagaatataagcagccacagatctcatatgtatttctggaatataggtatctggtctgatgtacaaaatattgaactaaagtctaaatatatgttaatattaatataacactggattaaatgtattatatgtggaagtagtcgaagtatttatggaacccactcggtttattgaacaaaatatcacctatgtattttatctagatgctggagaagtttggcgtaatatgacttgtataaacttaggaaacaaggttaaaaaagtaatcaaacattttctttttctttgtgktttttttttttttttttttgagacagagccttgcttcatcacccagacttgaggacagtggcactatctcaggtcactgcaacctccacttcctgggttcaagtagtcctcccacctcagcctcccaagtatctggaattacaggtgcatgccaccacgcccagctaatttttccatttttagtagagatggggtttcaccatgttggccaggctggcctcagactcctgacctcaagtgatccacccatcttggcctcccaaagtgctgggattacaggcatgagccaccacacctggctatgttttcatttactacctttctgtagttaaacaagtatatattattaccacgaagtgtcatttatgatcctgtttattgtgaaagagtgcatagacctctgggaattatcacagataacctttggaggttgtaagggagggcctttttagacggtgaattcattagagaatgctttttaccttgaacttggttgaatgtggaaagaatgagtggagagaattatactgtttttctttctttattcatcccttaacatattttttgataattataataaagctgtagaattttgagacaaagttgaaaacacaaaataaatgtttggaccatgcatcctaggattagactgagagaaggaatcagtgagtctgccaaggcttgatggctcttaaatgactaaaggcatacttctaaccaccttgtatgatatctacagtactgattcctggccgctgtgaaccagacctttgttctgttctgctctagtcccactcctctacccttgcctttctccaactttcaaatagtcttcccttttacattacagtttcagctttctttccccgatattatatgtaggccaactttttatgaatttccacagagataaagctggctacatcaacatttatttaatgatttgataacaaatatgtttgtggaacaatgtagaataaaagtaagacctgtcactgtctctaatatgcttatcattaaggaaataaacatgtaacactgaaaaatataattagccagataagagcttatatttaaggttgattatcatagccttagtagcatgggaatttatggcaaaaaagaaaacttttgctgagtataaatctataaatataaaatatatagctctggagtcatcccagtacagccttggtgccatgtgcatgtcggagagtcccagcccaccttgctctctagtacttgtagcctttttctttcgagatgcctgagaaagtgcacgtggagcggaggagctggaaacttgcctttcaggcagatattgcccaactcatgtctctcgtcatcaataccttctattctaacaaggagattttccttcaggggttgatctaatgtttctgatgcattggacaagatttcctgtaagagcctgacaaacccttccaagttggacaatggtaaagagctggaagttaacatcatccccaacccatggtaatggttcccaaattaggagatcagccttggtcatgtcaatgcctgtgtctaccaaagtcagggtgtattccctggtactaaaggatttatggaggctcttcaggctagtgtagatatctccatgattgggcagtttggtgctgcctttttttctgcctaccttgtggcagagaaagtagttgtgatcacaaagcacaacaatgatgaagagtatgcctgggagtctctgctgggggttccttcactgtatgtgctgaccatggagagcccattggcaggggtaccaaagtgaccctccaccttaaagaagaccagacagagtacttagaagagaggaaggtcaaagaagtagtgaagagcacttacagttcatagcctatcccattaccctttctttggagaaggaaagagaggagaaaatcagtgatgataggcagaggaagagaaaggtgagaaagaagaggaagataggccaggcacaatggctcatgcctgtaatcccaggactttgggaggctgaggtggcagatcgattgaactcaggagtttgagaccagcctagccaacatggtgaaaccccaactctttaaaagatacaaaaaattaggcggtcatggtggtgygcaccttaggtcccagctacttgtggggctgaagtgggaggatccaccaggaggtggaggttgcagtgagctcatatcacaccaccgcactccagcctggacgacagagtgttacaccatctcaaaacaaacaaaaaaaggcagatagagatgatgagaaaaagtccaagattgaagaagatgtgggtgggttcagatgaagaggaggacaatggtaaggataagaaaaagaaaaccaacaagatcaaggagaaatcattgattgggaagaactaaacaagatcaagaacatttggatcagaaactctgatgacattcacccaggaggagtatagagaattctacaagagcttcaccagtgactaggaagaccatttggcagtcaagcacttctctgtagaaggttggttggaattcagagcattgctgttcatcccttgtttggctccctttgacttctttgagaatgagaagaaaaaaagaacaacaaactctgtgtccatcatgtgttcatcatggacagccatgatgatataagagtatctcaactttaatccttggtgtggttgacttgggatctgcccctgaacatctctcgagaaatgctccaacagagcagaatcttaacagtcattcacagaaacattgttaagaagtgccttgagctgttctctgaggtggcagaagacaaggagaattgcaagaaattcaatgaggccttatctaaaaatctaaagcttgggccagttgtggtatctcacctctgtaatctcagcactttgggaggccaaggcaggaggattgctggaagccaggagtttgataccagcctgggctgcaaagcaagacaccatcacaacaaaaaataaaaaaaattaacccagcatggtggtacacacctgtagtccaagctacctgaggcaagaggatcacttgagcccacgagttccaggctgcagtgagctatgattgcaccactgcactccagcctggatgacagagtgaaacccctatctataaaaaaaaaataaataaaattttagaatttcaaaaattaaaatctaaagcttggaatccacaaagactccactagccagtgacgcatgtcctagctgctgcagtatcacacttcccagtctggagatgagatgacatctgtgtcaaaatatgtctcctgcatgaaagaggcacagaaatccatctatagcatcactggtgagagcaaagagcaggtggccagctctgtgtttgtggagcaagtgcagaagtggggctttgaattagtatatacagccaagcccactgatgagtactgcgtgcagcagctcaaggagtttgatgggaaaagcctggtctcagttaccaaggagagtctgcagctgcctgagtgagctgagatcgcaccactgcactccagcctggcgacagagcgagactctgtctcaaaaaaaaagaaaagaaagaaaggaaacagaagagttttgaaaatagtttttattcaaggaaaagaacctaaccttagaagtgaaagtgctttgaaaacttaaaatactagattgttatcatcatcagaaggcttaaatagaatgaataggccagtagccctattattttatataaccaaaattttaaatttagctaattgtttattatattttacaaataaactatcccataaatttttatgattattattttattattattattttttttttgagacagggtcttgctctgtcacccaggcgggagtgcagtgacctaatcatggctcactgcagcctcaacttcctgagctcaggcaatcctcccacctcagcctcctgagtagctgggactacaggcgcaatgcaccacacccagctaattttttacattttctctagagacaggatctcaccatgttgcccaggctggttctcaaactcctgggctcaagtgatcctcctacctcggcctctcgaagtgctgagattagaggtgatgatttttttttttttttgagacggagttttgctcttgttgcccaggctggagtgcaatggcgcgatctcagcccacagcaacctccgcctcccaggttcaagccattctcctgcctcagcctccagagtagctggaattacaggcatgcgccaccatacccggttaattttgtatttttagtagagacagggtttctccatgttgatcaggctggtctcagactccggacctcaggtgatccacccacctcggcctcccaaagtgttggaattacaggcgtgagccaccgcgcctggccagaggtgatgattattttaaattgcccacattttttgttgcacttttagagaaagaatactatgttttgatgatgcttagaaggcatgatgtagcattttgtatatatgatatttaactcttggatttttgtggaactttaaatcattactataattgctacgtttgtaatgtcatcaggtgtacacggcatagtgaaaatgtttaataggttgatatatactctcagaactataatagakaatctagttgggagacaacacttgtcaggaaaaaatcttaatcaagcctgtttaattacaaattgattttttttttaatgcttgcccatgtcaggtcaagcctagtatgcaatactgatattttgaatggaaagaaagctatcacatggttttagaatggacagtgtttcattatttaatatgctgcctatgatttcaatgaaaatgagattgagggaagaatttaattaagagtctaatgttcaatagaagggtaaaaggtgatttaccaagaaaatattcggagggggaaataaggaaatatttgttttaccaaataattgaattatattgtaggtctacaaaaaataaaacaatatgggactggtttaacaggacaatcaaggcccagaaatatctcctagtacataaataattagaatttttgcatttaaaatcattgagaaaagactattcattagctcatgtagggacaattagttcagtatctggagaaaattaaatatggagtcaatatatcaaaatcaattccatatgaattaaaatttgaaaccatcaaaggtctggaagaaaatataagtgaatagttaacttgatctcaaagtagagatcattaaggcaaaggaagaagccaccttatcctgggggccatggtcttcagtttacagtaaaagaaaataaaaacaaaaaaacagttcaaagagtcaggattggaaatgaaggtccagacgttcattttggtagttggctaaaacacccaagaaaatcaattgacaaactgttaaaaccaataagaaagttagcaagatggccaaatatagaggatctagggaaaaaaactaacaaaaaagtttataaatccctgccccccagcaaaaaaaaaaaaaatgagtatgtttgtaatattaatatatgcttggaggttacagaaaaatttcttttttttttcttttcttttytttttttttttttttgagacggagtctcgctctgtcgcccaggctggagtgcagtggcgcgatctcggctcactgcaagctccgcctcctgggttcacgccattctcctgcctcagcctcccaagtagctgggactacaggcgcccgccaccatgcctggctaattttttctattttgtttagtagagacggagtttcaccgtgttagcgaggatggtctggatctcctgacctcgtgatctccccgtctcggcctcccaaagtgctgggattacaggcgtgagccaccgcgcccagccgcttacagaaaaattttcatacagttttgagggcatttacttctttgtatcatttctgactaatatctatgtgtgtgatatcctactaatgtttgttattgtagttcatataatactgtaggggaaccaagaattaaatgtcataaatgtttgcatattttctaaaagaataattatattcactaactcatctttttttctttttgccgtgtgtaataggtcagtactcctgcatttgtaccaacgaaaactcacgtgctgcttcatcgaatgagtggaaaaggactagctgcccattatttctttccaagacagccttgcatttttggtgataagatggtctctatacaaataacactgaataacactactgatcgaaagatagaaaatatccacataggggaaaaaaaacttcctataggcatgaaaatgcatgtttttaatccaataggtaaatattaattctcatttaaaaccttaactatatttgatcactaaatatgttcatttwaaaagtaaagtagaatactttttagtaaaatagtaaagtagaatatgattgtattgacarttagcatattcagtttatatttgctttttcttgttaaactgaatttatcatataagataaatacatttctttgctcttagtgaatcaggtcccagtaatagtaataccagtagtgatggaaggctaggtctgcagagtcaagattgccatcatgttttacttacctgtgtcacctttccccatctctcctcctggtcagcttcattccctgcataattttaagtggtttattgtgtattaaaagcaagaaaatcgctctgcatttctgaatacaatacttctcgtatctcgagatcctttcctgtttcccttcacttttcaatttatgggaaagtgaagggagtgaagactgagaggatatagaccaagcttgaccaacctggctcaggccagctttgaatgcagcctaacacaaattcataaagtttcttaaaacattatgagatttttttgcgattattttttctttagctcatcagctatcattagggttagtgtattttatgtgtggcccaagacaattcttcttccaatgtggcccagggaagccaaaagattgcacacccccgatgtagactagtctgcttatcttcctctccatgtatagaatatacagtagcctagaggatatcactggtatttatccacatccaatttttacatgttttcaatctgttgccaccatttaaaaatgaagatgcttttacattttaaaaaatgagaaatctcacttttcttggagcagagcgtaaaatatggcagtactggccctttatccccacatgcagcaaccaatgagtgggttgctgagcagcggctgcccccagctttggctcgcactttccaggttgcttctgtgcccaccgcatcctgttgtctctccaacaaagtgtcagtggccatttttcatcccctttgcattttttaagtattttgctaaaaatataccctttaaacattaaatgtaacaattgtgtgtcttactttgaaatttgaaatagtgtaatatttagaatgtctatctctttctttttggtttttgtaagtggagataaccctaaggtttagttgagagaagcttcaggcaaaacctcaattaaaagtaataaaaggtttatgtcattgtatcttccaaatgttataaccagaatgctccagagagctcctttttataatacttaagataaacaatgccttttgaccaggatcaagtaaaattaggtaattgtaccttctttactcattgtttcacataactcttccatttttctttatctgagctctttggcattgctgaattttctcctctggttttcatgaatctttcggtaaagaaagtcattttgtgtgtgtgttatatttttacacaaaggaataaaataatttttgataaagcctggtaaagttttataagcaactagagcaaagaaagtggagttaaagtaagctgatttcaaaatccacttaatttttaaaaatattttgataattaagacactatttaaagaacacaaagtatcctaatttttattatataatgtgtgacattaatatattgccaaggaattattgtgttatttttgttgcttgtaattcaaccttttttacctagttaaaaaaaattagtttaggaagtgtcaagcagctgatacatgaattgtctgaaggttgagaatgttatccaaaggttaaagcagtagaacagtattaatttttctttgagctggcataatgagttgatgagttgacctttagttggcctatgtagaatagaagaaataaatataataaatttcatagtatgactttaacagagaaataaaatatgaatgtttaccattgcctcagtattggttgtaggcttttctttgtcattcttagacaaatttttgtgactgtatgtttcattcatttggttggcatttattgaatgccttcaagatacagagttcttttgtctgcagtatgtacttgtatgtaacaccacctggatgacactattatcaatagattgtagggttaaggaatataatatgtctaaattagtcctccaaaaacattttaagaatgcaacagaaaacaaatactgtattttagtgttttagtaaaataagggaggtaagctatttgttttatttatttttaagaacgtatacacattaaggagtccgcagttttcttatttgccaccaatctggttttgtctgtaatgtgcaatgacttttttttctggatttcactctgtgtttggcatgaaactgtattccttacaagaatattaggaataatattccattttccccaaagagacccagtatataagagggttttttttaagacacaaagaataggttaagctctctttactatattcagtggctttatgttagtggttgacaaatttgagttcagctaagattttaccagttactgtacaactgttacatcaaagtaaatggcatcctatatgatttcaygtgttgatattaatgttgtggcgtaacagagccagtgtttttcagccacttctacatagccatctcaaatatataggagcaaatctagaaatggtgtccaaacagagacacctaattgggtaagctttcccagtttagtcggctccaagtattataaaaatccattatttgaatgagtttatgctgatcattttgctcctgaagcatccatataataaaacatgccattgatcatggactgtcccccagaattagtatggcactaagctcacagttaattatcttaagactgaagacagtatcaaacagtgtcaaagagtgctatcaacaaggcatcttgagagctgtcactttgtcaaatgacatgcaaagatacatgatgaagggagatctaaatcatgaaagccatcaagttttggagatgacggaatttgctactaatgtgtcagataaaaacaagaccaaaccccaaaatagttatggcacagaaggcattaagaattcactcaagaatagcctggagcagcgtgtgactgacaaagctctaaactgttgacagcacatagctttatgagaaatgaaaaaaacatatgtatcattatagttatttaccctacagtaaagcctgtttgctagagatttagggagcaagtcttctagtatttgartggcatcctggaaaatgttaggtttgtaaacaaatgaaattcaaactagaatcagcaaactaacatacataccactgagcaaatagcattttaattattactttttttatttttaacatacttcctttgcctaacaaatagcattttaaaatcagcattgaacaaatactctcttgtaatgcttactcctcattgagcctatgagatataaacataatacttaataaatgaagcttattgaattattattttatcccgactgtaccatcatctctgtcgtggttagcattcaatggcaaatcatacttaccaagaagccctagaatagtcacagtctattgaattagaagtgtgcttgctaaaatataactacgtgtgataggatgtatagagaatagataaagctaaatataaagtgattgtatggtatagctgcaattatacagaatactttgagcaaagtagaaatcaaaaatggacagtttctatatataaacaaatatatacatatttatttaagatcccctcaattattctaagatatagctaaactttcaaatcataagcagaataaaattttgttcttgtttgccttaagttttgtcattgttaactgaaaaaaaatactgtattgtatattggtatagttatttcctatacttggttagttgatagatgaagcttctgaaattccaaatctatcaaatgtcattttattttttgttttataaagataatctaatctgccacaaatttttttgagtatttaatgcaattagacttaacattttggtttcaatgtgagatctcttaattaatttctgagtgcatcttaatttcttcttccaacttgatttacattttttaatttaggatttttttcattgaaaattttggacattgtttaaaatttactttttatatctagaataaacatgccatagttttaagtacataacctcttatgaactcccaaagtccattacaggtatgcgaaacaagaacacatttatttccttctcattttcagtacctatagagataatattagaaaacatgacatttctcaggaagatatgtatttctgaaacaaatgggtataatgygttcattggtgtatgcgcagaattaatttgtgaaaaagaaaaccttgaaacagaatagttaggttactttgtaatttgctttaatattcttagtttgaaatttttaagccatcattacatttcacagtttcaaccaagctacaaacattacctaaattttcagtgtttagtttrcctctttttcacatcctctgtgttttcatgtctaaattatcttatttcytagactctcttgagcctgagggatccattacagtttcaatgggtattgacttttgtgattctactcagactgcyagtttccagttgtggtaagttcaattgttcttctattttttatataacctgtaaaggatagcagatcaaaaactaagctttcaacagcttttgtgtgtgtgtgaaagacaaaacatttaaacaaatatgttttgctttgataatgtttagactgccttggaatagttgtacaaattgtgtgtagtatatgtatttttagcattcgttacacacctagccattacaacctgccatatgtgattgaaatccatggtttgttggttaaagaaagaagctactactaagtaatttttaacttatcactccagttttagaaaatttatgagaaaattcatgaggaaaatccaggagaaattaaaagcattaataatattattaaatagctcagagaagatatcttttgagatatacatacatgttatcttgagattcttaagtggaatattattgatgccatcagtacctaaaactcacacattttttttttcctttttacatccatttacaaactgctttgataaaagtcaaaagagaacatttatgcagttggcaaaggtttcatagctgaatgctgttcagaagagcttttttaggattggattttgttgttaatgtttttctataatgctttatacatttcttgtgaaattcagaggctattagcaaattagaacaaagccgtattcatgcatcattgagaattatctttgaactcttttctttttctgatataaggcccaattggctattttgagttgaagtttctttgtttttattctaaaaagaattgagacattttacctacattttagctagcttagaacagaatttgttatgatttaaaagtcttgaagttttagaaatagacattttaaaataaatgtatagattaaacatagtgaacttttcattttcatataccttttcagtttaccagtaattctggcctaatgttataccttttattgccgagaacctgcaatgataaatataagcaatgtagcataacacattgattttatgcagatcatcacctttatgttttgggaggtctgctgtattagtgatatataaaaactgattacttttcccaacattgcctagtaattgtttattatttttctattagacaaacaacacagatcaatattactgaacaacaggctatgagtaacatcactctaaatagatttgcctctgacaccagaggtatattcattttaatgatttggacaatgtgaacccaatgacaaagctcacgtaccaagttagaccaaaattaagaactaaaaaagattcctttttcttatcaatttgtataaagaaccttttgattcctatgtaattggatttttttccccaattttatttacaaagacttcctttatagtctcttgaacaggatttgcattttgtctttcataattaactaagtctctttaaggatggatatatatgcaggtagtatttgatttttatcttatgccaaggagtgtatgtgaataatattttttctaaatttctttcaaactaacattaggaaaataattcatgtatttcacatagaaaatgttcttgactattaaaagcatttacattagtatgttttgttattataaagatacaaattatttattttagattttgttaagcacaacagcatgctagatcaaaaattttgtgtgtgtgttccaaaaagagcactttgtcttgcatcaaatgtaattgatcctgaagcagtgtaatcacaattactcactttcttgattggcctgcccaaaatcagaaaatggaaaccgatcgacagtgtttaaatcaatagcttcatagtaatgcttgtgggggtagggagatagtggtaatgggtagatcaattggtcttagatgccaatcactgactgtgccttttgcatagtaaatagcactttttgcttagtgatgtgctgtattagtcttggtagttcaataaaaagaaaaaaagaaacaagaatggctgatattgaattttttccttgaaatacattatacaaatcgatacataaaattatgggtaataacagcayatttgataagaagccttcagaaatgctgggaacatggaccaaaagcctgtcagatactcttttattagttagaataaaaagaatagagtaaaatgatcctactttagcttctggattaattctatatcattataattgtatctatggataaatagatatagacagaactgttaaattaagccatgtagttatatgtatatctgataagcatttttgcctcttttttgcttggattttaaatggtcatcaaattaagttcttgattaaatttattgagatcaaatatgtgcgcaatatacataaatatatctgtctaaaagttagtgcagtacataaacagatcctcatcccccacaggcatgcatgcattaaccagtgtgggaagtcacacagcttagtgctagttagagaactgagcacatgtttttgtccaaagatccattaaaaagaaaatacattctttaatagtgaatgaacactgaaaatataagaacagatgccattagctgaccagaaattatgaggcattattgacagaaaacaaataggagcagataaacaataacagagaaaataaaaatcacagggtaaaacactcgtgggggaaaactaccataatggtaagaaccaatctggcagaacatcaagcacagcatgagtaggggtcttaagacagtcatcagggaattaactgcttccagccccttagttccccaatcttacccctgacagcaggcaacatacacatttaatttgagacttaagaataaaactgtaaagagaatgagccacttgcctgggaaagacgttttggtgtggatgtggggacctacaagaacagagcagggtttgagtttgtgtgaaggaagcaaggatggtcagagatgagatgaaatatagttttatccaagagagtatccaaaatattctcagatcctcaccaccagggtaaagccagtgtcacgtttgctggtggggaggaaaggccatttcctacctgcctgcctccaacttcatgtccacataaccagttagtatctcgtccacttataaaaaataaaactttagtcagcccacccaggggagaggagacccatagtaatgatagttgctaactcagtaggtgaataatggaatggacacagctgaatactgatcgagtgttctggaagaaagggtcaaggaaatcaactagaatacaaagcaaaaaggcagagacagaaaataaggaaagttagaaggatcagttcatctcataggagctctggcaggaaagaaaagacaatgaagggaagaaataatttagaaaataaattatagaggaacattttctgctggatgtggtggcttacatccataaccctagcacgttgggaggccaaagcgggagaattgtttgagcccaggagtttcaagaccagcctgggtaacatagcaagaccttgtctctaccaaaaatcaaaaagggttagccaggtatggtggcacacacttgtcatcctagccacttgggagactgaagtgggaggatcactggaacccaggagttcaaggctccagtgagctatgattgcaccactacactccagcctaggcgacagagtgtatccctgcccgtaatgagtgaatgaatgaacatgtgccccaacaaaagaaacacgcaagccttcagattaagagggccaaacagggtgaatatgaaaaactatgaaaaagatcacgtcctggtgaatttttgataaggagaagaatatcctattatcttccaaagcagagaaaaaagcagtttacctaaaaatggacaagaatgagaatggaatcaaatttcacatcagtactcttatcagttctggaagccagaaggtaaaggaaatgacctttaaaattttgaagataccaaatagtcatttttcagcgaaggattcaatcagtttaccacctgcacatcttttctgaaaggattactcaaagatatgctgtaatagaatattttcttaaatctgagacagaaccaggcatggtgatgcatgcctgtagtcccagctactcaggaggctgaggcgggaggatagcttgagcccaggaattagaggctgcagtgcgcgatgattgcacctgtgaatagccgctgctttccagcctgggtaacatagtgagaccttacctcaaaaaaaaatcagagacagagaaaaacatagaattaataaaacagtagtgagcaaagcattctacgaaatttatcaacgtataaaaataattgttgayataatgtgaaaaataaatattaacaataaattggaaccaaaatccccacagagacaagtgcaaggaggagtgatggtatactagggttcttgttatgtctgagaagagaattgatcgatggcaaaaattagtttaaatattgtttaaattattaaagataaccactaaaataatagaaatgtgatgtattataacttctaaacagctaaaggtaggaagaaagggagtaattaaaacctgatcagagctgcgtgtggtggcttatacctgttatcccagctctttggaaggccaaggtgggaggatccctcgaggccaggagttcaagaccagcctggccagcatagcgagaacttgtctctattcaaaaaaataataataatttaaaataaatgtttaaaacttggtcagtttaaccaagaggaagaggaaaaagcatggcaaatataaaacaaaaaaaggtggctggagaggccatgcacaccacacatactagttttcacaattcacgtcagagattaaatcctrcttttactaaacaggtaaaaaacaaaatttaacatatgctatttatgagaaacctccctaagagagaatggcacagaaaagttgagattagatagatgaagtgtgtgtgtgtgagcgtgtgtgtgtgtgtgtatgcatttatcagatagatgtgctaaaactagaaaaattaagaagtattttaggtaaaaagtaataataaaatattttgtgttcattgtaatcctccaagaaaatacaattgttacaaaccattaaaccatgcacttttgtaatttataaagcagaaaacaatacaaatactaggagaaattgtcaaagccataatcatagtatattttaacatgcacatcagaaatggacaaatcagagagtaaggttaaataggtatagatacatacaggtttaatgatttaattaacaagcttgatctaagatatatatgtttacatagaattccttgtttcctgtgtacagaaaatactcattttttaaaagaacatataggatgtacaaaaaaaaggaaaactatgggataatatgattaaagaaaaaagacaacgaagaaagattagagaggagaaagatgacaaagcacagagatcttttaagttacaaaataataccatacagttctacaccagtaaattggagtagttagatgaaattatttcctagaaaaatataaattaggaataaaaacgattaaattgtatcagaaccttaaaaaagagaatttttctagaacaaaagaaacggaaatcatgccatgtcattctgtaagtctaacatcaccctgattttaaagcccaaaaggataacctatgaagatggacatcagttgtagttataaattcaaatgacttctggcccgtacaggttacccatagccacatgaaatatcagaaacaatctcttttaagtcagaaaagcaaaacaaggatgtctgctcaccacactatattccacattataatggaagttccagccaatacagaaaggcaagtaaacgccatttgcagtataaatcctggaaaagaagagacaaaattataatttttttttttttttgagatggagtctcgctctgttgcccaggcgctctcagctcactgcaacctccgcctccttggwtcaagcgattctcttgcctgcctcagcctcccgagtagctgggactacaggcacgcaccaccatgcccgactaattgtagtattttcagtagagacagggtttcaccatattggccaggctagtctcaaactcctgaccttgcgatccgcccacctcagcctcccaaagtgctataatcccattacaggcgtgagccacagcacccagccaaaattataatttttattcaatttaattattttctttttttttgttgttttgagacagagtcttactctgtcgccaggctggagtgcagtggtgcgatcttggctcactgcaacctctgcctcccaggttcaagcgactgtccttccttagcttcccaagtagcttggattacaggcacgcgccaccaggcccagctaatttttgtatatttagtggagatggggtttcaccatgttggccaggctggtcttgaactcctgacctcaggtgatctgcccgcctcggcctcccaaagtgctgggattacaggcctgagccactgttcctggcctattcaacataattattaacccataaagttggaatcaacagaaaatctattatttaaactaatgagtttagaaaggtggtacaaatacttatgtagagagaaaaaaacctggaactttcctaaagggcataaaggaagatataattaaatataaagaaatataagcaaaataaaaaataaatatactgtgtttttaaatgggagacagtattgcacctcaaattaatcttcaaattcaatgtgattctaggctaaatgccagtcgactttttcaagaaacttgacaaacttctaacattcagctggaaaaaaaaatgcacaagaaaagtcaacatttttagtgaaaaaagtctttctctataataatttaaaaatattccttaaagccacaagaatatttttattctgtrtaattgatattgacacaagaaccaatgaaaccagagaatttagaaatgtagaaattttgtatgtcataaaggtgacatttcaaatccgtggggaaagaayagaccatgcagtaaatggtgtgaggaccattatttggaaaaaatcaaggtagcttcctcccacaaattataccaaaacaagttccatgtggatttattatttaattataaaaaactataaaagtatttaaatatagtatagataaatattttcatactctgaggacaaaagtcttaagcaagacacagtactcagaaagatataaaggaaaataactaacaggttcttctattaaaaatttaaaacttctctacaagtaaagaaaaagtagacaccataaacaagataatgagaaagcagtgcagcttatttggcagaaaaaagtttaaaaaccagaacgtgtagctctcacaatcaatgaaaagggaatccagtagaaaggtaaggaaaaggctaagaataggcaatttacaagaaaataaatgcaagtggccaacttgcatttgaaaaagatgttcaacatcactaatatttagggaaataaaaattaaaacattttacccatcagataggcaaagttttagaataacttttgtgtctggtattgaccaggaaggtagagaaaaacatgtactcttgtatgctgtttgtgggatcttaaattggcaatatctgtaaaatattcatacttttcaattcagcaatttcacttwtagtgtatcaagcctagagaagtatttgtgcttgtacggaaatagatctagccaagtataagcrttgtttataatggagaaaaattggaaatgataatctgtgggggaataatgaaataatgatatatccctattacatatgtaggttttgagtacttcctgtgcattatttcattttatttcctttaatagttaaaactagcctgcaaggtaaatgtcactcattcatagatgagaaacttgagtctcagaataggctgcttgcccgtttctcttacctacaaactttaccagtttggatcctataaaggaatccgtgaactgaggttacatgtactacaagaatatatgctacagttaaatgtgtaccaagtagaatcttgccttacattaaacttttatgccatctggtcctatgtagctcggctatttaaagctaccctaataatagtgcttcattgatctggtaactgttaattctgataaatttacatctatcatcagtcattttcacattccctatccaagttgaggcagttatgtgtagaaatggagataatctgtctctcccctgtttaatcaaaggggttgtgaagaaaaaaggaaaagaaaagctacatggagagagaaataaatcaaaaagaaggcaaaatggtagaaaaggagatgcttataaactggaggacatcctagaacactcatgtaaatgaaagtaaattttcccccaaataaagaggaaatgttccatcttagttctattataagccacgccttgcttacaagatgaaactggcttacaaagtgagttatgtactggttatattggattttgtatttggttgtgtgtaacagaaacccaactgcagtggcatgaccaaataaggatttattatcctcctagaacaagaactgcaggggttggcagttcagagctggtgcagtagcttcccactgtcttcaggacagtaaggtcttccacctttttgtttcatgtgctaattttgttagcaaatgctggtcaacttcgtgatcacaagatggctgctccacctccaggcttccatctgcattccagacagaaaaaaggaaagaaatgacatggagaaaggggccaggtttatgtcagaaaagcaaaactttctcagaaatatctactgaagttctgtttataattcattggtcataactgggtcacttgatcactcttagctacaagagaggccgaaaaatatgtttcagttgggctctctaacgccttgcttgttgcgaggagggacatttcaggatcgctttccctaccccctgcaagcagctagacattcatagatgccttagaaggcagatctcctgcctcttctctctctgaacaccccacccttctcccttggcatcattgctgtcaagccacttttaatcgaggagtatgtggtgtccttcaggagtgttgggaagaagagtttctattaaaaagaataaacaagtaattcaaaagtgttgtaaataatgatgtaactcagtggtyccctaacttttgaaattgtttacctctattagtaaaaatattttgagtatgtactctgtagaagtttatttgtaattatatatgtgtgtgtatatatatgtatgtgtctgtatttcttactgtgctaacatgtatttttactaaaacatacaaaaatagaggccaggcacagtggctcatgcctataatcccacaactttgggaggccaaggcaggaggatcacttgaggccaggagttcaagatcagcctgggcaacatagtaagactctgtctttacaaaaaaaaaaaaaaaaggccaggcgcagtgactcacacctgtaatcccagcactttaggaggccaaggcgggtagataacttgaggtcaggagttcgagactagcctggccaacatggtgaaacctcgtctctactaaaatacaaaaattagcccggcatgtggcatgcacctgtaatcccggctactagggaggctgaggcaggagaattgcttgaacccaagaggtggaggttgcagtgagccgagattgcaccactgcactccagcctgggcracagagtgagactctgtctcaaaaaaaaaaaaaaaaaaaaaaattaaattagctaggcatggtggcatgtgcctgtagtcccagctatttgggaggctgagataggagcatcacttgagcccaggaggtcgaggctgcaatgagctgtcatcacaccactgcactccagcctgggtgacagagctgagaccctgtctcccagaaaaacagaaccttaaaaggaatgagaaaaaataaatataattaatagggtttttgcctatacctcagttgattgtcttgtgcctctgactttggagaactttgtatacagtgacttgaagctgaaattttaaatttcatactgagttcatttgtaatttatatatatatattccatgtatgtatacatacatcttcttctagtccttcaccagtgtttacatgtttctcttaatgtgactgtgtcttcccctccatcaggtttggtctcattcttcgagtagcctaccctcaatcctttctctcttaagcactccttttcggctgtttccaaagaagtatcctactcctttctagagctaacccgctcacctcattcttgtgctcttcatcccaacctcttttacctctcctaagaccttgctctaccagttatttctttgtttcttcttctttactggctctttcccctcagcctctaagcatgctcaggtttctttaggtgttattcctttgcttcttcattctcaggaagcttctgctttctgttccttcttccattgccaatcytcccttcacccttcaactcactgcattgtgtagtcttcctgcaatctgaacagccttgctaagattaacagttatacttctttttatcccttatcttattctgcctccctgcagtatttggcacacrccttttttcctgaccactcttcctccagtctcttctgcaagttgcttttcttctgtttttacttaaatacaggtcttcaccagatttgcgctttatcctttttgtggtatcctcttttcctatatgatttttatctactcataaggcttcagctcttccctacaccatttacaccattcttactgcttccagactcctacatactgccctgtcctctctcctgattccctttcttttttcttttcttttcttttcttttcttttcttgatggggtctcactctatcacctaggctggagtgcagtagcgtgatcatagttcactatagtctcaaactcctgggcttaagcaatcctcccagctcacgctcccaagtagctaggactataagcacctgtcactatgcccagctagtctctctccagattcttgatttgtatttccaattatctgctgaatatctcttcctgggtaactcagtactcaaaatataatgtggctaaagccaaatctttttctttaagtccctaaactccttcagcacactgtcattcacccagttgttcacattagaaggtgtgaagtttcttccctccattcatcaccaggtgtgtcccttctgttctagaatatccataaaatattccatcttccccttgcccagtgctacccaccctggggaagctgtatattatagtggaataaatgtggactttgaagttagatacacctgggttcaaatcccagtgctgtcagttactagctgtgtgaccttgggcatattgttcaacttcttttcagttttctcatcagtaaatttgaaataacagaagctgtctcttaagatcctttttaggctttatttaagtaaaaaacacacagtaaatscttaaaaaaaatcaaaatcctgcctagactattaatttagactcctaactgatgtatctgcctttgatttctcccttactccaccttacatactgccactggagtttctaaaacataaatgggaccatttaccttcctatgccaaaaatctctagtagtttcccattgcttcaagaaacactgaaacacctttgtcttagttatataagtaaagtaaccatatgctttatcacacatatcaggacactttagagagtgaaaggaggcaccagctggacaggattccacaacaacagccataaactgggactattcctgggaggactgggatgaatggtcatactatatatgatactctgcaatgttcccccaacctcttctgttgacatattaggctgctcatcattcccaaagtacaggcctagaatgccctctttctcctcttggaagtaaacttagccttcattcctgcagaatgctttccacatacctaaggtagtgcctgccattccattataagtgtaatttctttccctcccgctagacttgtgagcttcaagggccaatctcacttggctttaaatccccagatattcacacactacataggatcaaggttgtattcagtgtttattgaattgataaataaattgkatttattggtttgccttcaacaatccacatatggaaaaaatataaggccacttacaagaatacaatacataatagcataaaataaaagtcgattttatgttctttttttatattatgtcatttgtctgtacccacacatgaataaattcaagtgtttcttaacctaatgtttagtatttcttatccacaatccctgtttctctagctaccatctcacaggctgtgggatccagttctaacatgaaggtagaagtccctctatgggacttcctgaaagcttttgcttttgtaataaaaaggaacagatttggttgacatagttactcaacactctctcatcaccacccttccttcaatggaatgtaaactaggtacctggagatacagcagccatgtggcaaccatgaggatgaaagccaacatagtaaggatggcagagggaaagctagaggaatctgggcctctaaagggttttttaagccactgaatgagcctgtgactggtaactctaagacttcttgtattataaacgatcaatgcctttttctcaaaaaactgttagtcggattttctgcttatttgccatcaaacacactactatcatttaggatacactcatcaacctacccctaaacatctaactttaaaaaattttttagacaattttagtattttttattgatcataatatcatgagacttaggtaaatgcacttattgtttttctatctgatattagaacaaacaaggttggctttcttaaattcttcatatcctgtcatttgaaataataacttttaccatgttggtcaataatgtcaatgaatagcactgctagcaaataagggctttttttttattttaggaaagcaagtttgcagatgagatattactttattagcacctatctaaacacaatatggtcactctattttcttcttcatttaaaactaatatttttaaaaagatatcttaactgtttcagactaaagcatttcatcttctatactttaagatgtatgcaaactagagataaaatattacttctctataagctgcatgaagtgtttctcttggtggtagtggttatatacaattactgcaattttttaaagttctttttcaaatgggataatttactatacctgtgtagttttgttttttaaaaaatcttgattgagataacagatgtatttttctgcaagtaatgttgtttgtttgggaaaatgtttaaacctttttagctgtgatgtttaaaccaaaaaggtcttatactgtatatgctagcataggctttcattgcattgatttaactacttagtattaagaatgtttatttatgaagcatttagtcagctttgattgtttttcttcagtaccaaggatgattgcttcaatgttaatattcagccacctgttggagaactgcttttacctgtggccatgtcagagaaagattttaagaaagagcaaggtgagagatgtctacaacttactagaaatttacataccaaataatatgtgcttattcctgtacagtctctaaaataaattttcataggtacatagccattaacagatattagtgcacaatcttccaatttttgttaatgctttgcacttacaaccttaaaaacagatgtttgtctatattcctggcatacttgaaaattgattaatatgtctttaaatgatacattaattcttaatcaccttttcaatgctgagagttgttgcttgtcaacctgatgatatactaatgggttttgtattattcaaagtgccaggaattggggactttaccgatgtcctaccactataattgttatgtttctgtattttttcactatagaactgtttttttatgtcttactaatgtatttgtccctgcacacattaaactaccttatccttcaaaataaactcctaattatggcattaaaatacttctagtttcttttgacctaattctatattaaagaaatgctgtgttgtcagaacctattagaactgaaacatttttaaaataagtacttaaaaagaaaatattttcagcaaaatgcaagtattaatatctgtagttggcccagagtcaaacataccttctaataaaaacgaggtggttttttttcgtatgtgaataaggggagataactgtctgattttatgtgtttaattaacgataacatttataaaattaaggcatatttaaatgctatagtcagcagtttttacaactttatgtgaatctaagccattttttcctgtggagggtgttatcaaagatcccttcattttgaggtagtaaatcatacccatcaaacttccagaacgtactaggcacacacaaatacctacacctaagaagaggggcacgcttcctggcactctgctattgtgctgaagatactgtttttactctaagcctttgcaattcacaatgtcaaaaagaaaatctcatacaagtccataaattaatagtaatatttttgctgggcattatttaagcaataaaaaagaacgatgaaatctttctttggatttgcatttcttggaaagttgattattgctatagaggaaaattatctttgtgattttatttttctattgacaaattgaattgattcttatatttgctattcttaccctttgctggctaaagcctgcctctctgctttacatctgctcagcaaaccaaggtgagtggcacacggtgactgaataaggctttggcacatttattgttaaggggatattctttttttgaaaagtgcagctaaagtatatctgaagcagcagattattatataccctttcactccctcagcttttggttagaatacttaatatttcgatcaaattttttgtgctctgctgtgactgagggatttttcgctgactagccatacagaaccttaagtgcatgagagaggtgcacttggagaatagctgtggtcctctgtggagttgttgccaaaattcctttttcttctgccattttacttctatggttgttgattatttgtctgaataaatctggcagctgtttgctatgtttaatagagcagaaaggctactctgaataaagctatttgaaaatttgtttatatgaagtatttgtaaatccttgcaagtctcttggcatttctgtatcattctttctgtcttcctgaattcattctttgatgtggaacttgatgctggcaaatttagcacaggtttaaagagtcttttcaatagcatctttttagttatagatttcagcaggtttggtaatagaggtctcaatcctcaactttacacatgtatttgttatactactctagtaagagcttagcttatttccacaaaagatacctagaaatctctcactaacggaaaagcctaaatcagaataaaaatcygtttcctcagattttatcaatgcaaaattctggaaggtaaaatgcaagtaaatttaaggggtgtgtgtgtgtgtgtgtgtgtgtgtgkgttacaccagctttaaccgatttttctaccttgaataaagtggatttacataattaatatcttatttcatatgacacattttaaaactcaagaagtatgttaaatgtgttaattaaatttaactgaaaaaattataaataaggaacatggggaatatggttctattttcattctaaagatatacgtaactgaaaagtgtacagtattaaataaaagtggttctaacagagtattacattttagattaatattttttaaaacaaaagttttatttctaatatgcaacatgatctatcactttttctcagttgtgtttagggtttcatggctaaacttttttatatatatataataagattggtagtcaaagtggtaaaygaaagattagattattctacgtattgacggttatgtatataagcctccatcagaagcatgatttattcattgctatgagtttcaagcattgcagaattagttaatgatctagctgtgagatgctttcaataagaaaataacatgggatctattttttacttaaaaatatttaatttggtttcttcacgcagttttaatttcaagagtacgtgttccgagataactcctcttattcattttcttcttgtgaattaaattgcaaatgtaaaacttagaattttttttgaatttttattcattttcttcttgtgaattaaattacaaatctaaaacttagaaatttttctgaatttttttatgttatttggtttgccttttagyagttaattacagctgattagcctaaagtaagtgctatctactgcyttcaccaaaatttagatagattctaataaagccacaaattatttagcctacagtttttaaatattttcccagtgattttacctttattatatatgaacaggctctacagtgttttaaagtattattttttaggaggaacttttaatgaaacctttgcctatttttctttcctgttaatttgagaatacctgatatagtttcatttagaaaaatctctggtttaagaaacctaaaatgtttacttaattttattatgatttatgcatctatcttatgagttcctagctagcaagatgctaattctttaaatggtcagacatttactattttctggcccttaactaccataagcaatcatatttgatgccccttaattagagcacctttttttctttccaggttctttttccacctcagcaatcgagacaatacatttgcttaccrtgctgctctcctaagtgttcttttgcatgtaaattaatcttgattcagtttacactgtcatgctgagtggtacaaattgcctataacaataaaacagcatgagttaaaaataaaggggggtgggaaggcagattgaatgtgtgccttgataggatgttactttgctttatgccaatacattagctgacgataatgaatcttctgttctgaaaagcatggtttagttgatttttttaattttacttcaatggagcagtaccttgtcttttatagaacaagttagacaaaccattaatgacaagagtgttaaggttaaatatgaagcaatgcattcacttctctgagtgctatccatctttccatttacaggagcttgacaaaagtactggctttgtacaacatttcctttaattacatgctgcgggaaacaggcttttaacataaacatagttgcattcatttattcagcagttgctcttcaatagagcttaatggagaaggtttaaatcctaaatgagtacacacatctctcagcagtgttatgtcagccactgtgctttacttaaaagcagtgtttgactgtttgtatagtttttaaagcttttgcctaatattgaagttaaacggtctaagacagaacatagtgttcccagagtttgaaagtggttagtgaaaaatgcttgttgttagaagctagatagttctattttctaactgacggcaaaagtcttttcacaatgttaggctttagtgttttcatactgttaatcgtagggattcttttaaattttagttttcatttgcaataaataactaaattaaatatatatgccagacggtgcagagtcttttgaaaacatgaaatcagatttttactattttcatcaattttgtaaactactgtgcacatatcaaatatctcaaagagttattggttctaatagataaccattagatgtctatgacttatatcaccgatccaaatagatggcatttgttgtaattaatttgttttttaacccgggcactaaatttcagtatttgttccaagtgtttggtatgttgttgaatttgttcactgaacatttttacaggaggtctggatattaatggcatgtcttgcattaactctgtatggtttttttcatgcttttgcttaacttaatttctctcctaaatattatttgaaatgtccctgggatttaagagttttcattctcattttttctttcattttcaaagtttttgcttcaggagtttcaattagtgtttttgtcagcaaaacactttccattcactagacaagtacttttagctctaagtatagcctaaatacttgtgcattttcagtgacttccagtcactgttgagataacttcgatctgtcatactgaggccatttaccaggtattgctgctagttatcctggaattactttgatgtgttctcaagcagcatttggcaatgagagatctttgaatgaatagaaaaaaatagcaatagtaacaaatacatttatatattattaagaagtaaaagcttactagtttacataaaccccagattgagtatactttaaagagactgaaattgatatttcatatgtgtgattctaagtttttatcctatcatacttaaaattagatttaagtgattttttactgaatttttacacattttcctatacaatgaggattttaaaaaacttcgaaacaattgcattttgttttagttttataattatcttgtaaattacatcctaaagtagtgtttcttttgttgaaaaaaagttaaaattttggccatgagcttaaaattctgtaaatgtaattttcaaaaagaaattaataaaagggagccttcttttgcttttacaggagtgctaacaggaatgaatgaaacttctgctgtaatcattgctgcaccacagaatttcactccctctgtgatctttcagaaggttgtaaatgtagccaatgtaggtgcagtcccttctggccaggataatatacacaggtaggttcactaacacacgatgtggaggtgaagatgacttgaatatgtataaatatataattttaaattcattgttttctttggaaataataacccctaaacatatatatatatacacacactcccttttttttctgatggtatagttgttgattgctttgcattaaggctgtctttcccatctcagagcatccttatcatactggcatggtctttcctgaaagatatacagagcatattcacattttataatagcttggtaatttataaagttaccctttttgaggtggttgagagtttatcttatttcaccagattcagtagatgtccaggaagaactattctataaagcagtatagttggacttttttaattgaaagggaggacgtttgggtactacatacagatttccttttgatagccatcccctgagactgcttccagtaaataaagagctgctagatgaccaacatgggggtaaatacagcttctgtttcttagaccagtaatattttctatcaccaagcatctgaaatatgagatccaagttatttgtcctgaaaggcagcagaaaatgtgattaatgtttgccctcttgtatttttatgaattccagtggctttaaatgaatgtaaagataaaaataattatctcttatccatttggtgattgcacagtcctctgtgagcttaagggaattcgttgcaaaccatctcatggcaggcatacttctgccattaaaaatatctacacactrtatatttagtgtgccctttcttatataattatcaatcatagaaaacaaatttagcatcaaagggaaggcctgcagaccttaaaaaacatttttttaagttaacacaggagcaagagaggccccatatgaaaaatgctacaggtgatttgggttttagatctaactctgccactaatgggcttggtaatcttggggaagttataacttcttatgtgctttacattccttatgtgtttggaaatgggtggcaggaagaaaaagtgaggtaggattgaaatgaaattctgtgatagctatgaaagaacattagatttgacttcagaagagctgacctgccattactgtatccgtagttgcctaacttcactgtactaatcacggcggaataaaaactgcatgtactagttgaaaaatagatttaccttgtactgttttttttttttttaagttgctcaagaggtctcatgctttcatttcttttttgttgttgttgagacagtcttactctgtcrcccaggctggagcgcagtggcgcgatctcggctcactgcaagctccgcctcccgggttcacgccattctcctgcctcagcctcccgagtggctgggactacaggcacccggcaccacgcccggctaattttttgtatttttagtagagacggggtttcactgtgttagccaggatggtctcgatctcctgacctcatgatccacccgtctcggcctcccaaagtgctgggattacaggcatgagccaccgcgccyggtgtctttcatttcttagtttttgacaagctctatctatctcacataggatggtgataaaataagaaaatggatgtaaggtcatgatacagaccaccacaaaaatacaacttatttatcagttaatgttgttcaatagggaaaagagtaacaaaagccttttcagtgaaaataaatattttgagttttcctgttttaattttattctgctttaaatacttcttttcactttcctaggtaattttctctaacagaaactgttttgttttatttatgggtccttggaattattgaatttactaaaacaccaaaatgctgtattatcaagtataacttcttcagtatgaaattttacctgaaacacctagtatccagcaatactgcagtcttgttttaatatagagtagccactgtttatgctggaacatctagtttagttttgttttgtgtataggttgttttgggtttcttttttttgttaacttttctgaaagcaatggcagctgtctagatttttgtttcttagaagaaaaaatgtcaaggctgggcaaggtggcttacatctgtcatcccagtactttgggaggctaaagtgggtagatctcttgagcccaggagttcaagaccagactgggcaacatagggagaccctgtctctacaaaaaatataaaattaaatccggcatggtggcacatgcctgtagtcccagttacttgggaagctgaggtaggaggatcgcctgagcccatggaggtcaaggctgtagtgagctgtgatcacaccattgcactccagcctgggtgacagagtgagaccctgtctcaaaaaaagagaaaagaaagaagaaaagtgaagttacaaagccacataaaatgaaagctatcttcctattgggagatagacttagagggacccttagcacagttgtataattcttattaaagatagtttgccagtaacttgtcttgctggtttggaatgtaatacctgtaatacctgctcaaatgatttaaattaaaattacaatcaattctcaattgtccatgctaatacagaggagacacacaactaagaaccatttatatttgactttggagtgcagagattgaacccaaaacttaatgttcgtggtcctcatactcatccacagtgtcttgaggcttttctgttctagccgtatcatcagtggcctggtgtttggctctgtaacctgggggagggcccaagttactacagggtcaaaagtcaataaaatacctgtagatacttaagaatagcctgtgctgtcttaacttgcttctcaagtcccatcatactgaattgaaaaatatttcatatttgcttttatagctaaagtatgactgtaataatgttctaaattttagaaagcttccaggtaacaaacacctaaagttatttttattttttatacagatattgacataaattattatcctgtgtatgtaacactttttctcattctttttgctaatagcaattaaaacaaaaataaacaattgttaataaaacgtacttttgtactttttttttgcttttcttaatttcatttaaaatgaaataggaattagtgtttacattataataatataaattaactgtttaccactttattgaaataaatgtttttaactatagtgttccatattatattaccctactccatggaattaatacatttctatatctaagtttatatattatttaattgctaatgataaaattgaaatccctatgagattttgaatgattcccttattcttttgtgatagttacgtttttgagtttataaagagtaggaccaaagccactctaatatttattaatggtaatcagtttgggattatttttaaaaacaccaagtatgaaaagcatttttactactagtattttaagagattaaaattttcaatatgataagttactcttggctggcttatgttctatttaatttttcaggatcttttctttctgagaggacttttaataagaattagtgtattcgttctaaccctttaatgaatagagtttccattgcctaattttggaatactttatttctactactcttcaaattttatacatttttacattaaatgccaggtaaagaaatacttagtgtaagaattatctaaggaaaagtgaacctttattaatgtggagtagtatgtaatggtataaagtacagattttaattgaacacttaatagaaaatgattcctaacacagcaacagaaaatggccctcattaagaaaagccaattaaaggcgcacaggttttatgaaatacacttcaaaaaccagagacattttttatttcgttaacacttttaaagatcaattgagaaagcagctctactgttagattatatgatttttagttgtaattttctaaatgagtgataggatcagagccaaacagtatactattgagagactcaactttatcttcatttctgtcgtacttacttgaaaaacctgctcttggagaacaaaatcatcttattgagatatacagagtggccgggcatggtggctcatgcccgtaatcccagcactttgggaggccaaggcaggcagatcacttgaggtcaggagttcaagaccagcctggccaacatggtgaaaccccgtctctactaaatatacaaaaaaaagtagccaggcttggtggcaggcgcctgtaatcccagctacttgggaggctgagacaggagaattgcttgaacccaggagggagaggttgcagtgagccaagatggtccactgcactccatcctgggcaacagagggagactccatctcaaaaaaaaaaaaaaaaaaaagagagatacagaattatggtcattgcgtcaatctgctgttttccaaattacagttaacgcatgataaggagtattacaaaaatgagaagttccatcatcatcaaaaagcatttattaaatatgtagctgaatatcttcacttcctgtgtaagatattcaaatttattttaatgagatatacattgtgaaggtcttaatgcatattacttaagacaatactagtaaactaatacataaataaagtgtatcccaagggcaaaatggacagcattaaaccagtatatgaatggactgcaaaggtgaaagggcaagacctcatgtgttcgaaggtaggagattagaggcgttagctgtggggatcccagtttcattcagggccaggaaaactttcatgtgattctctgtgaaatatccaggaagggtttaggaaggaggtttgtgttcaatgtcgtggaaactgaggtgccttgcttttrttacattgcatgtcctctgataacagcacttatgagtaagtgcagtggccaaaaagcagaaaacaaaaaacatgtagctccgaaatcgctaaggtttttctgtacaaaaaaatcatgtgtgagtttgtgtaaaactcagatttctggaacccaccccaaaaactcagcttcagtaaatctgagaaagagcccaggaatctctattttaggcagcactccaagtggttggaaggcaaatgttccgaagtccacagtttgaggctgcctggaattatcaagctgtaatgccacatgacacatttcaaaatattttttcctatgtttatatgttttattttttactgrttagtcagtaagggatgccagtagatgagatgtttggtttaatttttcttacacatatcccagagtgctccagcaagacagtgtattgtccattacgggagtacattagagcagtgtctataaaacagtcttagaccataactgtgtatgtctttcagcagtctcagccatctcacattttcacccatagtcagaaatcctgacatttgtatacaataatattgttgaaaaagttgtcacacttacctactcattttgccttttcatgaaccgcaaattaaccctctgaggagaaaaggtgatatttgattgaagacagaacatcctgtctctgccatgattctattttagttcttagcttattcagtaagattctggagcaactttcattattaacttgtattcactactgatattccttcccctctccccctcccccacccccccgtatatcttaattagtaatttggattttgtttatcctgtcactttttaaatttgcaagcttttaccatatgcaacttgtggataattacaatcctagtcgaataaatgttggtttactgttgtcactaggtccttaactattaggaaagtctggtgctgtgagtgaaacagtgtatccattggcaaccaagtagtcaactttttaatttatcaacacacataaagacagtttatttcaggtttaaaataaaagtcttattatttaattcaagtacaggtaaagaacaacttgtttcatttctttttttttttcttttaagacagggtctcactctgttgcccaggctagagtgcagtggcacagttgtagctcactgcaaccttgaactgggcccaggcaatcgtcttgtctcagcctcctgagtagctaggactacaagtgcatgccaccatgcccagctaatttttttttttttttttttgtagagacagggtgtccctatgttgcccaggctggtcttgaactcctgggctcaagcagtcctcccactttggtttcccaaagtgttgggattacaagcatgcgccactgtgcctggccaacttgttccatatctaggccttaaactcacccagttaatcactgttattgcatacctgtttgaaggttgttaataggggaaatactggtacacattatttttggtatcctaaaaagatctataatgtgtagctccttcacttagtatttttttggagacctttgtgacagattttgctggtgctagggttgcaaacacaaatggcaaagacacttcttgatggggtctctaatatttccctttctctattcttagtttgattaacttttgagttactgtttttgtttgttagttgttttcttctctgttggtaactatatgggatttgaattctgggtaattttggagaatttgtaattctccaaagaatttttgcttttcaaataacattggacatcttgttgccctaattgtataagccctgatactactgtcaaccttcttcattgtataaacagaaacaaaattttgtataaatagttttaagtataaaactatcaggctcaggtcttttctacaatatgacaaattttgagtctcaaacaggactgaagatttgtagaacctctttagtaatcaaaacagttctttctcaggttggtggctgtccactagaggacagcactgcatttttatctgactgctttgaactctgcaggccctgagcatcagttcattgacaaacaaatgcggacctcagttaattttcacacagaaagcatatttggatatttcagaagtaaccaaactgcacagctgatttttactttaaaacattctctatttaagttttatttaagttcaccatttaatgtcctctaatgcaacaattttrctaatgggaatctgtaactgtttcacgtaaaaatgaaagaaaggtattcttgatgcttttccttctggtttgacaattttgtaaggaatcaaagagaatggggtaagaatgtatttgttttactattagttttcccttgttaaccccatctcaccccacccccaccagacaaaccagaaatgctctgaaataactgggatgttttatgtcttctttaagcaagggcacttagattttttagctttcctatataaagaaagagaatgcatcattggcctgatagtgtggggaataatttttttataccatctctgaagattagagtaggaactagagagtcctaaattatggtggttgtttattttttattttaacttttctcatttgaacgttagaggaaaatactacaatattgttaggtgattttttaaataactgggaaaaatacattgctttgtgtaaattctctaaaactaaatcacgtgtaaatgctttttttgtccttcactattaattcaatagtgtaatggtttaactttaaaatgcaattttatagtcaacaaaatagaattttttacaacttacaaattctctgcctgtttaaaatgttctactataataactcaaggtaataaagatttataattttaaatcctttggcagatagcgctccaaatcactatactttggtattgatgtttaggaggcttattccaaccagtatttcttacatataatgatcgtgcgacttcattacacatttgtcaactttggactaattatttttatacagctagggcagggcactgcatcttgtgatcgtctttcttactaataggattctgtctgcttcagcaggcagtaattgaaggcttcatgtacagagtacaaaaaaaaaaaagttttagcctgagtgggtcattgtcacagcttctggtaaccagtagaacagaaagcacaagaaaattgaactcagaatagaaaaatcagaaaccaggaagactatccaagagaagaaaaagcatgtcttagagctgttgcattaagtatagcaaatctgattctgtgtaaaaaatgttatgtttgtgactaccctggagactgacgcagcctctcagataaatacttttaaattcatgctgtaccgttaatgttaattgttagaacaattgaattataggatttcttttccttctaacaaagaacatgtatgatttatagccagtttgttacaaatcttaaaaagtatagtttaagtgcatggagaataaatctgtgtattatagatattagatttttttcaaatttgttgttgctatttggtctgtttttataattatgactatagttaagacaaaataactttttaagaagaatgaaacttttttttatttagctttgacaaccagcttattctgtctttttcgtaaatcttaagaattcctataggcttcaaagattaaatgtcaattgctggagataatagacaaagacatttaataagatgaaatacagatatagccaaacagttttaccttctcagttggtgattacaaacagcaagtggttggtgatagaatgaaatgaaaaatatctagatggtgtccttttaataacatggagcccgtcatacacaggcaatacatctttaactgtcatcgcacttatttgttctcatttgtggtgttactgcttttcgaggttgattggtctccccgtagtccctccctgtgttacagctccattcaaaaaggctttgtatttttcattgctggtgtctctttagggagaggagagtaggggatatttaaaatgttttaaatctttaaaggcagaaatgtaaaatatatgaggaatcaagtccgcacgctttgaattacgcattactacaaaatcaagtaaacaatttttgaagagaggactcttccttcttaatgtttttggaacaataatagattatgtgtatattaggtaaatgggaaaaactttatctgttgactgataaaaacaaattattatgggtgcatttttgtatatatgaagataatttgtgtgacctggaatcagaatgcttgggttcagatttctgctcaaccagaaatttggtgtgtggccctgaggaagttcttcaacttctctgggcctcgcttgcctcatctataaagtgacctgcctcataggattaaatgaaataattccagtgaagcacttagaacccactgccagaacacagtaagtgcttaacaaatgatagctgctatcatcattatagtgatcaaaaatttctcatgccttttgaaaaaattttgtcacagtgtgatcttagttcaaggccaagcacagaggttctgatgtcagccattaagtttagtatgtaaatatctgacccacgctgactttataatcaatgtttctgacatcccaaagctagctatttattacttatgaattagtactctttccataactattttttgcatgtatgttgaagcatagcctgtgcaggagttaaatgatgaataaatctggggtagtggtttttgccttccgagggccaaaacaaaccaattttgatcatgctgtgttccaattaaatatatcctttctgaactgtgaaatgagaatgtcagaacatctgatcttctagtcttccgctttaaaacattgcttccaccatttgtgtccactagaacatagagacctagttaataaaggcagtagcttttacaccagctagcagattatgttgctaggatgatttgcttagtgtgtttccattgcagcgtaagcagatgcctcttttctttcatacccctattctttatagtactgagacttttgtggcaataggatttcaaaaatatgtccaagatactaattctaatttctgtcaacatactgacaccaaaattgacatttgtctctgccaactttatattaattgtaacattaactctaagttttttaatagaaaagagacaaaatgtgccttggggctgtgccaccctgaaattcaaacaacagtrcttttgtgttcctattcaggcataatctccttctctatggtcccaaggcacaagtgttaagtaaataaagggactaataagactattgtttacataattataaccctgtcagaaatagggacctctgttgaaatatttgttgagtgaattacacacgtgatgaccgaatctgtgggaaaagttgcataaatgaatgggaaaatagagccacctcatatcctttggtgacgtggttttacaggaatatagaaacagcattctcctatgaagcagaagagcctgaaaaatttagacaaaagaaatgcataaacctgtgaggagccttagaaaagagagatcattttagggctggtgatctttatgtttctcaaagatgaaattgaggtacctagttcataatctctcatgtgtacgtctgaaaagcagatggatgtgtgtgttaagaggtttataaaaacctctttaaaaacattggtatgatttatattcctaaactggttacttacaattgcttctctcagtaggaatactgctctgtcagattccttgcaagttttcagcatgcttgtagagtgcacaagcaaatgcctaggaagattttctaacatattttgttgatagcccattagctaacattttaaaacacaacttcaaagtgtttataatatttgaaatttagtaaaattagcatatctgttttggtttggatacattattctaattattgttggacaacctagttcatgattttatttgtccaaaaatggcttgtttggttttaaaaaaattaatgtgttatgagatcttgatgttattttttaaaaaacccaaaaaagaaattacttttcatttaaagagaatctgcttcctgcttaagtggctaatattttaattaagtcgggagtgaagtttttctgagtgtctcctgataaactccctcttttatgttgatggtaattaaacagatccctgtggacaccgtgggctctgtgcgaggcccatgctaattgtcagacatgagacactgaccagttggtttgctcttgaatagtccgcagcgtgctgttagcgcggcagttttatttttatgtattgtgagctgttgtcagggctaactgggtgccattgtggctgaagatgttgcgcaaattgaggcagatggctcagattcagacacgtgtcatatagaaaggggcaaggggattggccctgcaaagtggggtcacagcaggtcacagacctgctctacacttgttagtgttttcaaaagctcatgtgcagcaactttgtttttctccagtcatccctgcaatcaaaccccctcccccaaaaagtgtgtggaacatgcttcatgtggaaaagggaggcttgggaggttcctgtcctcttccttcatgaccctgaggctcaactgtgcatgcagaatgaattagcaggattgacagaagttcgttatgcctgcaacggcttttcagtcaattgcagtgcttaaaaggctagttttgcttttagttccgtgtaatcagtaggttcttcatgtcttggaatttagagttagagctttagacctccagtttcctctggaaatgtttttgtttacactctacagaaagaaagatctaatgtcctaaacatttcaaaacaaagaaaaagggaagcgtgaggttgcacttagctgtcacgtgattttgcttcatgtcatcattaacattagagatttaatttgaatattgttacatgagtgaattcattgaaacttagtaagaattttataatgtacgtaaaattatctaacttattacataatcattttcagatatgaggagttaaattttgaagctctttgagaaaggtaccttttcttaacatgttttaaaaataaaaatacaatggcttatttaaaatgtccctatgcatggtgaaatgttaaataccaagtggatgaatggttctcaamtatattgtaatggagaattattcacatgcatctattgtttaaactaataagtaaaatagacttcctttttctgttctgttttaaatgtgcactaaaattacctgcttgtggttagcatgggctggacagtttattgatttttcagaagaatgcttggctttgggtttttggcaatagggagcctgcagcaaattatttcatttgacaaaaaagagttattttaatcctatttgaatgtatgctatctcctttaccctccccatcttatgataaaaggtctctcttttttctcttccaggtttgcagctaaaactgtgcacagtgggtcattgatgctagtcacagtggaactgaaggaaggctctacagcccarcttatcataaacactgagaaaactgtgattggctctgttctgctgcgggaactgaagcctgtcctgtctcaggggtaacctgcttacatctggactttagaatctggcacacaacaaargtgcctggcatccactactgctgcctttcatttataataatagcccttccatctggcagtgggggtagaatacactcttgacattcttgtctcctgctttagaatgctagtgtgtatctatcatgtatgcaatactttccccctttttgytttgctaaccaaagagcatatattttactgtcagttgtctcaactcttgaatccatgtggcgttttctctgtcctgctgcttcttttggcctcctcgttttccttctctttttcgacaatggtagacatgaatgagatatttaaagttcattggaaatcttcttccctacagcagtaagcaaaaattagcaaagagatagtctaaatggcctctcagcttkgtatgtgaaaatgagatcacatactttttaaatccaaatacaaaagcatagtctctgcaagattttgttctttgaatttcttgatattgtaattgattattgataactgtcatcatgaaattatctctcaataataagataaataaactagcatatgaatcatatttgtctttgcatttttaatgagaaactattaataatcctgaagttcatatgctaaagttttcttattttaaagcaagtattttgagtgttacattatgcagagaagcaatgtggtttagttagcgaaagaaaaaccacttccaaaccaagtaaattttctacttatagtttactccaaggaaaaaaaattggtgtatttaataacaaaaacaaaaatcttcatattgcaaaataaacatcttctaggtagttttgatctattagtagatatctgattatgtggcctgctgaataaattctttgaatctcatttttccttatgcccaactttggaaactaactagcataaacttatagaaatgtttaaaactagttatatgatcaacctattagcatcttttcctagagtatttgttttatttgctaccttaagttactgttttcaaggttgttctataatcagagaacttttctaatactttcgtacctttttaaaaccagctgaaattttacttcctttttgaagcaaggtaatggactttcaggtagtataagctactcagttctttttgtatagagccacatacataatgatttttaaaaagtaaaaaggaagtgactgtacattgcttgaagcattataggaaggctgaaaagaaaagaatggaattttcttggaacatacatattgaaaagaacaaaacagagtcgaaaaattatttaaattttcaagctggtgggatgacaagagtaaacaaaattgttaaattttcctgctccagaaagaaatatagccctgaatctccgggaagagaatgtacagaagtgcaatgtacagaagccacgtgtacattttgtgccaattccgtaccatgtgtacattctgtaccattctgtaccaatgtatggaagccacgagttccacttccctctggagcctgggcgctgtggtaacacacccaaaagcccctttgtaatcgcaggtcgttggcatttccatattagccttattgctcagagcttcataactttgaattttaagtcaataactttttgaaatgtcagacagaatttgacaggtttaatacctgttttctgaggaagaaaaaaaaattatatccatgctgtcttcaggcagagggaaagtgcatgttgtgattgagaaaggtcttatttttccttaaattaggacactcatctttaaaagatagttcacacatttgtatttttttaaactaaggaaatttaattagggctttacttttgactaagttatttttggctgctaacttttaaaattatggtaaatcaataatataatgtagtatgaatcagtgaacagtatgtatcgattgtaatgtgcgctaccagttgaaaccattttaacactagtagcttaatatcattaaaatgtttttcacgtaaaacagaaaaacgaccaaagccccaagttaaaggtttggttttttttcttttgtggtgtggtgattcagagttccttgcctcatatttcctttaactttgtcataatccatgattatctttaaattgttccattgagtcgagttagtcaatgttgaattcttaattctagctatattttttcattttaatgttcacttaatgggacattttatgtacaccaatcttgaagaatggctctcatagtatatttcagactaagcctcatttttgatatcacaatacatttgctttatttattatgagagtttttttattctaaagagactgtaacaatgcatttctcaaattaaaatactgtatacttgtccttctcgataactatttgcaaacgtatgaataactttatagcttacaaaacgtttgcccttataacctgtgttcccgttgttaagaatttagatgttagacaagataagaatccagactgatggaagatttcaaaaaaagaaaagttggaccagctaaaagagaacctaagatctttcccctgacttgttccctctctgttgtctctctgaccttctagggaactttgtttaaagggagaaaggaatcctgttttcacaaaatgagagagaaaaaaagagcactatgtttgccagctgtggtggctcattcctgtaatcccagcgctttgggaggccgaagtgggaagattacttgaggacaggagttcaagaccagcctgggcaacagagcaagaccctgtctctaaagtaatttaaaatctagccaggtgtggtggtgcatgcttttaatcccagctgctggggagtctgaggcaggaggatagcttgagcccaggagttggaggctacagtgagccgtgatcatgcccctgcactccagcctgggtgacaaagtgagaccctgtctcaaaaaaaaaaaaaaccaaaaaaaaacagagcctttctattccctttttgctgaaagactatatctactgtgaatgtggagaactacagtaaacctcatcaggggtgtagtaaaatataagttatgctctgtacttactcaaaaaacgtacaatctaattggcaataaacaaaggaatgaccatgtggacctccctaagttagtgagccctggtttgcaaataagtgttgcttacatcctaacacaggtttgcctccgccccacccacacttccttcaggtgccaagtcctgcagcttggcagccccagaggcctgctggccccagcttttcacctccatggcctccttacacaggtgaccgcactggactggccggccatgggggacacacttttgttcttccatcagttggggttgattaattgaaagacaatgacttctcgactgtgcttgtttatcttcttaagtcctcttccccgccggctcccgtccccctgctttctaacctcaggaaacattttcatgatcaattcattctcttgtatcctactttggtaacatgacttttttttttctaccgcttttcagctgagttgtggagtaggcagaactttattatctgacctgggaagctaaccactatgtgatactgttttctgaggaaaatatgttagattccacatggtaacttgacaaacaaacttgaaacatggctgtttgaaagctgagatggtttgtgagaaacattgtgaggcagtgtggcgtgattaattgtcagataacaccagtaagtacctttgagtttaggggaagaagtgattagtggctagagaggtctgagaaggttccactgaggcaatgaaactagctagttcttaaaagtagggtggcatatagaagagaaaacagagtttctaggcatgggagaagggcaaatatgtgattctcagctgaggctgtatcttttaaaatgttttgaaaatacctttgtacagaaagcaacactggccacacctaagaaagcgatgcttccmctccccctccttgccctcacttctctttcccctctcacacagtccctttctctcaaagccattccccatgtctccacctcaatggcctgtggtagtttagagcaggggtccccaacccctgggccatggaccactaccgtggcctgttaggaacctggcccacagccagaggtaagtgacaggcgagctctgcctcctttgatgtaagcagtggcattagattctcataggagcacaaaccctactgtgaactgcacatgtgagggatctaggttgcatgctccttatgagaatctaaatataaatgtgatgcacttgattcatccagaaaccatcccctccatccccatccatggaaaaattgtctttcatgaaaccagtccctggtgccagaaaggttagggaccactggcttacaggagaaatgaatggttgagatatcatggatgggagtagcctgcacttgtaaatagtgtagaggcagaaaaaaaggttgggaaaaccttgaactagatagagatcaggagaagccagcattgtttatgttactcttctgcttaaaggccaattttagatatttccttggggattttagttatttcctgtgcctttgcaggttctaaaatgattcttttcagacttagagtcaaagtagctaaagaatattaaattctggctggttgcagtggctcacgcctgtaatcccagcactacgggaggccgaggtgggcagatcacgaggtcaagagatcgagaccatctggcaaacatggtgaaaccctgtctctactaaaaatacaaaaaattagctggatgtgctggtacgtgcctgtagtcccagctacttgggaggctgaggcaggaggattgcttgaatccgagaggcagaggttgtagtgagctgagattccatgccactgcactccagcctggcgacagagtgagattctgtctcaaaaaaaaaaagaaaaagaaaaacatatatatatattaaattctagccaggagtggtggctcacgcctgtaatcccagcactttgggaggccgagtgggtggatcacttgaggtcaggagtttgagaccagcctggccaacatggtgaaaccccgtctctactaaaaatacaaaaattagccaggcgtggtggcgggcacctgtaatcccagctactcgggaggctgaggcaggagaatcgcttgaacccaggagacagaggttgcaataagtcgagactgtgccactgtactccagcctgggtgacagagcaagactctgtctcagaaaaaaaaaaaaaaaagaatattaaattccattactatctatttactggttcagtgattgtgagctgaggtgatattaaaatttctaatcttcccttgtgtttgtctttctctggggccagttttatgtacatagtcacttgtgcatataattcctagctgattcagtaaatatgtacaactgaagactgaaccctcagaaactgacatgaacctgcctttaataacagtctaagacactgataacagtctaagacatctgcaatcttgagggccagagacaccaaagatccaggtgtaactcaagaaacatctttatcctgagatctagagatgtttagaaaacctaactggtagataattctgccagtagactcaaccatgtcaggccttggatcctgcagatgatgcgtgggcacttgaagagagcagggaaacctcacctccaccttcctcattcactgccctggataggaagggagggagagtggttgccaaggagaaagtatcagaacatagtgggggaagagataaaggagattagctttctcaaacagtgccccaccaagattcccgtttccccccgccactccagaagagcattttctcaccccatgtaagaaccacatattttttttctttagtgatgtgatgaatgagaagttttatgtcatgatagggtcaaccaactccatggatggtaaggaattgttaagaccatgacctatgaaaagaaaacttaaattctgcttttgcaaagtagttaagaaaggtcgtatgaaggtaggcccttcaagctacatttaaacgtcgtttctaatgagttcatctttcgaatgcttatttcattttgtcaataaaccatatataaaattaggaatggcaaccaagggtaagatacgaactcaagcatgctgataaggggggcctaatgtagaaatttggcggacacaaaaagcccttccaacttaaggtttgatttttgagtcttaaaaaatgaagccagtgtgaaagggcctcttactggcatcacacagaaatcctcatcatccaagagccctcttccttgaccccaaagtctttgttttattcaggactcatcaaaaccatagggcctaaataaaaatattttgtaaacaaagttatggacagcccagttttctaattgaaagtcattatgatttctgtgctgtggtgtaattacctaaaaaaatgttatttgatgattaagattctggagtgaattgtgttctttgggctcctgcaccgttcctccatcagggacttggtttcagcggtgtgcagctgctggagttgatttacagtgctgcggctgtggctggtcataaataaatcctcttatatagttgttatgaacacctgttagatcatctgtcagcaaagcgctgttcacatttatcatggtgcgggagttattttacctcaatccatttccaaccgactcggcctccatcgctggattactattaccacaccataatcgcttgctcccactccatgttacaacttgcagataaaagatttcactacttg

SEQ ID NO: 12203 - DNA, 24313 bp, Homo sapiens
agttcaagaccagcctggccaacatggtgaaaccccgtctctactaaaaatacaaaaatcagctgggcgtgatggcagatgcctgtaatcccagctacttgggaggctgaagcactataattgcttgagcctgggaggtagaggttgcagtgaactgagaccacaccattgcactccagcctgggcaagaagagcgaaactttgtctcaaaaaaaaaaaaaaaaaaaaaaaaaaattggcggggcatggtggtgcacacctgtagtcccaactagcaactcctcaggaggctgagatgggaggatctcttgagcctgggaggtcgaaatgcagtgagtcatgactgtgccaaggctgggagccatgattgtgccactgcactcccacctgggcaacagaacgtggcccccactcaaaaaaaaaatgcaattgtggacaagcaagggctacattgggtaaggcagcaccagttagagtgttagggagtttaaagagaaatgaccggccaggggctggcaggggagaggggatacagcaggagaggagggggaagtcagtcacagagccagggtaaggaagggcccctggacaggctgtcccagagccacgatcttaaataaaaggcagtggagggccaggcgcagtggctcacgcctataatcccagcactttggaaggccgaggtgggtggatcatgaggtcaggagatcgagaccagcctggacaacatggggaaactagtctctactaaaaatacaaaaattagccaggcatggtggcgcatgactataatcccagctactcgggaggctggggcaggagaatcgcttgaacctgggaggcggaggatgcagtgagccaagatcacacctccgcactccagcctgggcaacagagcaagactccatctcaaaaaaaaaaaaaaaaaaggcggtggagacacccagcactggttccctcctagagaaggggagagagccgagcccaaacacaggctatttttggagttgtgttgtttggagagcaaccaagccagaaatagtgctgttagcaagaccctgccttctccaacccccggctctcccagtgaaatcaccaggaatcagggaggctgggccccacattccagggagcctgtgtaacaggcagtgctctcttccccaccggaagggcttgggagctgagcatttgactgtaaaagggattctgggattccagagggacagagggactgagtcagagagagagagagagagagtggaaatggggggcaacctcctgcagcggaggagaggggacaggagggaaggcttggggaagaaagggtaggcaggaggtcagagagaagggagcaggaagcgggaggctcagagagagaaagggaaagtgaaaaagaaagcggggaagacagaagcaaagaggaagagcagagatcgggccagaaggcgggaggtcagggggcgatgggtggtgggaaggccagtgtccacccagggcccaccagtgggtgggggacagagggacagtcatggaaaatctgagtgtgatctacagtcacgaaccacctgctcagggacagatggagacatctttcccagtagctggaatcagaactttcccctgaaatccacagcccggtaactcactctcttatctctgaccctccggaagccagagatctagctatttcatcagcatggacttttctttctgtgcccgtgtgaccccttacaaaagagctcaagctggaaagagaggattggatcaagaaagagagaacttaggattcaggggaaaaggggaaagtgataaccccttgagtcagattctgagaagagggtttctctgagaggtcggtggggagcagcccgcaggcagctggaccctggtatggaagggctcggctcctaaggcaggtaagagaaggcagggccacgtgcatgaagtagaggcaggggtcatggccaagtctgggttctttttatttatttatttttttgagacaatcttgctctttcgctcaagctggagtgcagtggtgcaatctcagctctctgcaacctccacctcttgggttcaagagattctcccacctcaggctcctgagtagctgggactacaggtacgtgccgccatgcctggctaatttctgtacttttttttttttagtagagacggggtttcactccaagtctgggttctagagtagctaggcagccccagctcatcagagtcaatggagaaatcggaaacttcacatggacccgataacacaggttttgcctcagtttctaatacacatcttccctatgcctacaagtttccaccgatttgggaaaagacctcttagtaagtcagccacttctgagtccaaagtaaaacgctccccaccctccaccccaatcaggactagagctgctccccagctctcccgtgcccaaggatggaatgtcctttttgctctttgctttgtcctttgagacagggtctctctttgtcacccaggctggagtgcagtgttgcaatcatagctcactccagccttgagctcctaggctcaagcgatcctcctacctcagcttcccatgtagctgggaccataggcacacgccaccacactgggctaattttttttttttttttggtagagatgggatctcactgtgttgcccaggctggctcaaattcctgggctcaagtgatcttcctgcctcagcctccccaaagactgggattacaggtgtgagccaccacacccagcaggggtgtctattttggattggcatcaggatcatccacccaatctatgagtggggactaaattggtgactgctcctgcagagctctggctgtccacagaaaacagcagagacctggcaaggtatgggacaatggctcctggtatgacaggcagaggaagggatggaggctaagctgcagcctggagaggctggcgtcagacacctgaggaggccacatctagctatgtctagacccattgaactttcaagtcttcgaggcttggtactgcctgatccctgttcccctctgatccttaaggtcagagagcaaagccttgcggggtactttttttttttttttttttgagacagattcttgctctgtcacccaggctggagtgcaatagcatgatctcggctcactgcaacctccacctcccaggttcaagcgattctcctgcctcagcctcccaagcagctaggattacaggcacgcaccaccatgcctagctgatttttatatttttagtagagatggggtttcatcatattggccgggctggtcttgaactcctggcctcaagtgatccacctgccttggcctcccgaagtgctaggattacaggtgtgagccaccatgccctgtcttggggtacttttgaggacaagagttaagttcgggactgggcatgttggcttatacactttgggaggcaaaggtgagaggattgttccagcccaggaatttgagaccagcctggtcaacatagcaagactctgtctctataagaaaaaataataattagctgggcgtggtggtgcttgcctgtagtccccgatacttgcttgagcccaggagttcaagtctgcagtgagctatgatcacatgactgcactccagccttggtgacagagtgagaccctgtctccaaaaaaaaaaaaaaaaagagatgggtttggggctggacttgtcttcttccaagaggtcagggcagttgcttcttcctcaccgctaaccacactctcagggactccaaaccacaactaagaaaaggaaaaagacataaacaagaggcagtttcacaggaagagttctcctaatgtgtctgtgagcctaactttccgactgtggttctcctctctttccctgccagctgtgagaaaacaaagcctaaggcagattaaaaagcaggagggctgctcagtgtggttgcccttggtatctgtttactgaaaaaatycaaaacaaacatccgacgcttccacccactgaaacttcctgtgactctgctatcagctgttgccatggattctcccaactgaaccccaccacatacactaaacccaacagtccgtggaccccaagtatgccatctctccaatacaggaccccctgggcagcaccctggccacccttccatccacaacatccagaccacacggccaagggcacctgaccctgtcaaaaccccaaatccagctgggcgcggtggctcatgcctgtaatcccagcatttgggaggccgaggcagccggatcacgaagtcaggagttcgagaccagcctgaccaacatggtgaaaccccgtctctactaaaatacaaaaattagccgggcgtggtggtgcacacctgtaatcccagctactcgggaggctgaggcaggagaaccacttgaacctgggaggcggagattgcagtgagccaagatagtgctactgcactcagcctgggcaacaaaataagactccgtctcaaaacagaaaaacaaaaaaaacaaaaaacaacaacaacaacaaaatccactagtctagccctacatgctcacccactgctagccagtttccaccctctacagcagaggtacccaacctctgggccaggggcccgtactggtccatagcctgttaggaaccaggctgcataacaggaggtgagtggcaggtgagtgaaatttcatctgtagttacagccactcctcatcactcgcattaccaccagagctccactccctgtcagatcagcggcggcattagattctcataggagctcgaaccctattctaaactgttcatgtgagggatctaggttgcaagctccctatgagaatctaatgcctgatgatctgtcacggtctcccatcacccctagatgggaccatctagttgcaggaaaacaagctcagggctcccactgattctacacgatggtgaattgtggaattatttcattatatatattacaatgtaataataatagaaataaagcacacaataaatgtaatgtgcttgaatcatcccgaaaccatcccaccctggtctgtgaaaaaattgtcttccatgaaaccagtccctggtgccaaaaacgttgaggaccactgctccacagaatctatcggtcactcttcctcccctcacccccttgccctaaaagcacaccctgcaaacctgccatgaattgacactctgtttctatcccttttccccttgtgtctgtgtctggaggaagaggataaaggacaagctgccccaagtcctagcgggcagctcgargaagtgaaacttacacgttggtctcctgtttccttaccaagcttttaccatggtaacccctggtcccgttcagccaccaccaccccacccagcacacctccaacctcagccagacaaggttgttgacacaagagagccctcaggggcacagagagagtctggacacgtgggggagtcagccgtgtatcatcggaggcggccgggcacatggcagggatgagggaaagaccaagagtcctctgttgggcccaagtcctagacagacaaaacctagacaatcacgtggctggctgcatgccctgtggctgttgggctgggcccaggaggagggaggggcrctctttcctggaggtggtccagagcaccgggtggacagccctgggggaaaacttccacgttttgatggaggttatctttgataactccacagtgacctggttcgccaaaggaaaagcaggcaacgtgagctgttttttttttctccaagctgaacactaggggtcctaggctttttgggtcacccggcatggcagacagtcaacctggcaggacatccgggagagacagacacaggcagagggcagaaaggtcaagggaggttctcaggccaaggctattggggtttgctcaattgttcctgaatgctcttacacacgtacacacacagagcagcacacacacacacacacacatgcctcagcaagtcccagagagggaggtgtcgagggggacccgctggctgttcagacrgactcccagagccagtgagtgggtggggctggaacatgagttcatctatttcctgcccacatctggtataaaaggaggcagtggcycacagaggagcacagctgtgtttggctgcagggccaagagcgctgtcaagaagacccacacgcccccctccagcagctgaattcytgcagctcagcagccgccgccagagcaggacgaaccgccaatcgcaaggcacctctgagaacttcaggtaggagaaaakcaaactccctccaacctcttacttcgggcttaaggcagagaactcgcctccccagaatctcctccctccatgatcccccrctattcctctattttcttttcctcggacctgcagccttgggtcgaccctgccctaggggtgactgcaggagagcagggaggatggtcaggcgtcaccaacaaccccatcacccagtaacaagaacyttgactctctcagtccctctgcatcaagacacttacccatttcccacctcatgcctgctaacttgaatgaaacaatcgctgggaaagcattaagagaattaaggctgggcactgtggctcatgcctgtaatcccagcactttgtgaggctgaggcaggcagayawcttgagcccaggagtttgagaccagcctgggcaacatggcaaaaccctgctctcccaaaaaaatacaaaaattagctgggcgtgctggtgtgcctgtattcccagctacttgggaggctgaggtgggaggattgcttcagctggggaggcrgaggctgcagggagccaagactgagccattgcacccagcctgggtgacagagcaagaccctgtctctaaaaatraatgaaaggaaggaagaaagagagagaaagagagagaggaaagaaggaaggaagtaaagaagaaagaaagaaagaaagaggaaagaggaagaaagaaagaaaagaaagaaaagaaaakaaagcaaatttaaagcttatgcaaatcaaagatgttgtgataattgataattgagtctgggctaaattccccctgggctgcaaaggcagagagtggtaatgacttctcacctgcttttcttctaaggcttttttacgggacacagagggaagggagatggactggattccaagattcccacagggcaagatgggcgaagactccctgccactgcccggggataagtcagtctgagtgagacggagtrggatgggcttagaacctgaacatgtcatggtctcttcctgcaccttgccctagtgttcacttaccacctgcttgcaggaaacaagaagagcagggcccacagctggccagctcccctcccctcccrcctgtcttccagaacgattccttcaccagccctctttccattgctctaggatgcagatgtctccagccctcacctgcctagtcctgggcctgrcccttrtctttggtgaagggtctgctgtgcmccatcccccatcctacgtggcccacctggcctcagacttcggggtgagggtgtttcagcaggtggcgcaggcctccaaggaccgcaacgtggttttctcaccctatggggtggcctcggtgttggccatgctccagctgacaacaggaggagaaacccagcagcagattcaagcagctatgggattcaagattgatggtgagccacgggacaccaggggaggtgggtggcatgcagaacagacctaccagaagccaaggaaaggctggctctggcttagccgagccaagccccatacagctgtgctgcaggggccaccccatcttcttcccactacactccaagtcactggayccttgaatctccaagggtgtctgaccagtagatttacygcttattcaccaccgtgtgatcttaacctcgttwagtttgcccatctacaaaatgaggattatttgctgtcctaaagaattcatgagccgggcgcggtggctcaaacgcctgtaatcccagcactttgggaggccvaggmgggcggatcatgaggtcaggagatyragaccatcctggcyaacacagtgaaactccatctctactaaaaatacaaaaaaaattagccaggcgtggtggcrggcrcctgtagtcccagctactcgggaggctgaggcaggagaatggcatgaacccaggmggcagagcttgcagtgagctgagatcgtgccactgcactccagcctgggcgacagagagagactccgtctcaaaaaaaaaaaataaaagaattcatggaattacacttgtgaaatacttagcatagccatcactataggaaaaaaatctaaggccaggcacagtgcctcatgcctgtaatctcagcacttttggagtttgaggcaggaggatcacccaaggctaggagttcaaggccagcctgggcaatacggtgaaaccccgtctctaataaaaatataaaaattagtctgatgaggtggtgcacctgtaatcccagctactcaggaagctgagacacaagaatcactttaacccgggaggtggaggtggcagtgagctgagatcacaccattgcactccagcctgggtgacagagtgagacctgtcaaaaaaaaaaaaagaaagagagagagagagagaagagagagaaagaaagaagaagaaagaaagaaagagagagagagaaagaaagaaagaaasaaagaaacaaagaaacaaagaaagaaaggaaaagaaaaaaaaaactaaggccaggcaaggtggcttatgactgtaatttcagcactttggaagattgaggcaggaggatcacttgaggccagaagttcgagacaagactgagcaacagggagacccctgcctctacaaaaaaatttacaaattagccagatgtggtgacacatacctgtagtcccaactactcaggaggctgaggtgggaggatggcttgagcccaggagctggaggctgcagtgagctatgattgtaccactgcacttcagcctgggcaacaaagggaagccctgtctgaaaaaaaaaaaaaaagaaaaagaagaagaaagaaaatatttagggttcatccaggaggcagaggttgcagtaagctgacatcgcgccattgcactccagcctgggagacaagagcaaaactccaactcaaaaaaaaaaaaaaaaaaaaaacaggaagaaaatatttagggttcataayttaagaacagagaaaaatattctagcccaaagaaagggttgggatctgagacttttgaagaaaggaaggagatacagaaaagagatttcatcctggaatgaaatctccctccagagagccctgggaaagcacggtagcccccatccatcagagtggagccccttgtgggggaagtgggctcggctgggaaccctcaattcagcataagcctcacatgtcctctcctctctgtcccggtgcagacaagggcatggcccccgccctccggcatctgtacaaggagctcayggggccatggaacaaggaygagatcagcaccacagacgcratcttcgtccagcgggatctgaagctggtccagggcttcatgccccacttcttcaggctgttccggagcacggtcaagcaagtggacttttcagaggtggagagagccagattcatcatcaatgactgggtgaagacacacacaaaaggtgagcaggcagggaaaggaaacccatttcctgggcctcaagagaaagggaatttggaaataaatccacatawcccagttgggtgcagtagttcacacctgtaatcccagcccaacactttgggaggtctaggcgagaggaaggcttgaggcctggagtttgagaccagcctggccaacataacaagacctcatctcytcaaaaaatttaaaaaccagccgggcatggtggtgcacacctgtagtcccagctacttgggaggctgaggtgggaggatcacttgagtccagcagttcaaggctgcagtgagctatgtttgcaccaccacactccagcctgrgtcacagaacaagacctcatctctaaaaaacaaacaaaaaccaaatccacatatcctaaaaaatgctccttttcagcattctcttctctatggacaaagggctggatgctttaagaaccaaatcttaggctgggcacggtggctcacgcctctaatcctagcactttgagaggccaaggcgggcagattgcctgagcacaggagttcgagaccagcctggccaacatggtgaaaccctgtytctgtcaaaaatacaaaaaattagccaggtgtgttggcgcrtgcctataatcccagctgctcrggaggatgaggttcaargaatcacttgaacccgggaggcagaggctgcagtgagctgagatcatgccactgcactccagcctgggtgacagagcaagactttgtctccaaaaaaaggaactagacrggttcatttaaacccctgactgcagccctttgacatacatccarttgaggactggggactccgggaaacatctaaaaggcttaaaaactttgtctaacttcagccgggcatggtggctcacacctgtaatcccagcactttgggaggctraggcaggtggatcacaaggtcaggagtttgagacgagcctgaccaacatggtgaaaccccgtctcyactaaaaatacaaaaattagccaggcatggtggcaggcgcctgtaatcccagctattygggaggctgaggcaggagaattgcttgaaccccggagayagaggttgcagcgagccgagatcgcgccactgcactccagcctggcaatagagtgagactccatctcaaaacaacaacaacaacaacaacaacaaaatcgtctaacttcctgatcttcctgatcattgattttcccataggtatgatcagcaacttgcttgggaaaggagccgtggaccagctgacacggctggtgctggtgaatgccctctacttcaacggccagtggaagactcccttccccgactccagcacccaccrccgcctcttccacaaatcagayggcagcactgtctctgtgcccatgatggctcagaccaacaagttcaactatagtaagtccaagagccccttccccacagcccacagcaactgcatctcattcctggggtctcccaaggaatacccaaaatgtcaccctctgagggaggaagaccacagggaatgctcccctttaagggaggagagaccctagaatatactccagctttgacaaagatttcccaagcaggagacatcaggataatgggaacagaagacaggaggtttatcccatgaaggatgaagaagctgaaatccagagattccctcagggccacatttgtccacctgactccagggtctcatcttcgtgtgttgctagtgtgattacctggggatgagaaatcctkctgggggagttgaggttaagaggatgaggactccaggtgctgtggctcacgcctgtaatcccagcactttgggaggccaaggcaggtggatcaggagtttgaggtcaggagtttgagaccagcctggccaacatggtgaaaccctgtctctactaaaaatgcaaaaattagccaggtgtggtggcaggcgcctgtaatcccagctactcgggaggctgaggcaggagaatcacttgagcccgggaggtggaggttgcagtgagccgaacgaaattgagccacttcaccccagcctgggcraaagagtgaaattccattcaaaaaaaaaaaaaaaaaaaaaggatgaggactgggatgaactggtggctgggtgtggggaaaatggaagtgaaggaaggccaaaagagacagagaaggcctggcgcggcgactcacgcctataatcccagcactttgggaggctgagaagggggattgcttgaggccagaagttgaataccagtctgggcagcatagcaagrccctgcctctacaaaaaaaaawttttttttaattagccaggcttgktgacatgcatctgtagtctactcaagaagctgaggtgagsccaggcayggtggctcacgcctgtattcccagcactttgggaggtcaaggcgggtggatgacctgaggtcaggagttcaagaccagcctggccaacatggtgaaaccccatctgtataaaaatacaaaaattagctgggcatgatagcaggtgcctgtaattccagctactcaggaggctgaggtgggagaatctattgaacccgggagggggaggttgcagtgagccgagatcatgccattgcactccagcctgggcgacagagtgagactccttctcaaaacaaacaaacraacaaamaaaatacagaagctgaggcgggaggaacatttgaacyrgattcggaggctgcagtgagctatgattgcaccactgygctccagtctgtgtgacagtgagaccctgtctcttacacacacacacacacacacacacayacaygcacacacacagagagagagaaattagaagatactgaattggcagaagagaagggaaatagaaattaaaatactgaataggggagcagtgaacaggggatacccaaaagccaagagcgagagagagcctggcttccagaaatagtggagaagccaggagaactaggtgaaaacccagtgctgggttgccatcagcragagctggagccatttccaacraaccatcttgtcgtcttcacagctgagttcaccacgcccgatggccattactacgacatcctggaactgccctaccacggggacamcctcagcatgttcattgctgccccttatgaaaaagaggtgcctctctctgccctcaccaacattctgagtgcccagctcatcagccactggaaaggcaacatgaccaggctgccccgcctcctggttctgcccaagtaagccaccccgctatctcccygacctaccaacccctctctcctggctccctaaagtcaccgcccccaggttgaatttcccagatctgtgaygcttgcaggacatgcatgtgtgggaggctgatgggaaactgtggcctgggtttgattatgagtcttgcaatcatccctccccctgtttctgctggagggcagggracagctcttcctgaccacacccccacattgactatccccagaatacccagcaaaagcccccaaaaggagagtcagagaaatgagggaggtgggggcccaatcagtccacatctacttagggtcgccccatcagcacttccatccccaaccctttcaagtcaacatccaaacaaaagaaatcacttccaaggacggagcagctcaaagcgcagcttctagctggggttccaagaaagcagatttttcgaaatccttctgcagaaggaagcaaagagattttttgaaatctttctgcagaaggagaaggctggagctggggaactccagaattatagggaagcctcccaccacgctcatcccaaatttccggatgctataatgccaggcttggggaaagaggagaatttagttggttagctggtgcgtgctctcacttgcatcctctctcttcctcttttttttttttctcctctctctctggctcataaaaatggaggtaattagttgtgccctggtgagaagcagagagtgcacaaaggccccctgcttgagtcctcttcagggttagctctcagaaacacaatctgcagaacagatttttgttccaacatccttgcaggagaatttgcccttagcttcccccaccccagccaggctgaataaaattatgctgaaactactgtcttatttgaggaaagtaattagtcataggtgggagggggtggggagattgcagaagaatgttcatgaatattaggattttcagctctaaggggggactttgtaaacagctttagaagaagaaccaggccggctgggtgtggtggctcatgcctgtaatctcagcatttggggaggccaaggcgggcggatcacttgaggtcaggagtttgagaccagcctggccaacatggtgaaaccctgtctctattaaaaatacaaaaattagccrgcygtggtagcgagcgcctatgatcccagctactccggaggctgaggccagagaatcacatgaacctgsgaggtsgaggctgcagtgagccgagatcacgccactgcactccagcctgggggacagagcaagaatctgtttcaaaaaaaaaaaaagaaaaataggaaggaaggaaggaaaggaaaggaaagaagagagagagaaagaaagagagagragaaagaaagaaagaaagaaagaaagaaagaaagaaagaaagaaagaaagaaagaaaaagaaaggaaagaargaacgaacgaaccaggcctccctctccaaccttcacctccgtccctattctggccacttgattcgggggacacctggtaggggatggggaaaggtgggagctgccagccagaggggaccccggcttgagcagcctcttgctgctatctgcaggttctccctggagactgaagtcgacctcaggaagcccctagagaacctgggaatgaccgacatgttcagacagtttcaggctgacttcacgagtctttcaggtaagaagactttcctttgcattttctcaccccagtggactgcgggggcccctaagaggaaaaaggaacctctccttgagagcggcagctgatctaatcctgtatccacatctgtttcagaccaagagcctctccacgtcgcgcaggcgctgcagaaagtgaagatcgaggtgaacgagagtggcacggtggcctcctcatccacaggtgagtctggctcaggtgaggctccacgggtgtcgcctccatcgcccttcaggataactggtccccagacccggaaaggaccccgcagccctctcggcacagagcagytctgtctgtgctcagccatcacccactccccacctgtttctcagcctggaaaaygggcttgggaccatggaaccctgtttcctcgcctgatggctcctaagttccctgactgtgaaaaggcctcctaaagaaaracccaagttgttcccacagtgggaagtaaacttaagaaacatgcttatcaggctgggcatggtggctcccacctgtaatcccagcgctttgggggaccaaggcaggtggatcacttgaggtcaggaattcgagaccagcctgggcaacatggcaaaaccctatctctactaaaaatacaaaaattaggcaggcgtggtggcatgtgcctgtagtcccagctacttgggaggctgaggcaggagaatcacttgaatccaggaggcagaggttgcagtgagccgagatcacgctgctgcactccagcctgggcaatagagcatgactctgaagaaaagaaagaaagaaagagagagagagagaaaagaaagaaagaaagaaagaaagaaagaaagaaagaaagaaagaaagaaagaaagaaagaaagagaaagaaagagaagaaaagaaaagaaagagcttatcaataagcccttaaaggatttagataaatgtgtgtaagggaagagctgatccattgctaccaagctcctggaggaaaccaggtctcagaggatgtccctaaacttttaaggttcatattcaggaaaacaaacaacttccagctgggcttagtggctcacwcctgtaatcccagcactttgggaggccgaggcaggaggatcgcttgagcccaggaatttgagaccagcctgggcaatataatgagactgtgtctctacaaaaattagaaaaaaattagccaggcatggtggcatgcacctgtagccccagttacttgggagactgaggtgggaggatcacttgagcccatgagttcaaggctgcagtgagccatgaaggtgccactgcactcccrcctgggcgacagagggagaccctgtctctaagaaaaacggcgggggtgggggtggtgccagtgccagcatccctctgttctaagacattgtcccttctcttgcagctgtcatagtctcagcccgcatggcccccgaggagatcatcatggacagacccttcctctttgtggtccggcacaaccccacaggtgagcctggaacccatcaygttccacatcctcccacccattctttctctcaggaactagtcccgacagatgcagacatccctctatccctgagagggctctgggcagggaacccataaccctaccctgcttcctgtcccaagaggaggctaccttctatcacccacagacagtgccgggtccccgctctgtgactcaggcagctgcgactccagacagctcactcatctgcctagatctcagtccttccacccacatccagcctgatgagctgtcccactccttctgcttctcaacccccatggttcttccaccctcaggaacagtccttttcatgggccaagtgatggaaccctgaccctggggaaagacgccttcatctgggacaaaactggagatgcatcgggaaagaagaaactccgaagaaaagaattttagtgttaatgactctttctgaaggaagagaagacatttgcctttygttaaaagatggtaaaccagatctgtctccaagaccttggcctytccttggaggacctttaggtcaaactccctagtctccacctgagaccctgggagagaagtttgaagcacaactcccttaaggtctccaaaccagacggtgacgcctgcgggaccatctggggcacctgcttccacccrtctctctgcccactcgggtctgcagacctggttcccactgaggccctttgcaggayggaactacggggcttacaggagcttttgtgtgcctggtagaaactatttctgttccagtcacattgccatcactcttgtactgcctgccaccgcggaggaggctggtgacaggccaaaggccagtggaagaaacaccctttcatctcagagtccactgtggcactggccacccctccccagtacaggggtgctgcaggtggcagagtgaatgtcccccatcatgtggcccaactctcctggcctggccatctccctccccagaaacagtgtgcatgggttattttggagtgtaggtgacttgtttactcattgaagcagatttytgctyccttttwtttttataggaatagaggaagaaakgtcagatgcgtgcccagctcttmaccccccaatctcttggtggggaggggtgtacctaaatatttatcatatccttgcccttgagtgcttgttagagagaaagagaacyacyaaggaaaataatattatttaaactcgctcctagtgtttctttgtggtctgtgtcaccrtatctcaggaagtccagccacttgactggcacacacccctccggacatccagcgtgacggagcccacactgccaccttgtggccgcctgagaccctcgcgccccccgcgccccccgcgcccctctttttccccttgatggaaattgaccatacaatttcatcctccttcaggggatcaaaaggacggagtggggggacagagactcagatgaggacagagtggtttccaatgtgttcaatagatttaggagcagaaatgcaaggggctgcatgacctaccaggacagaactttccccaattayagggtgactcacagccgcattggtgactcacttcaatgtgtcawttccggctgctgtgtgtgagcagtggacacgtgaggggggggtgggtgagagagacaggcagctcggattcaactaccttagataatatttctgaaaacctaccagccagagggtagggcacaaagayggatgtaatgcactttgggaggccaaggcgggaggattgcttgagcccaggagttcaagaccagcctgggcaacataccaagacccccgtytctttaaaaatatatatattttaaatatacttaaatatatatttctaatatctttaaatatatatatatattttaaagaccaatttatgggagaattgcacacagatgtgaaatgaatgtaatctaatagaagcctaatcagcccaccatgttctccactgaaaaatcctctttctttggggtttttctttctttcttttttgattttgcactggacggtgacgtcagccatgtacaggatccacaggggtggtgtcaaatgctattgaaattgtgttgaattgtatrctttttcacttttgataaataaacatgtaaaaatgtttcaaaaaaataataaaataaataaatacgaagaatatgtcaggacagtcactgccttcaccttctccatttcacaccggtggtacaagaaatcagaagcctaggccaggtgtggtggttcatgcctgtaatcccagcactttgggaagccgaggtgggtggatcacctaaggtcaggagtttgagaccagcctggacaacatggtgaaaccccgtctctactaaaaatacaaaaattagccgggcgtggtggctggcgcctgtaatcccagctactcgggaggctgaggcaggagaatcacttgaagccaggaggcagaggttgcagtgagctgagattgcaccactgaactccaggctgggtggcagagcgagactccctctcaaaaaacaacaactacaaagacaacaacaaacccagaatcaaaatcctgttggtccatagacctcatgggtggaagagaccttcctacatccaggttggcccaacatgggggagtccatgaaatggtcacctcagctctgccacaagccccaaggataagttgattctgcccctgggaatcatcctcaaaaaggaaaaaaatgttcccctgccataaactttccacttatgcagatgggcctgctcgtaagtcactgtcactgtgggttcccaactctgttcatgacacttccttccagcaccaaatgcttcccacccctctactcccactccccattcttcaaacccagctcaagttccagttcctccacctaggacttcccatggatccagccaatatcactctcaggtccggcgcagtggcccacgcctgtaatctcagcactttgggaggccggggcaggaagattgcttgaggccaggagtttcagaccagcctggacaacatagtgagactcttcctctaagaaaagaaagagagaaagagagagagaaagacagaggaaagagagagaaaaataaagaaagagaaagagagaaagaaagaaagaaaaagaaaaagaaagaaagaacgaaagaaagaacgaaagaaagaaagaaagaaagaaagaaagaaagaaagaaagaaagaaagaaagaaagaaaagaaaggaaggaaggaaggaaggaaaggagggagggagggagggaaggaaggaaggaaggaaggaaggggatcaaaacatcatcactctcaactcgacactgactgagttttcttctccctggtctgtaacagtgcttggattctcgagtgttctttagctttgtgtgtgtgtgtcttaccctccccaagcccatcaaggtatcaggtttcttgaaaacaaggctctcttgttatatatactctagcatcttcttgaaaatggcttcctgaaaagtcttttattatctttctccagcatctcgaaggcttttggcagagggcacacttccctccattagtttctgttcaaatattcaaaaataattttttaaactgaaaaaagaccaataaccatctgttgaacttgtatactgtctaactccagaaccctgaagataggattcagagatgcagccccctgaacacccagctcatttctattgctttttaaacaattttttgtagagacggggttgcaccatgttttgaacttttgggctcaaacaatcctcctgcctcggcctcccaaattgctgggattacagttgtgagccaccatgcccagcttggctcaggtgtacctttcaacctccttataccctgaaagtatgactaattccaggccccaggctagtggctgaaaagttacctgtctctaacagatttgcttggaaagctaaacagcctctttttgcacaaaatgcttcaaaaagcagaacaaattagccctaactctgcagtatacagttcaaaaactgctcatccatgctgagatggctctagaggaaaaagagttcttcaaaaagccccctyaccacagaggaggcttgttccaggaaatgccccatttaacagactctcagctattgtgaggacaaaaatgatgtagactcacagcacgagacctgcccagccctgtttgactttgcctggccctgtcccttgcctgttctaagtttgtcttcccttctctatttttttttttcttttaagacagggtctcgctttgttgctgaggcaaaagtgcagtggcacaatcttagcttattacagcctccatctcctgggcccaaagccatcctcgcacctcagcctcccgagtagctgggaccacaggtgtgcgccgccaagccctgctaatatttgcattttttggagagatggtgtctcactatattgcccaggctggtctcgaattcctaggctcaagcaatccacctgtctcggcctcccaaagtactgtgatcacaaagtgctgggccaccatgcctggcccgctgttctttagggatgaaaaattaacaagatctgcctccagctaccgttattgtacatttcttgtaaacctcaaacagtggaattatttatctgctcatctgtgggcaaagagtatgaatgttgtaaatcccttaatggtaaaaatattcagtcaaaagcaaatttgtcaaggagacaccatctttttttgaaatcatttttttaggtggtttctcaagtaagctttgttgaaataatagtagcaagcggctgggcgtggtggctcaggcctgtaatcccagcactttaggaggccaaggtgggcggatcacctgaggtcaggagtttgagaccagcctggccaacaaggtgaaaccctgtctctactaaaaatacaaaaattaggccgggtgtggtggctcacacctgtaatcccagcactttgggaggccaaggcgggtggatcacgaggtcaggagttcaagaccagcctggccaggttggtgaaaccccgtctccactaaaaacacacaaaaaattaacgaggcgcagtggcgggcgcctgtagtcccagctactcaggaggctgaggcaggagaatggcgtgaaaccaggaggcagagcttgcaacgagccgagatcacgccactggactccagcctgggcaacagagtgagactccgtctcaaaaaaaaaaaaaaaaaaaaaagtagcaagcactcaggaaaactgagacacagagaggttgagtaacttgatctcattattatcattattttagagagggggtctctgttgtttaggctggagtgcagtggtgcaatcacagctcactgcagccttgaactgctgggctcaaacaatcctgtctcagcctcccaagcagctgggactacaggtgcgcaccactcactacccagctaattcgttttctttcttttttttttttttttaaaaaaaagtctcgctctgtcacccatgctggaatgcaatggcttgatctctctgctcactacaacctccgcctcccgggttcaagagattctcctttctcagcctcctgagtagctgggattacaggcatgtgccaccatgcccggttaatttttgtatttttagtagagatagggttttgccatgttggccaggctggtctcgagcttctgacctcaggtaatccacctgcctcagcctcccaaagtgctgagattacaggtgtgagccactgcacctggccccagctaattttttaattgtattttttgtagacacagggtctcactatgttgtccaagctggtctcgaactcctgggctcagcctcccaaagtgctgggattacaggcgtgagccactgcacccggccccagctaattttttaattttattttttgtagagacagggtctcactatgttgttcaagctggtcttgaactctggggctcagcctcccaaagtgctgggattacaagcatgagctactgtgcccagctgctgctatcatcattattacttaacagccacaggcagttgggcaccctgtgttccctgcctctacaccatattgcctctctctgtggcacgtgtgaacaggaacaggtctcccgaaacaccaagaagggctcagacgtaggcaagacgcggtggcgaatcacttgaggtcagtagtttgagaccagcctggccaacatggtacaatcccatctccattaaaaatacaaaaaaaaaaaaaaaaaaatagctgggcattgtggcgcacaactgtggtcccagctgctcaagaggctgaggcaggagaatcatttgaatccaggagacggaggctgcagtgaactgagatcgcaccactgcactccagcctgggcgatagagcaagacatcaagagagagagaaaaaaggaaagaatgaaagaaagagagaaagaaagaaagaaagaaagaaagaaagaaagaaagaaagaaagaaagaaagaaagaaagaaagaaagggaaaggaagggaaaggaaagggaaaggaaagaaaagaaagaaaatgaagagaaggaagggaaggaagggaaagaagaaagaagggaaagaaataaagaagagaaagaaagagagaaaagaagggctcagacgtggtcgagtataaaggtgctggccaggcagtggctcatgcctgtaattcgagcactttggaaggccgaggcaagtgaatcacctgagtccaggagttcgagaccagcctgggcaacatggcaaaacctcgtctccacaaaaaaaaatacaaaaatgagctgggcgtggtggcgggcgccagtagtcccagctactttggaggctgaggtgggaggattgcctgagccaaggaggtcgaggttgcagtgagccaagatcacgccactacactccagcctggggtgacagagcaagaccccggctcaaaaaaaaaaaaaaaaaagtgctgccctcacgtgccagtcatcagcagcttctgtgttgccaccagccgcggggccagcctgaacacttgcttcctgaaccaggtctttgatctcctcgccaccagaggtcgctttcgctccagtggaaagctcttccctgaagcaaagcagctgtggcttccaccaaaatcttgccaagttggaactccattcaatttaacgagtatttatttaaaagctgacctttagactgggtactgtgaagcattaaaaagaaagtgtcagctattcttaatagcagatatctaatgacaagggacatcaaaaagctggggaaaaaaagctatgctgaccaggtgcagtggctcatgcctgtaatcccaacattttgagaggccaaggtgggaggatcacttgaggcagccaggagtttgggaccagcctggacaacatggcgaaacactcaactaaaaataaaaaaacttagccaggcgtggtggtgcatgccagttactctggaggctgaggccggaggatcacttgagccctgggaagtcgaggctgcagtaagctgtgattgcaccactacattcaagccggggcaacaaagtgagaccctgtcttgaaaaagaaaaaagaaaagaaaaggaagaaaagctatgcaagtcactgcaaaaataatggaaaggaacactgtataaatgatcgctatagtctgaaatagagtgtagactcatcagaggaggggctgtttgaaaccataaaggataggctgggcgcggtggctcacgcctgtaatcccagcactttgggaggccgaggcgggcagatcacgaggtcaggagatcgaaaccatcctggctaacacggtgaaaccccgtctctactacaaatacaaaaaattagccgggcgtggtggcgggcgcctgtagtcccagctactcaggaggctgaggcaggaggatggcgtgaacccgggaggcggagcttgcagtgagccgagattgtgccactgctctccaacctgggcgacacagcgagactccttctcaaaaaaaaaaaaaaaaaaaaaaagaaaccataaaggataaatcagatgggtttggggtctatagggagggaatggcagggcattccagaaaacagcatgaacaaaatcacgaaggaaaacgtatagcagggcagatgcaagggacacgtgagaatgaactctcagatctccagctggtttcagc

SEQ ID NO: 12204 - DNA, 22218 bp, Homo sapiens
catatgtaactaacctgcacgttgtgcacatgtaccctaaaacttaaagtataatttaaaaaaattaaataaaaatatatatacattaaaataaaaaatatttttgtacattaaggttttttgtttatttgtttttaagatggagtctcactctgttgcccaggctggcgtgcattggcataatctttgctcattgcaacctcaacctctcgtgttcaggagattctctgcctcagcctcctgagtagctgggactataggtgctcgccaccatgcctggctaatttttgtatttttagtagggacagggtttcaccatgttggccaagctggtctcgaactcctagcctcaagtgatccgcctgcctcagcctcccaaagtgctgggattataggcatgagccaccgcacccagcccctgctttcaacatgatgtgtatgcaatagattagcactctttaagggaagtgtctaacctgatgggcctgaggacaaacacacagaatcctgtacatcccttcatggacgaggcaatcagctgagagagatcatccctccacaggagtgagacccagaagcccagagaaggctatggactgggagaaacctgcagggtccgagggaagacaggtctggtgtatagatcccgagactggaggtcactgtggtactaaagataacaggagtaaatggcagcacatcatgcccccaaactggccaggactagctacactgagtgaggccagcatggcagaagacaaaacaggcaagggattatttcccctgccacactaagtcagctttagttatgaacaaattcgcgaatttttttttttttttagacggagttttgctcttgttgcccaggctggagtgcaatggtgcaatctcagctcactgcaacctctgcctcccagcttcaagcgattctcctgcctcagcctcccaagtagctgggattacaggcatgtgccaccaagcccagctaattttgtagttttagtagagacggggtttcaccatgttggccaggctggtctcaaactcttgacctcaggtgatccacctgcctcagcctcccaaagtgctgggattacaggcatcagccaccgcatccagccttatgtcatctatttcttgacaccaataacagacaactactctagtcagtaattagttgtcaatatatatttttcttacttaaaatgtattatttaaatataaaattagcacatgtaaatttatagttaaaacattcatgaatttgggccaggcgctgtagctcatgcctgtaatcccagcactttgggaggctgaggcaggtggatcacctgaggtcaggagtttcgagaccagcctgaccaatatggtgaaactaaagtacaaaaattagccaggcgtggtgacatgaatctgtaatcccagctactcgggaggctgaggcaggagaatcaccagaactcaggaggcggagattgcagtgagccaagattgggccattgtactccagcctgggcgacagagcgaaactccatctcaaaaataaaataaaaagaaaagaaaagaaatagataacataaaattcttacgattatttgcttgaagtgaataaagaatgttttctgtattactcttctatgaattacagtagtcaataccattcaatctcaactgttatcactattgaaatggcctcaaaaataaactgccctttcaaaaatcaagcagatggaaaaggaaaaatccatattgatttcaaaagtacagctgccctcatctgaaaactacttcatcttaaatttcctaatatgatcatggctggctgcgattcaccacagcttccaacagccgactggagagcgtttttccagaataactagtatgtttgcttcaagacaaattatttgacaaggttaaggaaaagatgtgaaagctagataatccattaagaatctttttttaaaacttcaaggcattttatttatacttcttttttttttttttgagacagtctcgctctgtcgcccaggctagtgtgcagtggtgcaatctcagctcactgcaacctccgcctcccgggttcaagctgttttctgcctcagcttcccaagtagctgggattacaagcacccaccgccatgcccagctaatttttgtatttttagtagagacggggtttcaccatcttggccaggctggtcgtgaactcctgaccttgtgatccacccacctcggcctcccaaagtgctggaattacaggcgtgagccaccatgcctggctatacttcttagcttacttttttgttacgcgtatatattaagaacttttaaaagtccaaattaaagaagcatgcctagacatcattaaaatagctatcaatgcccatgacaatcctgtagctcaaatagtttactttagaatgtcaaaattgattttgtaatagtcaggacaggataaacagtcgctatattaagaccatgtacgtgtccctagacctagttctttccctacgtctgtttttataaatgctggtgataaaccaggtctgattaatatataatcattttgtgtgattatgtaacggctataattctaggttatctttggtcaaccttaagaaaaatggcagtatatgtaatgacttttgcaaatgatcagtgctaatttgcagacttttgtttaaagagggtttaaacaaaataagaaaatttcatgattaccagttgctattaaatgaattgtaactttttttaaaaaaaaagaatgtccaagccaggtgtggtgctcatgcctgtaatcccagcactttgggaagccaagaagggcagatcacttaaggtcaggagttcaagaccagcctggccaacatggtgaaaccccgtctctagtaaaaatacaaaaagttgctggacgtggtggcacacacctgtaatcccagctactcgggagggtgaggcaggagaatcgcttgaacccaggaggcagaggttgcagtgagccaagatcttgacactgcactccagcctgggcaacagagcgcaactccatctcagaaaaaaaaaatggtatatccagattcacattttttttcaaactctgcatttttctttctttcttttattttttaatgtttttgagacaaagcctcactctgtcacacaggctagagtgcagtgccacaatctcagctcatttctcagctcattgaagcctcgacctcctgggctcaagcaatcttcccacctcagcctcagcaataggtgggaccacaaacatgggccaccacgcccagttaaattttttttttttttttttgagacggagtcttgctctgtcgcccagtctggagtgcagtggtgcgatctcggctcactgcaagctccgcctcccggtttcatgccattctccttcctcagccccccaagtagctggggctacaggcgccccccccaccatgcctggctaattttttttgtatttttagtagagatggggtttcaccgtgttagccaggatggtctggatctcctgaccttggagaccgccttggcctcccaaagtgctgggattacaggcatgagccaccatacccggcataatttttgtattttttatagaggtgggtttttgccatgttgcccaggcttgtcccgaacccctgccctcaagcgatccccctacctcggcctcccaaagtgctcagactacagacgtaagcctccgcacaccttttggactggtgtgccagttcacacatgcctgtgatagcaactgcgttctgaactgcagggatacatttacttgtcagcacctgaaaacttcctcctgagttgagtccaattatcagcttcatgtgccatctgccaatccagatgaaacttggcaaatacaaagctgtccttttccaggtgacactccccaccttctttttcctccaccatttcattaacaactaaaaagctcctgcatgatcagacctgtgtatctatccatcatcaaatcccactcctttttcgagactgggaccctctggaggctgacccagccacgcatttgctagcatgccctgcagacatgaccctcgctgggctctgatcagccttcaggcctccactccaggtgtcactgttctgtctcccctctgctctcacagccttctctgctagatgtctcagccgtgctggccctctctatttcagaagtgaatgtactgagagggtcttagggacttattaataatgctcctggggtcggatgtagtagctcatgcctgtgatcccaatactttgagatcacttgagcccaagcgtttgagaccagcctgggcaacaaggtgaggccccatctctatcaaaaattcaaaaaagtagccaagcatggtggtgcacgcctgtgatcccagctcctcgggagactggggtgggaggatggcttaagctcaggtcaagactgaagtgagacatgaggccaccactgcactccagcctgggcaacagagcaggactctgtctcaaaaaaaacaaaacccactataaccataatactattatcacacttaagaaattcataattccttaatatcatcacatatccaattgatatctgagttcaattatttcatgtcaatgtttttaaactatttcaatcagaatctaaatgaggtcaacacgttgcaattggttggtatgtcttttaaactccttttaatctacaggtttctctttttttgccttgagtttcatttattagagaacccagacattgtcccatatagtctcccagagttggatcttgctagtttcatccccacggcctagtttaacacattcctctgtcctttctattttcttttttttttcttgagagggagtctccgtctgtcccccaggctggagtgcagtggctccgtctcagctcactgcaacctctgcctcccagttcgagcgattcccctgcctcagcctcctgagtagctgggattacaggcgcctgccactacgcccagctaatttttttatatttttagtagagacgggggtttcaccatcctgatcaggctggtctcgaactcccgacctcaggtgatggacccgcctctgcctcacagagtgcaaggattacagacgtgagccaccgcacccggccaaatgtcctttctattttctataaattaacagtcagatctaggggctcgatcagatttgtgtgtgtgtgtgtgccgtgtgcgcgtgcacagcatgttctttgactaggaggcacacctgctttggttatcttctttttgtaatctttaagttgctctttgatgtagacgtggtaactaatgttgaaacaaaattagtttcgtttcaaaacctttctttcaggaagaggttgtggttgattacttctgcgacaggtagatgcaaggttgagcaatcatctcttaacagaagtggtcacactagaataattcaagcacaacaacaaatcccacatcatcaccccctcttaataatggtgttttctttttacttgattagcttttaattgtcacgcactctgcattttttccctgaggtattatttccagaaggcagcgaaatatgactcaatggctaatttgctttttaaaaattaaacaaaacttaggccagctgccatttaagaagggctccggggcctccagactcggtgtgaccgtagccgtgcccggtgctcccctcgcggaggcgttagggcggcaggtttatctcacttgagaccattccttcctttttcatcttctccgggctccggcgcagcaggccgcaggggcgggcactcgcaagaacgcggcatcctggatggtggccgagtcaccgaagctcagaaccccgcgtcccagaatcgctgagagccggccccgcacgggggcctgggagcgccacgcgccctccacccagagaggcaggcgggcgggccggggggggcggggcctcgggactccgcccacgcctccgtctcctccgcgctccgccacagccggccgacaccacaccagccggggagccgccgccgccgccgccacctctgagcagccggctgggagcgagagccgacagctagtctgcaagccaccgctgtcgccatggggagccgcgtctcgcgggaagacttcgagtgggtctacaccgaccagccgcacgccgaccggcgccgggagatcctgggtgagggccagcgggcgccccgttatgtgcgtgcgtggcctcccggcgccggggcgcgctctcccctcgcgggccctgcgcggtcgtgggcgccggaggcccgttagcagcctgctccccgtcgcgtcccgtcgccgctcgggccgccagcccgcgggtcagcgcgggagaggctgggcgaggagcggggggagggacgggtcctcggagccgcgcagctccgacccttccgcgaagaggcgcaggcgcgtccccgagcgcgggagtccccgccaggcccacgccggccggttggggcgaagggtgtccccggctgtgccagccttgagtagatcttttcgctagaagattcctgtgccctcaggtgggcgccctttcctctcaccactccctctcctccggagcgggccgaggtgagcgggtgccggccytggggctgcctgagtgctaggcagggtgtggtcctgggcatccttgggcctaccagcgagccctgctcagggtgtcgggcgccggcgggcagtactggcgggggcggccgcagtcccggccttgggcccgttaagggggccggcgtccctccatatgccccccggggcttctcggacttgatgggccctggtcggttcacgccgcttgtcccattgatcctcacgacaagcctgggacgtaagaacggcggattcgtaggcatttttcatccatctcggttttgtggatgaaaagactgaaaatggaagacttgccaaataaggaaaatatgtggcgtggcctgctggtcccctgacagctaattgagaggccttaactctccagaggattcgggccttctgtgttacatagagaatgctcatctctcccaggctactcctaatatgctagggattgtgtggaatgctttacaaacattacccaatttcatcctcttggtaattctacttggttggtattatcgctgttttaaaaaatgaaataagaacgcgtgactaaatgctagggggattctaatgcgcattcggttgcctcttccagagcacgtgtttgttttttgtttgtttgttttttgagactgcacgtgtttgtttgtttgtttgtttgtttgttttttgagactgagtctcactctgttgctcatgctggagtgcagtggcgcgatctccactcgctgcaacctctgcctcctgggttcaagcgattcttctgtctcagcctcccgagtagctgggattacaggttcccaccactacgcctggctaatgtttgtatcttttttagttagagacggggtttcaccatgttggccaggcttatctcgaactcctgacctcaggtgatccgcccgccttggcctcccgaagttttgggattacaggcgtgaaccaccgtgcccggccagagcacgagctttttaacctctgttgaggaaacggggaccggtcacggtagctcaggcctgtaatcctagcacttcgggaggctgaggcgggaggatcgcttcagcccagaagtttgagaccatcctgagtaacatagtgagagccccccgtttmcacacacacacacacacacacacacacacacacactttttttaaattgaggaaacggtgagttgaacatgagcaattattccttatatatagtatttccttagtttttcttctcaacattcatttgcccagtgaaaagaaaaagcaagtagctgggaccacaagcgcacaccaccatgcctggttgatttttctattttttgtagagatgggtttctccgtgttgcccaggctggtcttgaactcctgggctcaagcaatctgtccgctttggcctcccaaagtgctgggattttaaaggcgtaagccactgcacccggtaactttgggttcttgaattcccttcctcctcttcttcctcctcccctacactccattagagaaagggtcttgctttgttgcccaagctggagtgcggtggttgttcacaggcatgatgatcactgcagcctgggctccagtggtccgcatacctcagcctgccagtagcaatttgtttggcacatcacttacacatacttgatatgagatagcatgatacttttttgagacggagccgcactctgtcacccaggctggagtgcagtggcccagtctcggctcactgcaacctctccctcctgggttcaagcagttctgcctgccccagtctcccgagtacctgggattacagacgcccgccaccatacctggctaagtttttctatttttatttttagtagagacagggttttgccacattggccaggctggtctcagatgatgcgcctgccatggcctcccaaagtcctgggattacaggcgtgagccaccctgccaggccacatatgatatattttatcaatgccttatctacatgttacataggaataatctagcgtcctacctgtgtaaaaaccaactctggaatactgaaactgagctacttaatattckgaaaatcaggacgggtgtggtggcttttttttgcctgtaatccgagcactttgagaagctgaggcaagaagatcgcttgaggccagttcagaacagccccatctgcacgagaaattaaaaaattagctaggcgtgcatgcctgtcccgctactcagaaggctgaggcgagaggaacacttgaactcaggagttcgaggccaacctgggcaacatggcaaaaccccatctctaccaaaaaaaaaaaaatttaattagcgggacatggtggcatgtgcctgtggtcccagctacacagaaggctgaggtgggaggattgcttgagctggggaggtagaggctgcagtgagccgtgattgccccaccgcgttccagcctgggcaacagagtgagactgtctcaagaaaaagagatgaaggaagtgagaaggtgctgattgatacttacctcacactgagccttttttccccccacagacttatcactgaaccatttcactgggaaagtaaaaggaccacatatttcttggccgggcatggtggctcacgcctgtaatcccagcactttaggaggctaaggtgggcggatcatgaggtcaggagatcgagaccatcctggctaacacggtgaaaccccatctctactaaaaatacaaaaaattagccgggcgtggcggcagccacctgtagtcccaactactcaggaggccgaggcaggagaatggcgtgaacccgggaggcagagcttgcagtgagctgagatggtgccactgcactccagcctgggcgacagagtgagcctccgtctcaaaaaaaaaaaaaaaaaaaaaagaaggactacatatttctcaatgaaaatacagtgtacaatgttttccatgcaggtgtaaatactaactcatgttctgtttcagggtgggagatggaataacctgtagaaagaatctttagatttgtttaaattatacacaaatgataagagatctttctgaaagtattgactttttggcgggggagggaaggggcctgatagaacaaccaacaattgtacactttaagtttacatttagagttcacattaaaagttcatttacaaggcatctgtttgaaattcgtgaggatgagctgggctgggtggctcatggctgtaatcccagcccttgggtggctgaggtggacaggtcacctgaggtcaggagttcaagaccagtctggccaacatggtgaaaccccgtctctactaaaaatacaaaaattagctgggtgtggtggtgggcgcctgtaatcccagctactgggaaggctgaggcaggagaattgcttgaacccaggaggcagagggtgcagtgagctgagatctcaccattgcactccagcctgggcaacagagcgagactccgtctcaaaaaaaaaaaagaatraatcacaagaaatggttccttcactgttatactttaacatgatacagctttttaatgttttattttttgagagagagtctcactgtgttgcccaggctggagtgcagtggtgtgatcataaattcttgggctcaagtgatgctcccgcttcagcatcctaagtagctgggactacaggcttgtgccacctcacctggctaattttttttatttttggtagaaatagaatctgtttgcccaggctggtcttgaacactgggcctcaggcagtctttgtgcctcagcctcccaaagtgctggattaatggtgtgagccacagcacctggccaatagctttattgagattataattcaactrtcatgatttattcatttaaagtgtacagttcagtattttttagtatattcacagagttgtgcagctgtcaccaccatataaccttagaacatttcatcatcaccaaaagaaaccctatactcattagcagtccctcatatcccctgcttctacctaggtaaccactaatctactttgtggcctatagatttgcttattctggacatttcatatacatgaaatcataaaatacctgatcttttatgattggcttttacttagcataatataaatttttttttttttttaatttgtagagacagggtcctgttatgttgcccaggctgatcttgaattcctgggctcaagtgatcctcctgccttggcctctcagagtgctggcattataggtgtgagccactgcacccagccattagcataatattttagctgggcacagtggcatgctcctgtagtcccagctactagggtgactgaggcaggaggatcacttgagtccaggagtttgaggctgtagtgagctatgatggcatcactgtacttcagcctgagtgacagaggtagaccctgtctctaaatattttaaggttcattaaaataatatattttcaataaaataatatttcaataaaataatattttaaggttcattcatgttatagcatatgtcagtgtatgattcctttttctggctgaataatattcctttgtatggatataccaggtgtttaacattttgaggaactgctgtacagttttccaaagcagctgcaccattttatattcccactagcaaagtatgagggttctaatttctccacatccttgtttttacctacctttttttattatagtcatcctagtgagtgtgaggtggtatctatggtttcagtttgcactttcctaatgactaacggtgttgagcctctttcatgtgtttcttgactgtttccgtatcttttggagaaaagtgggttcagatcctttgcccattttttaattggattattagttgtaagagttcttcatatattctggatataggtcccttatgagatacatgatttgcaaacataaccccgcttctgtggattgtctttttactttcttgacagtatcatgtgcaacagaaagtttttgatgctgtccgatttctctgttttcttttgtcacttgtacttgttatagtatctaagaaaccacaaaggccatgaagatttatttctatgttttcttatcagagttttataattttcttataaatttgggtctgtgatctgttttgagttcatttttgtgtatggtgtaaggtaggggtctgaatccattcttttgcctgttgataacargtcggtctagcaccatttgttgaaaggactgttctttccctgattatattggtagcctgtagtattggtttttatatactattacaattttgggaaaattcagtacagaattacttggagcatgttgatttgtctgagaaaactgtgaataccagtttcatgattttagggtaactacaaaatgtatattatattctatcctttgtcagatgtgttaatttaatcgttttatataaggtaagaatgctgtacctctgtctaaacacagaaataacatgtattttaatataaagaatgtggaacttctaaactttgaggctaatttttcctgcataaattctcaaattattgtgacatgatatttcataactttactagtagaatccttccctgtgttattaaatatccactaaagtctctagtaaagggaatatgatttacagaacaaatttaatgtgttagtttaattggtgttaatttaattataattggtgaactattacatacttttcttagttcctgtttttttgttttttctttacagcaaagtatccagagataaagtccttgatgaaacctgatcccaatttgatatggattataattatgatggttctcacccagttgggtgcattttacatagtaaaagacttggactggaaatgggtcatatttggggcctatgcgtttggcagttgcattaaccactcaatgactctggctattcatgagattgcccacaatgctgcctttggcaactgcaaagcaatgtggaatcgctggtttggaatgtttgctaatcttcctattgggattccatattcaatttcctttaagaggtatcacatggatcatcatcggtaccttggagctgatggcgtcgatgtagatattcctaccgattttgagggctggttcttctgtaccgctttcagaaagtttatatgggttattcttcagcctctcttttatgcctttcgacctctgttyatcaaccccaaaccaattacgtatctggaagttatcaataccgtggcacaggtcacttttgacattttaatttattactttttgggaattaaatccttagtctacatgttggcagcatctttacttggcctgggtttgcacccaatttctggacattttatagctgagcattacatgttcttaaagggtcatgaaamttactcatattatgggcctctgaatttacttaccttcaatgtgggttatcataatgaacatcatgatttccccarcattcctggaaaaagtcttccactggtaagtaaaggatttgatacatattctaattttgttttttcatttgtttgttttttgagacggtgtctcactcagtcgcccaggctggcgggcagtggcacgatctcggctcactgtaacctccacctcccgggttcaracgattctcatgcctcrgtctcccragtagttgggattacaggcgcatgctaccacgcccagctaatttttktatttttagtagagatggggttttgccatgttggccaggctagtattttgtcagtccaagcagttcattaaaaaaaaaaaaaacaaaaagagcaagaatataaatactgcatcttccagcctacttttacaaagggttcactcttgggtccttaagcttagtggttacacttaggatttatttttaattttattttttaactttatgtttttttagagacagggtcttgccctgtcacctagtctagagtgcagtggtacgatagctcactgcagcctcaactcctgggtcaagcgatcctcccacctcagcctcctgagtaggcaggattataggcacgtgccaccatgcctggctaattttttattttttgtagaggcagggtcttgctgtgttgctcaggctggtctcaaactcctggattcaagtgatcctcctgcctcagcctcccaagtagctaggactacagccacatgctatgacaggctgattttttaaataatttcttttaatcctccaaatggtttgttaaaatttttaacatttttaacatttttatagagctggagtttcctggatgggtgcagtggctcacacctgtaatcccagcactttgggaggcctaggtgagtggatcatctgaggtcaggagttcgagaccagcctggccaacatagtgaaagcctgtctctactaaaaatacaaaaaacttagctgggcatggtggcgggtacctatagtcccagctactcgggaggctgaggcgggagaatcgtttgaactcgggcagtggaggttgcagtgagccgagattgtgccactgcactccagcctgggtgacagagcgaaactccgtctcaaaaaaaaaaaaagagagagatgggtttccctgtgttgcccaggctggtctcaaattcctgggctcaagtgattctcttgccttccagaatgatgctgggattatacatacgaaccactgtgcccatccagatagttttttaacttgagatgaaaagacatttttaacttgagatggcagaattgcacatttgataagtgcttttttttttttttttttttttttgagatggagtctctctctcacccaggctggagtgcagtggcacaatctcggctcactgcaacctccgcctcccgagttcaagcaattctcctatctcagcctcctgagttgctgggactacaggcgcacgccaccatgtctggctaatttttttgtatttttagtagagatggggtttcaccatattggttaggctggtctcgaactcctgacctcaggtgatccacccgcctcggcttcccaaagtcctgggattacaggtatgagccaccgcacccagccaagtgcttaatttctatctaattagcatgccacaatttattagtatttgtaagttcctggatggcagggatcagatgttgcctttatattctatggcgtcatccatgcagtacattctttaataatatcaagttaatctaattgtatgtatttgttgttaattttacaaataagccagatatttagtcccttggaatgtgatgggagagagacctagagggtcgagtgtattcaactgctgctgaaatgtagactgctttttgtttagaattcccacagctgctgctgctgctgcttttttttttttttaagagagaggagggaggcaggtctcatggtttcccttctcagtgtttrtgtcaaccattcatcagtcatctttgaaagaacctagtaacactcatttttcatcttgctgtattttttcccttctaggtgaggaaaatagcagctgaatactatgacaacctccctcactacaattcctggataaaagtactgtatgattttgtgatggatgatacaataagtccctactcaagaatgaagaggcaccaaaaaggagagatggtgctggagtaaatatcattagtgccaaagggattcttctccaaaactttagatgataaaatggartttttgcattattaaacttgagaccagtgatgctcagaagctcccctggcacaatttcagagtaagagctcggtgataccaagaagtgaatctggcttttaaacagtcagcctgactctgtactgctcagtttcactcacaggaaacttgtgacttgtgtattatcgtcattgaggatgtttcactcatgtctgtcattttataagcatatcatttaaaaagcttctaaaaagctatttcgccrggcacggtggctcatgcctataatcccagcactttgggaggccaaggtgggtggatcacctgaggtcaggrgttcgagaccagcctggccaacacggtgaaaccccatctctactaaaaatgcaaaaattagccgggcgtggcggcacatgcctgtaatcccagctacatgggaggctgaggtgggagaattgcttgaacccaggaggcggaggcagaggctgcagtgacccaagattgtgccactgcactccaccctgggcaacagagcaagaccccatctcaaaaataaataaatatatataaaaaataaaaagctatttctagtttatttcactataaagttttgctttattaaaaagctaataaacagctattaatcacagtgtattagtatttgttacatttttgtatttcactatctttatactatataatatggtwacttgggtaccgggggaactttaaaatttcatctcaaaaataatttttaaaaagcctgaggtatgatatagcataaaagattgagatgaaaatatatttccctgtaagctgaattactcatttaaaaattttaacttctatatgggacccgaattagacactgctgaatcctgtacagccttactyataaataaartacttactgaatttccaccattcaaattcatttttcaggtgtgttgactctcacattagaaactgctcaactgataaagactttcatgttatttcactgcagtgggaactggctgtggtctgatggtagatcgttggtctcaagtagctggtagcatgggctgttgttatgtcagcagtcttgcttacctcaaatatgtcacttggatacgtttagtgtaatatggtgaattattttaaaaatacatcagcagctgggtgtggtggttcacacctgtaattccatgcttcggaaagctgaggcaggaggatcgcttgagaccaggagtttgagaccagcctgggcaacatagtgagaccccatctttttttattttttattttttgaaatggagtcttgctctgttgtccaggctggagtgcagtggcgcaatcttgcctcaccacaacctctgcctcctgggttcaagcgactttcctgcctcagcttcctgagtaactgggatcacaggcgtgcacagccatgcccagctaatttttttttttttttttttttttttgtatttttagtagagacaggttttcactatgttggccaggctggtctcaaactcctgatctcaggtgatctgcctgccttggcctcccaaagttctgggattacaggcatgagccgctgtgtctggcccccatcttttcaaaaaataagagtggtgtggtggtgtgcacctgtagtcccagctacttgggaggctgagattgagactacaatgagccatgatcgcactactacgctccagcttgggtgacaaacaccctctaaaaaaaaaaaaaagttggctacattgcagtttcgtaaagaataaaacaacacccagaatgctgagggcggggtgaggagtagaatcctctgtgggactgccaggcctgtctcacagacctcatttcatccccaaaatactttgctttcccttcctgacccccttgcctaggaaaattcctagtatcttctaatctgttactcaaagaacaatcaaagagtgacaatagaaccaagtttacaattcagattttactcagtcactaaagtatctgcaaaacatacccctggatttgatgctagatcatagagatcatgtactcccatcaagtctatagaactctggccaatggcaccgggcgtggtggctgtaataccagtactttgggaggctgaggcaggtggatcacgaggttaggagttcaagactagcctgaccaatatggtgaaaccctgtctctactaaaaaaaatacaaaattatctgggcatggtggcatgtgcctgtagtcctggctactcgggaagctgaggcaggagaatcgcttgaacccaggaggcaaaggttgcgtgagccgagatcacgccctgcactccagtctgggcgacagagcaagacaacgtctccaaaaaaaaaaaaaaggccaggcgcggtgcctcacgcctgtaatcccagcactttgggaggccgaggtgggcggatcacgaggtcaggagatcaagaccatcctggccaatacggtgaaaccccatctctagtaaaaaatacaaaaaattagccaggcgtagtggccggcgcctgtagtcccagctacttgggaggctgaggcaggagaatggcgggaacccaggaggcggagcttgcagtcagccgagatcgagccactgcactccagccggggcgacaaagtgagactacgtctcaaaaaaaaaaaacaacaaccaaaagaactttagccaatggctgcagctgccatgtaaatgctgaaaacctccaaatctatcacttcagacctctcactacctgctggatgcacagagtgggttgtcatccctctccaaaactccagtctccacttacataaccacttctttcctgaatggaagtttcagtcttcgtagcaggcatcccgattattctggctcccatctgccaactcgatccattctttaagagagctaccaatctgggcagtaagaaggctgggccccataacctctaaagaataactccaaacaaaattatccgggcctggtgttgtgtgcatctgtggtcctaagctactcaggaggctgaggtaggagtttcgcttctttttttcttttttttttgagatggagtcctgctctgtcgcccaggctggagtgcagtggctcgatctggctcactgcaagctccgcctcccgcgttcacgccattctcctgcctcagcctcccgagtagctgggactacaggcgaccaccaccacgcccggctaatttgtatttttagtagagacggggtttcaccgtgttagccaggatggtctcaatctcctgacctcgtgatccgcccgccttggcctcccaaagtgctgggattacaggcctgagccaccgcccacggctggagtttcgcttcttgaacccaggaggcggaggttgcagtgaactgaaattgcacgccattacactccagcctcggtgacagagcgagatcccgtctcagacagtcctaagaaatcactcagtagctttgcatgagttctcccttctgttgtaaactcctttctccgtttctcttctggttcaaagtttcacaccttcaaggctcacagcagccttctgttacccacccccagtccccagcaggtcaggtgtcaatttttttgactttgagaaccaatgattatctcttcatggccctaatcataccattgtgtaaataggcactgtttctccataagttgtaactccttaagagcaggacacatcttttatttctgtttcccaaacctagcagggtgtttgacttaaagtaagtgcttgataaatggagagagaccagcagggagagtccttgaacttgagaagctttttctaaaacaaaaacacagccaaagacagggcacttgtataatctttaggtaaaagtattttatgctacaaataatggacattcaatgagaatccttacttttcactgagtcctgtaccaagtgttttacatgaactattgtacttttttgttgttgttcctttttttttttttttttttttgagacagagtcttgctctgtggcccaggctggagtgcagtgttgcaatctcagctcactgcaacctccgcctcccagggtcaagcaatcctcccacatcagcctcccaagaagctgggactgactacaggtgtacaccaccacacctagctaatttttgtattttttgtagagatggggtttcgctatgttgcccaggctggtctcaaactcctgagctcaagtgatccaaccacctcggcctcccaaagtgccgggattacaggtatgaaccacaatttattgtatttaagtctcaacatttatatgctataagcagtactattaatatcttcattttgtagatgacagaaaaggcttagagagattaagtaactggccgaaggtcacacttagtaaactgcagaaactgaacctgaaatgcagactctgtggactccagacccaaaagccttaaccatattccatttggcttacattatgagcctcgtcctgaaacagtaatgagaatgaaaatcacatgttcctattactacatacatactctactgcctcattaaccatttcctgtatgccagcattttggctaggtctctgtttttttccaactcttgaatctaaaattcaaatatgaaacattaatgtttaaatccatgcaaaaaatgcatttatgtattcatttattcattctacagatgcttttggcaggcttgcactaggcagtgaggatacaaagacaaaatgttgccccaaattaaggagctaatgctctagtgctgggaggtacatgttaagaaagaaaggacttaaaacaggagaattaggatgtggctgggactgagtagagggcacacattgctatcgctgatcagggtgagtgctctgccaggctgtacgtgcaaatattgtgctaatccacggcagcctgggaaggtaggtattgtctcccacacttttcacaggaagaaacagggttaggcaagtaactagcctgaggtcacacaacatgggccagggcctgaagctatgtgtgttaaagccaatgctttatgctattcctcttggaagctctttggacaagttcatgtatttcttgttaggaaaatcttctagaagccttagccatttggaaggaagcaagaacagtttgatgacctagggctaggaaggctctgaaaaactgtgcccttgaaatccaagaacattattattattattattattattttgaaacagggtctggctctgtcacccaggctgaagtgcagtggtgggatcatgtctcactgcagccttaaccacctaggttcaagcaatcctcccatttcagcctcgagtagctgggaccgcaggcgtgcaccaccatgcctggctttttttttttttttgagatggagtctgcttctatcacctacgctggagtgcagtggtgtgatctcagctcactgcaacctccacctcccgggttcaagcgattctcctgcctcagccttcccagtagctgggattacagacacctgccactatgcccggctaattttttttttaaatatttttagtagaggtagggtttcaccatgttggtcaggctggtctcgaactcctgaccttatgatccgcctgcctcagcctcccaaagtgctgggattacagatgtgagccactgcacccggcccctatttttattttgtatagggacagagtctcactgtgttccccaggctggtcctaaactccagtggtcctcctgtctcggcctcccaaagtgttgggatcacaggcgttagccactgcctccagccccaggagcatcactaataaatccctaagacctgctcagtacattgacttctgagacagagggccagcatggccgaggcgcctggcagaggaggctctgagagcagaggggagacagagcagtgacacctggagtggaggcctgaaggctgatcagagcccagcgagggtcatgcctgcagggcgtgctagcaaacgcagggctgggacagcctcaggagggtcccagtgttgaaaaaggagtaggatttgatgatggatagatacacaggtctgatcatgcaggagcttttcagttaatgaaacggtggaggaaaaataaggtggggagcgtcacctggaaatgaacagctttgtatttgccaagtttcatctggattggcagatggcacatgaagctgataattggactcaactcaggaggaaggtttcaggtgctgacaagtaaatgcatccctgcagttcagaatgcagttgctatcacaggcatgtatgaactggtacaccagtccaaaagcaggccaggtgtggaggctcatgtctgtagtctcagctattcaggaaactgaggtaggaggattgcttgagcccagaggttcgggacaagcctgggcaaacggcaaaaacccacctctataaaaaatacaaaggccaggcatggtggcccacactttgggaggccaaggcgggcggatcatgaggtcaggaaatggagaccatcctggctaacacggcgaaaacccgtctctactaaaaatacaaaatattagctgggcgtggtggtgggcacctgtagtcccagctactcgggaggctgacgcaggagaatggcgtgaacccaggaggcggagcttgcagtgagccgagatcgcgccactgcactccagcctgggtgacagagcgagactctgtttcaaaaaaaaaaaaaaaaatacaaaaatacaaaaattggccaggcatggtggcttaagcctgtaatctcagaactttgggaggctgaggcgggtggatcacctgaggtcaggagttcgagaccagcctagccgacatggcgaaaccccgtctctactcagaatacaaaaatcaggtaggtgtgatggcaggcacctgtaatcccagctacttgggaggctgaggcaggagaatcacttgaac

SEQ ID NO: 12205 - DNA, 78752 bp, Homo sapiens
  misc_feature (1)...(78752): n = A,T,C or G, or insertion/deletion polymorphism (see Tables 1-2)
tccaccttatctctacatattcaatggtaccatgtagcatattgggctaaatactaacatttgagcttcttttattaaaagtctgtgcacatactctaaaataaaaataattaaatgtacagaaattctatctgaagaaactaaacactgatattttattccaggttgattcatttctaatctaaaagtggtgtttgcttgagggaaggtaaagtaccttgaaataatatagatacaggaaaagatttataaaacatttgctggaggttgatggtttaagttgtaaataaattgcttgattatgtctttattcttgctttatgtagcctaatatatttccttgttaacatgtactttttctgatttgcaaaatatttatggagaaattgcaatgctttcacagattgttgaagtaggttcatcacatatagtgttaagctttgacatttttcaaagggtaaatatgttttgacatttcttgatgaacagctcaaatgatgaaaagcaaccatctttcctttgttgtcaccctatttccaggtttgatttgaatatatatgtatacaaattcttttattggatggcaaattcactagactctcaaaagcttaacctgagtgaaacaaaagaaacaatcaagtgctgttttcagtcttcccacctgtttcagagaggaaaaatccttgaaaggctttcttttcaattttccagctgaacaccctcaataaatagtttatgatacatccagcagatcttaatgtggtaggagtgaaaaagtaattttaaaattacaggaaacactgaaaccagcttcaaaaacctttctctctggtaagccaggattcttcatgtggcccgccctgatggtgcttttgcaccgtaagggatacctattgtgatcttggaattaaataggtcccattttacagaaatccaaatccccctcccttttttttccatctggatacatattctttaaatttgactcatgatctccaagtgtccctgagatgaagataataatccttttgagatcttgccattgatttttttcttttttaacttttttaagtgaataaggaaagcatccaatacaatgttagtgcccttggtaacctaaactttcaaaatagtatacagatttttagctgtaccactcccattaaaacgatggaaaatcatttcagctaattctgcatatgcttggaacattcacccacactgatcttctactaagaattagaaatgctcagctaagctaagtaatcaccaggtagttaatttcaattcatattctggtatggttttcagaatgttaagctacaatgccatatttattccaagaaaatatattacacacaatttaaaatatagtgaatttaaggtggcttctgatgtgaactacaacaatttgtagctcacagctgttagttaatggtgcagatttgcttttagagataaatgtaatcagttaaacatttgactaccacattcatctaactgaatgatatctatatgcaaatgtagggaagtaaaatttagagcacaacagccaatagatcatgttctagtttgcagtaaactgttctcttaaatttcgacaacagatttttcaagtttttgtgttcagttggattatttgacaggagagatccttgaggcatgtttgttttacaaagttcaaaagaattcttttgggtgatctgattccttttttcagaaacctcagttctaatttctctttgtgggttataagaccttttaccttttggaccatataggcttattttttgtttctttaaaccaaatcctgctttagtcaatccacttggcttctcatattggttgtgacataggtttgtgtatgaaaactgtaaatataataacattggcataaacaaaagggtctcctccccatctcagcatatccatgagtctcagctggcatgctatcttaactctgtgaagtcatcaaaagcccagactccctttgtgttgctgatctgccaaacttagggtgttgcatttatccataaaagccaagatggtatatcgccgtttggatatttcaccagagggaagaggtaaagtgagagcacatatcttctctctaagcacatgacctggaagtctcatgtgtcacttctgctctcatcttattggccaaaactgagacatacatctacacagaattacaagggatgctgggaaatgtcatctttattcataataaccatgttcccagtgaagaaaagaaaacagatattggggaatattatctttgctactcttcccatgtcttgctcacaaccagctttcttcccagtcggatattcaaatttatccttcttctctgcttatccactttcttctcttgtttaccattgggataaaatctaactgcttctgtggaactttaagttgtattagcctctttggcttaccctaaagattctaagaacttttacttctaagttctggtctcaggtattttattgtctgtttggcagtatttgtgtggttcatttgacactagttgttttgtgttgccattagatgttaaaaattactttttatgttctcacggtttctatggtgggaattcaataaatgttgacttaacaaaatcagagatttagcaacatatgacatgcttctcaagcctaacttctaaggctggtttttggtagtaggagctgccttatcatcattttttaaagtatttacacacacttttccagagctgaatatttgttgttcaccattctttaaagtgtatgtattaaacccttttcattagtcacttatataccatccttctcatcctccttcctaaatatatatgtacaattcttgatagactttctactattttattgcattagaacaattgggtcaaaagtctgatgtattctacttttgacacattgctaatcttttttttttttctgagacagcatcccactctgtggcccaggctgaagtgcagtggcacagtcccagttcactgcagactcgacctgcctgggctcaggtgacctcccacctcagactcctgagtagctggcacacatcatcatacccagctaatttttgcattttttgtagagacaaggtttcaccatgttgcccaggtcgatctccaactcctgggctcaagtgttctacccaccatggcctcccaaagtgttgggattataggtgtgagccgctgcactcagccacattgctaatctttatactaaactaacaatattctttcaatgccccaaaagcacttctaatgcactatacaagcacttttggcatttgctgcagtatagtcttgattagaaaatgaatcagtcagtggctcagcaggaggtagacagatggctcaaacagtgtaattagaaagtgtttaaaaagctatttgcaaagaagtaggcagggctaaggaaaaccaactagggatgctaagcatgctagggtcagcatatcaggagccacagcacccaggcctaatgggggaacagaggaattggacaccagaaccagctgctagtacctgtagctgggagagggcttcccagtagaagctgtggactttggtagagggacccagctggcccattatgaccctgcagggtgagtcaaggagaagaaagaccctaatttcatctcttgctagtgcctgtcactagtggactccagctgcagtcctgaggttagtgggtgtagtcccgaaaggagtgacccccagagtctaggtcaggccagaaaaggtgaatggtagatctagagggacaaatggaaaatatctagcatagaaaacatatccaattttatatacattttccaaagttgccagttacaatttttttatttttgttttcctagtatttcaaggatgccattgaataaattgtaatgaatttcctttcctcttttgtttgaattatactgtctgcttttacttcagcaccagtcttaaggcttaaaagattcagagtagagtttatattgaagacatttagacagaaatgagtccattccaataatatccttttagacccctaaaataggaacattattcaacgtaacattaaattgagcaaagccattgcatgaagagcataaattagttattgtcagcaagtttgcagtatgaatgaaaatacaggaatgtaatggaggacatctcctttgtctagaatactctataattgtggcatttagttatgtagaggacttcaacaccatatgttttaacaaatactttgggtcataagggtatgtataatggaaggacataattaaagyttaatctgttcagtaaaaaggcaccattaattactctaggcaatttattgggttattaattggttctggaaacatgtcaagatactaatttaaatggaattttttcccctaattgtctagacagcccctcgaccatatactgctccaggaaatatgcagcctccaattcgattacagcctcttcccagtaatcctgcagtagaaactgttccaaaggtaacttcaaggtccagatcaaaaacctcattgctggaaaatgaagctctgtttcccattggggtaaatgttatttttatcaataaatatattttaatttttgagtagattattataggttattacagtggtcaaggtattatattcgattaaaatctacacagtgaaaattatattgtatatgtatgaaacacttactacatacttgtgattaattatgtcttactcaaatgggaaggcctgtaatttgtgtcactgagcaaaaaagtaaagaatagattggtaataatgcatggtgatttctccttagtttacaaggctgattgaaaaacaaaggggaaaacttttctgaaccagatacaacttctatcagaaaagacctagtgttgacttcttccaaattttaaacgcatgaaacctagaaaatgaaactttccaagaataggtttgcatttgcatgccgacttactttcccatcaatgtatgaaattgcttcaagtttgacttttaaaaggttgaatatagaaagaatagaatgtccatctttaaaaaatgctgagtttatcacacataggagcttgattctgctaccctctcaaggttatatctcagataattttcccttattttaatagagcacaggaaggaggtatggtaaccatgaaacatgagttacttaaatagggaggaggaattagtacattcactaattagggaaagtattgttagtttttctaaaatgaagaaaattttgccagcttaagaaaaaacctgcgacatgagtacaattgtcattatgttcaaaggaatgattatgtttcatttaagaaacgcaagatatatgaaattaagatatttttatttttaattgacagataaccttgacactaagaaattaattcagacaagtgattgtgtttcacagtaaaagtataaatacaactctaaaaataataatatattaatctgcttaatatgcttttcagtttctgaagcacttttcataaatcttatttcagttaatttaataatagttttctagaaaccaagagaaattaatccaaaagtggtggtgcttcatccagggaagactgcttacagttaggcaggaacttcttgagtcttatgtcaattagtttgacactttctaggctctggtctccactttgaagacccagagatttcctgttttagccagggtccaggaatagtcacatcttgtgagactgtccaggctaactaaacgaactcaaaacaagctcatttttctctagataataaacgaaaatgggcaactcaatgatattcaggggctatttattcaccaagagatgtcatagtcaaggcttatagaagaagtgcattatcccctagtaggcagacatatatgagaagccaaatcacaatgagaaagttgcctagtgagcatggaatcagaatgaggggagatagtgtaatagaatgttaatcgtataaggcctatatggcctgatacacccatctcatcttgggaatgggctagccaaaggtaccagaaaactcaaaggtctttggctaaaatccyctgtatcctccagcagtaactttgccattaggactagaaatackcaaagtccaatgagtaggatttcctctcccctagatagtacttrgatgggtgctttccatgcttgccaaggtgattatattattttttaagktccataattattaatgctactttgatcaatactttgtttcattagacatgtgaacaccatcaatcaggtattatttaagctctgctggctggggagcaatttttttttcctttaatgtgactcttcaaatctgttctgagccactggatagatttactaattgaatctttacagggccttttcctgtttcaagtttttggggtatgtattattgaaagacaggcagctaatggtagctgtcatgtgctgacaagattgagataaattccacaataatgtcaactagctaaactcacttttcatttagtaaatatttattgagcatttatgatggccttggtactgctttaggcatcaagacagacaaaagtaacttattggagcttatagtgtaatgttcacagacaaagtatactgtgattatgtcttatctgtaatttttttcaatggcattgatgatgaaaatgatttaatataaaatcagacaagaagctcttaaagaagaataatattctgtacattgctgagtatgtagtgagcactcaaaaaactcttattgcttttttaaagagtaaagtatatacatgttgaaagtacttgaaggtacaacagatagaagtaggttgaactttgctaagtagcaggagtgagagtctttaatttaggcaaaagtgatttggccaaaaacagacgggatgagatgcaaatgaggaaaaataatgacttgattgaaaatgaatgatgttagaatgagagtttctcatatattattggtagaagtagaaattagtacaagtatttgtgaaggcaatatggaaatatctatcaccattttaaatgaacatgctcaagcattttaacatgtaggaatttatcctaggaatacacaatatgtgtaaagaaacagattcaagaatattttgtactgttgtatttgcaatagtgaacaattggaagatacctaagtaatagggtattgttttaacttgttatgttatattaaagtacatttaaaaagtattattacttgcactggcatgaaaagatgtccaaaatgctgtcgaactaaaagaagcaaggtaaagaacaacatgttaatttttttgaaaaactggtaaaccatttccaaagaaggcatgtaattgattgatgcctactcagaaataattttgttttaaatccttaaacacaaaaagttctagattcattgattttcttgtcattattttttacttatttttattttttattacaatataaacgtactcctttacagaaaaaatggaaaatataagaaaagaaaaattagagcttgacaaaatgcaatatcaaccattctaacaattataaactccttggtgaatatccacttaaatctctttcggttcatatgcctttttaaatcaaaatatgggctatccatgcccttcatttataagttccttttgctcatttagcaatgagagatatttggagagtactttcctttctacaaaacaatttttcaccaataagcatattaaaatacaaactaagttgatcaaaaattaattagaaatttaaaaataaacataagtacaatataaatttatattgtagaaatagaaataaattggtgcaaaatagataaacctacttaaatattccttaaaatttgggaaactacctcagatacccaaaaattaccaatttgtgaaaattcagtgactcacttatacctgacaaatgtaattattgactatacctttggtgttttttaatgattaaaatagtacatgctgattaaactctaaaacaatatgaaggtatatccctaaaggtagccacacattcaagttttttcagtcattcttatttttaatcagaattcacacgtaaattatttaaaagaaatttatggtcataccatatgaacctttttatttcaggataaatatattcatgttatttttgtttaagcccggtgagatctctcataggaacaaagcaagttttagttaaacatcttcctattgatggacttatatgatgttacattttgtgcaattaacttcttcatatatatgtgtgtgtgtgtgcatgtgtgtatatgtatccttatacacatttatattagtgaacttgtatagttatctgtgtaggatttattcctaccactagaatttctaggtcaaaggatatataccttaaaattttgataaatattttaatttttcctctgtaaatgtaataatttactctaaatagtacatgagttatttatgctaaacagtacatgccagtttgtttacagctttgcaaaccctgcatattctaatacctagatgcctgaaataagaatatgaaaaaagtcctaatttcctattgctaactggactaaagctctgctttaaagcacacttcaaacttcttgattttaaattgtttagttgtattgggtttaatggattgttgaagaaaaaccccaaaagtactataaaagtgtcatcactttatgttagttaaaaaatataccacacaaggttagaatttttaatttgcygcagatactacaaagtgtcatttttcagcagactggagtgttttgagtttrtctattgatatcagttgtgtttgcatgcaatgtcaatcatttaggcttgtctttaaatttgggttacattgagtcactgattctgtttcactggttcttatgcgatgaaatatgattacagggcaagaaggcagtgatgaagttcaggaactccataggcaattcacagagaatgaattcatatcaacttccaaacattaacagttacatgatgcctattcctcctccacttcccccaactgggaaaatcacaagagaaaatagatctgaaacatggagaaggagaagatttcgtccaaccactgctscaaatggcttagaacctcttttgacaaaggtgattatggaacaaatttttcttttattaatttatctcagattacattgcactattagatttctaggtttgcagtaaaagaatttggaggaaattgcatgcaaaacgttgtgtgtaaagaaatacaattttataagtaagcttgaatgtatctgaaaccacaggcttgagtaattcagttgcataatgagtttagcataattaataataaaagatttaacaattcttgtggtcaaatttaatttgaccaatacctatttccaaatcatttatttccttaaatgcacctgttcagtcacatgttgttagaaacatctttacatctaagttgtaaaaattcagaaaccttgatatacctaaaaaacacaatatagtttattttgaacaatttatggcaaattactgtatcatacatagataaattatttcagtaattttttaagagattacagtttgttgtactgatttcctcaaaatactaatagaagaaacaattttaaggcctgttggactttatacacatacaagctagtaagaaggcaaaatatctcttcatttttattatgttaaatatacaaccaatagcaattaaatgaaagttttgtgattggcaaataagctgggtcaacatttcactgactgaccatcaggaagtgaagtgccagcatgcacatagattcttaaaaaccaacttcactttcaggaaccttattcaccccatgtccacatctcactcccagcagctgtccttacctctaaccttctcagaagatggggaccatcttcttcctgcttgcttgaatttccttttttcaactctacttttaccaattctctcccttggttgctgtctttgacaggatgttttctctctcatccccaaggcccacccttgccctgcgtctttgatcagatactctttcactgtcggtggtagctcatactatctgtcattctctctaatttggatttgctggcttcctctaatactcatctctgtctctcaacatatccaggccttagataaaggagcaaattatttcctcacatgctgcaaccttagacttctgttttatcttttcttcattagtaagttctctatagagcagtttactggagcttagtctaacaaccccaggcaactcaacttacaacaatattcttgctcacaattttatggtcagctgtaattctaggacccagagtggaggaacagctcagaatgaaggagtctggaatatgttggcctcattcatgggcaacagaaccacagaatgcttttaaggttccactcaggagtggcacatgtcacttacacttgaatgccatttggcaagcccttgaccaagactgacctcaatggartaggaagtatcagtctctcacagaaaagggcagcgaatatttggaacaataatagaatctaccatatccactaacttaatttttcactctgcatgctggcattggtttctacctggccaatgaacatgctctcaaaagatgtggctcatacttmgcaaaaacaatgacttactcatcattctgaaacacttggggggcaggatttgattttcggatgttaaaatgtattactgggatacattctacctgttcatgctcttttaaaacacaagtttaaatgtctcacaagccataagaatatataaagtcttatctatatgtacaagttcaacaacaataaccaagcaagcaccatgcactcactacaccttcacgatgaactctatcatattatgcaagagccccctttttcctgccccatcattctttaatttttccagagcaagcaycatgctgacttccctgtgaactatgtccctgcttttctttagagttctatcgcttatatgcataaaacttcagaaataagctcaaacctagcattgtaatgaaaggacgctatttccggaagaaaataagctgaatagaatctttgggtcacagcctgggtttggtttttaaacagttttaaaagccccttctggggaagtcagagtggtcaggtcatgagtgtgtcaaggtatctggcgaggtcctagtgtgagccagacactggatgtccagcaggaaaatgaccaggagaatgggcttctgtagctgggcatggaggagggagcagcagcctcttcatcccagggtcgtgacaagtgaagcacaaataagcatctgagccaggttcccctgggattctgcattcaggttagaagcacagcatggtgtcatcaggcatgctggctttgacagaccttatcatgtctgtctcctgagtcacagggcttcagtctgacttactcttctttttttccaagaaaaaaaaaacctttttctctctttttggaatctctattttgggaatgttagaactactagactgatgctctaagattcttagcttttctctcctactttctacctctttgtctttttgttctacttgctgagaggttttttttttcaattttatcttccacacattctactgagttttttctcctgccatgtttcaattctaagaactccttttgtgctcactgaatgctacttttaaaaatgcatcttattcttgatctgtatgattttaactccgtcgtatttgtggagacttgctttgtgagctaatatatgttcagttttgggaaagaataatatcctttaaatgttgaaattaaggttctataaatgtccaatagataaatgttaattatgttactcatatttttacatttgtagactttttatgtgtttagtctcttaattcttgagttataatgaaaatccattctctataattatggatttgtcaatttgtctttgtaattatgccaagttctgtttttaaatgtttagaaagtcttatatgctctcagacttaagattattttaatcttactggtgaggagatcctttttgtcatattactttttgtcttaaaatctattttgtctaataatacttcttattttctttagtgtgtckgtgtgtgtgtgtgtgtgtactgtatatggagagttgacacttgaataacatggggggaaggggtgtcatttctctgcacagtcgaaaatttgtatataaactttgactccccccaaacttaactacttgtaacctactgttgactggaagccttaccaataacataaatattcgattaacacatattttgtatgctatttgtattatatactgtattcttacaaagttagagaaaagaaaatgttattaggaaaactgtaaataagagaaaatacatttatactactgtactgtatttatcaataccataagttatgtcttctctttacgaaatgaatcgtccacccgtgagcaacctcagctagagaattcaattcaaccttttcttgtaatgtcatgactttgcttcctggagtgtttctccaagtgaaactttgttgagtcccatgatgttattcagtgtttacagtattacgctaaacacgatggaaaatatgtaagaactttgagagattactttttactctgatagatgatttactaaagagatgaattgctcgtgtggacatgactagtgtcacatggcattttaagtggatactcacaacacttgagctcactacaatagcaacagaaggtggctatgaaattattacagcagtacagtatgtactacagttaattttatgcagttatgatttaatattgcatctttatatttgtttacatttctcttgattgtaaatggcaccatgcatggtctgttaagagtatgtgtaagttttcataaatcttaactttttataayagatttgtgtgtattttatggtagtaaatgataaaacagactagcatctacatatattttatgcattcataacatacatttttcttatttttcaaaatatttctaggctatacagtttgtcttcaagtttttcaaattgttgtaaatctccaaagaattttccaacatacttattgaaaaaaatctgcatatgtgtggacccatgttgttcaagggtcaaccgtatatatacacatatgtatgtgtgtatatgcatatgtgtatatatattcctttcacttttagtcttttggtgtctttagttttaaactttaggctttaaatatgtttatgtaacataggggtggattgtgtttgattcaatctgagaatctctgttctattaataaatgagtttagtccaagtatatttactttgtttagtgatatatttagacttatttctaccatcttagtttttttttaacttaccatgacatttctttgtagaattttatgctattaattgcctcttccttaaacctctcctctcttgccttccatggcattctgttttcatgcttcctcggggtctcctttcacctcttgtcctactcctttgtgattctttttcatcttcacccataaatctacccatccctataggcttcagcctttacacttgtttttctattcaagatgtagtcatcttcacacatgatttcatgctagatgtctgttggagttgactctagccctgatccttaggcatcgagtaaaattgtctcagtggggagagtcacacattttacattaatacttgagtttcgtttatttagatatagaaaagattcatttaaggggagatggctcttgtgactaatttacacataaattcatctttcattttatgactaccatccagcaaagcatcttttaaaggctcttaaaaaaaaggaaagaaagagtaaaaagcaatgaaatgtggcttgctggtatccaccacctgctcctctatgaatgtgtagaacaacatggtctctggcttctgtgattcatgtctctggggatgatcagtagagccaaatggcaaggtgtggtacgactcacagtccagcaagttgtctctggactctgttgctttgtcctgttttgttctagcaccttcagagctttatactgcatttacagaatccatgaggctagttacattttgcactaaggtttaactcactcacctccagacttttgtgttcccactcaggatcgaggtagtctaaccttaccagtcacctactctatacagcagcctgctgaaaatgtggaaagtttcatatatagcttttataaaagggaaagtacaggcttccaaataagaacctacttaatggttatgtttatctattttagaaaccaataacaaagtttgcttttattttttatacattttttgaaagagagggcaaaaagtttatgacactagtttgagacttttccatgaaagccccctatctacctcctaggtaccaaataagccctgtgcaattacagatgcccaattgataggtcctactgctcctcaaattcaacatggttacaacttaagccagtttctccattcagttgccttatttattttaaagcacaaacttttgtcctgtaatttggcctcaaaatctataatttcttcttccttgtgcattgcacatccagctagttgctaagttctctagatcagagatgtccaatagaaatagaaggcaagccacatatgcaattctaaaattttctaatagtcaatttaaaaagataaagagaaacatgaaataaattttaagactttaatatattttatttaatcaagtatatctaaaatatcatttccacctgtaatcaatatgaaaaattttaattaagtatgatgtattttcttatactatgtctttgatattcaatgaatattttatacttacagcaaatgagctacctttcaaatgcccagcatccaaatgggagaagtggctgctgtcctggatggcacagctctagatgccacctgaacagtggctcatgtacctgataatcctttttcatccttactgctacatctctagttcaggggcttgataactaatcttttaatggaactattgcaatcatctatatacttgtcctgcctctaaatgagaatatagctcagtccagtttttgttgataatggcaaatgatatgctaggtcctgaggttaccaagatgggtaagactaaactgtttctctcagaaagactgcagtctagcaagagagacagatatatatatatacaattaaccatgatatattgtgatgagtactataattgtgatataaataaagcacaatagaaacatagaggaaagaaatattagttttgaccgaggagattagagaatgcctcctagagaaggtgscatttgaaatgggctttgaatgatcagtaggaagttagcagatagaaccagggaactgagattgaaaagcagaaaggggaaaaaggaataagcaaaattcatctcggttttattagattctacataatggtgctaaattaaactttatggaaaaactctcaacatgctcctctactgcttgaaaccttcactagttggccctttcttaatgaaagtaggtatattgttctgcatggctattttaaaatgtgggtttttaaaaattattcaggtatggtgaaacttacagattaagagacaattgccatcaaaaagatagattgttactcacagttcccaagaggaggggacacaccacatgcattggtcagggatccatccagaataatgtttaccaatctgggcattggagtccggctaaattaataggtaaaattaaccatcacaagatcaggtgcagtggctcacatctgtaatcctagtgacttgaaaggctgaggcaagaggatcacttgaggtcaggagtttgataccagactggccaacatacaagacccaatctctaacacctgtaatcccagctatcaaggaggctgaggcaggaggttggcttgggcccaggagtttaaggctgtagtgattgcaccactatgattgcaccactgcactccagcctaggcaacacagcaagaccccatcttcaataatgttaataactcttacaccacaccatgcagagctacacaaggaagcaccagagtaggttaggaagcagagggagtrggggaggaaatgtgagcaggaacccttattatcatttctgtgggaaggaacaggtgagagagatcctgaaaatctagagctctgatgcctctgtaaggattgaggtgtttctgggcacattaggaataagcatgaggtaaagtttacacagtagtaagaaaaatggcccaaaagaaaatgaaaagagtaactatactaaaagcaaactgggaggcaaaaccagagagaaagagaagagaaagggaagaacatgtgtaatgtagtgctgtgaggttttcatacaaccagctgcttcctaagtctttgggatatgaacactcttcctctggcttgtgtcagactttctctctctagggccaccagcatcaacatggggattgccactttttatggtcaggctggttttgtatcaatctttatcaaggaatagtaaccaaaattggtgtttggtttaacaagacactgtgaatcagttttcctgttctggtaactattgagtttctataaatgtagcaagcttcctatatagggtagaaccaacctactgtagctttatcagaatatggaaaggacagaatatggaatgcctaattgttccatgtctgtgtccagttggatcaatgttaattaggtccttactaagcatcagcactggcaagttactgggggcatgaagatcactaggacgtcatccttatctactgagagagagataatacaagggaatagttccaatatcatgtgactcatacagttgtagaggcctggagattaaaagtagttgatagtgtttgggccactacaatcagttccgttgccagacatttaaatgtagcatgagaaattgcaatcactgggagatagtaggtattagaaaatataacacattttatgttgcctggggaatgttggaacttatcccatggataatgggaatcactggagggctttaagcaggagagtcacatgatctgtttaataacaatagatcactctgatttccaacaggagggagattttgagggatatcagactagaagtggggagactaattcgtagggcgaccatacttctcagttttcctggaatagttcaaaattctgcccctttcccccccatttcctaatttttagtaacacktctttcactatgtgtccaagtttggatgataaatttcayggtcaccctacttgatgtccagaattcaccagggcttcgtgaagaagatggagaggagttattrcccaacactatcaacaagaacaggccctttgacactatactgtttgtgtgggcatggataaaagagatttcagtgaaaacttagtatatcaattcaatgctaaatgttgcaaatatataatgactgatgggttaaccactcaatgggcttgctgtttctttatcagctcagttgtacttgcctgagaaatctgaaaagaaatgagaaggaaagtcataagcaacyggtgaaggaaatcagaaagaagagctttagttatgcaggggcatgaggccttgttcctgttcttcaaatggaactgaattttcatggaaggttttgatacttacttgaggatagcagaaagggccgagaaaccttattaaagtttcatttgtctctggtcattatatctttgcaagatggtaagtatagaggcagttcagtcaattgaaagaaactactgtttgtttcctagtgtgtatatttaatcacgagctgtcacttgggccttctgtttgttagaaaaaatttacttggttgcaataattagggaatattttttaaaaagagaatgaaataatgagacccaagagaaaagagattttaccatcagaaataagctttagcagaaagaaatatgaataagaggaaatgaaaaggataaagggctgccttttcctgtatttttctctttaaaagtttctccttccagtttctcatttcatacacaggacacaggtctttccctgactctaatcccactattacctagtatttatatagtgcttatcgcctacaaactcacagggctgcctctaaatccatgctgcttcagaaagtattgcttaacaaaagggggatgcttttatttaatcagtcacttcattaaaggtgctaggtgcagcttggagctggatttgcctgaggtctgctgattgtgcagtgggctgcacacaggcatgtcacagctccacagttgcccaggcaagaggaaacatgggattatgattttccaagtaggagtcagacctggcatcatcccctttgcttcaactgtgattcagggagatgtttctaatctgcaagaaattatccagtttgctgatttactttcatggctcttgatgccctgtaatatgtctcttgattatctctttatttgagagctcttccttccaacaggcaagaaaatttgcttgaatttttaaatcttggactttctccctcatttatactttcagatggttgctagcagaatttcattccatcagatttctttcctctggtttttgcttcagagaatagaatgaaatggaaaagaaatcatctgaagtggaagaggatgagtttagagatggaaatattttagtagttccttcaaaaatgtttgttgcagcgttgttattctttagaaaatgcatgcttctcatgcatctataatttgatggaatcagctcaaattactgccttggatccacttaaagttggtctctgcacattttttgtctagcttaaaattgatttttaggaaagtgaagtagatgagaaggaaaggctggcctgtgtacaattctagaggcctacaattttcttactagccccccytaaagtctttcaaccctctcagcctttcttatttctcttcctcttcctcctttcctttgttctgcttctacttcctcctcttcctcgtagaggtcaggcaaacactgtgctcattcactattatgaaaatatttcaaacaattaattaggagtcaatgcctaggacattgattttctggcatacacatttactgcatattttataaataatttaaattgggcaatgccataggatatcaaataggtttttgtagtaattttagagactttgatcggtagattgttttgatactataaacaatattgatattggattttcaatcaactgaatgcccctgtgaaactggatagtcccaagcccaaattattgatgacaccgatcttcagaatgaccgtagaagaaatcatacatgtgcatctccctctcagatggaataagcccagggaaggatgtgttgtcagtgctcagctgtaaagataaagcagccaattacaaaaactattgctaaatctctaagtcagttcaaactgaaacaaaatgatgttactaatatttatttagttcatttgtttggatttttattggagaaccagctaacagaggcaaaagtttcttcttggtgtcattgaaatttttgctatatataacaaacacactcccacacacctccccacacacttgcacttaaagtaaaaaatgacaaactctatccaaatccccattatttacattaaaagtagaaagccaaaacatatatgttatagttatttaggaggatttattttgcaatgagtttgactttttgtgcatttgtaaattgacactttatttagattttgttggtaggtacttaaaaataaccttctttattcttcatattacaatgtcaggtaagaactctcattagaaagtaattcgttaataagcctcatttttctgtttatttcaggattcaagaaggattcataaaacatccttacatagtaatgcagctattacaatgatctatttggggaaaaatgtgcacctatcttctgataatcctgacttccgggatgaaattaaagtttatcagcagcactgtggtggggaaaacctttgtgtctacaaaggcaaactacttgaaaaaggtacacataaaatgtgaatgttttttaattgcttggagttgatgttatagataagctgctgttgatataatatcaaaatgacttcaatcactttatgaaattatgcatatccagggacttataaaccagctgcctaaaagtaaatctagatttactgctctatgattgaaacygaagcagcaattactctcgcagattgtggaagaaaggatttggagtgatttaacctggtaacagattaattttgggatggagatatatgatcattaaaatgttgcacgaataagctgtccccgaaattccaagttaactatttggcttgccatagtgaattatgccatacattattctaagagaaaaataccagattggaaatttgttctttagaggtatgttgagataaaatcacaaatccaataaactgcagggtgaatcacacctaaataacttggtggagaatttggctaaatagctttttagtacatttttgctttcatttgatcataaatccacgtttgtcagcataggataatgtttatatgcaatgtaggtttttgcaaattatactgtaatgtttttcttcaatatttagttcaagggagcagcagtgaaaagaaatagtgtttacagggttatattgttacttccttgcttaagaaactgggtccaaaaagtaatagcatttttactaattaaaagaaatatacgtatttggataatcttggtaggagttacggggagaattggggacaaacatggaatttttacttttagtctttctgatttccctcattaattgaagacagtgactattacttaaaataaaattcatgtccttaaagagagactataaattcatattgaggaattacatatgtaaaactttccatcacaaaaatggtaaacacttaaatgatagtttcaacttaaagtgaaacacaatatgatgctcaatgatgtcagaaactgtttttttccatttccattttatgtatttggtaggaatgcaatttaccttgtttattttgctgtagcattccagagttcattccttttgttttgtagttgaggaaaatgagatgattccagaggtggagtggctccccaaggtaacactctgaccagagtcgagagcaaatcccgagcccctggctaggtgcaaggcccttgatcagttccaggcagccccagtgagctattctgagtagcatggagtttcctacattttcatgatataagtgggatgaaacccctaatgatagtggcatagatacatacacttatttttttaaagtataactttcagctattgatttaggagaatgctgaaattagctgtaaagtcggaattaatgtgatgaaaactgtcctggactttagatcacactttattcaacaaaatgcatataaaacatctatttgctggaaaatgtgatagatacaaatgaaaaaagaatgaggcttagctaaatgattctctggtagaygatgtacactctgtgatgagagtgaaaaaccaaaggttatgggaaaaagggtgtcacttgagtcagtgttattttgcatacatattgatgctgggatgttttgttacggcattggacagtcttgaataatagcatggaatggggacttaaataattgaatcctgtcgatgcaataattttgtctcagcttgcccttgattgccaggaaagtaattgttcaaaattgaaaagttgggtggctcagagttgacttgtggttcagcaatcttagcaatttagctggactgaaaagaatctgccctttctacaaatcaaagctgtgcatgattcagtaaaatgtgaatagggttttaaaagatttctgttaacaaaagttggagggggagcatttaacattgtgcttggagcagtaaactcattaagatttggctttcgttaattcgtcttgcctttttattagaagtaacaataaaattaattatttagaaaggtggcaagtgcatcctttattcccaggtaattcatgatgtcttgcaatttgattttagacttcaagccacaagctgattgtttattatatacacctatgaagttactgagtatttcctgctacttgtagagtacaatttcttcacaggcatttttatttgccatgtttatcttttcagacaacacaaaccatggcttcctgggttcattttaagtgcaaaataaagtaacaatttttttctggctttcttagaatcccttccttttctgccccattttcctgtatttccataaccggatcctgttgcatctatctgtgcattcctcattatgctgtggcaaatacagctgcttcacttgtcccatacgcactattatttttcctttgcttgtgctatttcctttgtctataatactttctcttttctccttttcaaattcaaatcttacccatcttttaggactcagattaaggctgtgcagctttctcactgacttctactctgttttatcccaatagctttcagtcagcactcaaaactgaagcagttcattgtgctttgacttatattaackgtttttaatttttttcttttttaagagacagtctctctctcacccagactagagtgcagtgccacaatcatagtcactatagccttgaactcctagggtaaagtgatcttcctatctcagccatgcccagctaatttttaaatattttttatagagatagggtcttgctatgttgcccagtctggtctcaaactcctggactccagcaatctccctgccttggcctcacaaagcattgggattacaggctttagccaccacactcagccctgtttcttatttttcttttatcattgacttttttttcagttttaaaaaatagctttattgaggtgtgaattaaatgccataaaatttattcattgtaagcatataattcaatttctttttagaattgtacagagttgtgcagtcattatcacagactaggtgtaggacatctccagcacttcaggaagttcccttgttctctttgacagttggtccttgtctcatagacagccccaggaagacactgatctgctttctgactgtacagattttcttttctggacatttcctataaacacaatcataccatgggtagtcttttgtctttttacactcacttagcgtaatgtttttgagagtcatgcatatttgtagtattagtagtggctctctctttatattgctgagtatattccattacatggatataccatatttttaaaaatttattccccagttagaggacatttgtattgatactagtttgggactatgaacataaaaacacgtttttgggtagatacatgttgctcttgattagattcctaggtgtggttttaattgcttttatttctaggtatatgtcatattttccctttttctaacatgtcttttgattgtttgttgaaaactacatatttaggtgctattttaaagttcctgtgaattctggattctgacttttccctatcaaaggttattgttgtttctggtttttccttcctttttttttttttgtttgttttttgttgttttttttagtaacttaccaaaattaaatctgtgaaatttagccttcatcatcctggtgcagagccagccatgttttgctcagattaaaaaatattatattgctattttttagtctggactcttggggtagtctctgtgtttttatagctcattgctaacgtccccaaaagtatatctgaaaacatcaagaatttattctcttgtgggtttccaggccaaaagtcaaaaatgaaggtattggcagggacacactccctgaaaagccccaagaagcattcttcttaactctgtcaactggccttccttggcctgtggttccgtcacttcaatwtctgcctctgtgttcacatgctattcttgtgtgtctgtgtgtgtcctcacctctttttataaggacatcagccattggattgagggccaaacttaaatccaggatgatctcatcttgatccttcactaattatatctttgaagaccctatgtccaaacaaggtcacattctgaggttctgggtggtcatgaattattggaggacacaattcagccgactacagtgggttcaggggtacattcaaactgtgggcaattttcaagtatgctccaacttttattttccaccaggttctcttgtgtttcttctgtgcctaagggaaagctactggtaggctggagatgtatgaaaaggttgagccctctctgatccatgccacttccagttagccagggatatatagggagcttatcaaatgcttctatgactggtttattgcttctatgttccttttaaatttttagttgtccgctggcctgttgcttgcccttattagaactacagtcatggctggttgtggtggctcatgcctgtaaccccagcactttgggaggccaagacgggcagactgcctaaggtcaggagttcaagaccagcctggccagcaaggcgaaaccccgtctctactaaaaatacaatatatatatgtgtatatatatatagctggccatggtggtgtgtgcctgtaatcccagctactcgggargctgaggcacgagaatagcttgaacccaggaggcagaggttgcagtgagccgagattgcatcactgtactccagcctgggcgacagaacaagaatccttctcaaaaaaacaaaaccaaaaccaaaacaaacaaataaaaaaacccaaactacagtcacaggcccatagaacctctgaccttccctgttagcttgcctttgagattcctacttattactggtcataccacaggcgaaaggtttttctccttgcactctaaatcaagtcaacccccacagacagcaaagcggctggttatttgtggcctggcctaccctattagaactgctgtgataaggcggtagcagatgttggggataagagtagccccggaaaaaatgcatggattcccattacctaaagttcagtaatttttcatgaatatatgcttctcagtttgttttaagcctttaattcttctccagagataaaattttaagaaagagaggatttggtgaccgcaatccagaagactgatatattaattttgcccctcctgtttaatgatatctttttgagtcaggagaacacatttgatatttttcagtatttttgtttatctttagtgcctaaaacagtgctaccaactgtcagtgaacaataaataattaactgtacaaatactataattataatcatatataatgctttctaatattttacattctaaaatatttaagactgtrttgtggatagactagcacattctacacacccccatctctgttttatgggtgaaaattctgaaaggcaacaaagttaaatgactcaccaagatacactcacctgtgccatggaccaaaaccttctaatttctggactacgttctttccactgctccatgaagaaatcatcaagtcaggatggggaggtgtcactgtatttaaaatacaaaaataagtaacaaaggagtaaaggcaaagggtggcagttcttgttctagaactctgaaaaacaatgaaaaaacaaaatggagtaatatctgggcatactctccagctacatgagcatccgatggaagggcagtcacttctaggggttgatttcctgagccctttctcaacatttccttaagtgcactctcttcctgaactgggaacttaggaagttatggagcatgatactgcagcagaatggtttatattacaggaatgtagactcaagcttctataacaaaaacaatcaaacttgctttcaccacctgaggagtccatttatcattaagacaaaaggatttttaaaaatattgtatcctagttttcccagactctaacctttttcagctctctctttcctagtttaattttacatcagaaatactaaggtataaatgactgaattacctttttaataagtctgttctttagaatgagttgcatctagtgtagagtttttttttttttttttagacggagtctcactctcactcccaggctggagttcagtggcgtgatctcggctcgctgcaagctccgcctcccgggttcacgccattctcctgcctcagcctcccgagtagctgggaatacaggtgcccgctaccacgcccggctaatttttttgtatttttagtagagacggggtttcaccgtgttagccaggatggtctctatctcctgaccccgtgatccacccgcctcggcctcccaaagtgctctggaattacaggcgtgagccaccgtgcccggccgagtttttttttttttttttttttagggaaaaaatgtggtacacacagtgtttctaaataactgaaaaaatagattaaaataataattcactcattattttgggggagccttctatgccattgtccagggatttggagaaaaaagatgcatcaacttcagctcttatggatttcacaaacatgtaaagcagctaatgtctagattagagttcttagaaggcagtccctagaccaatagcatcagcatcacctgaaacttgttagaaatgcaaattcttggttcttaccacagacgtactgaatcagaaacagaggtaaaacccagcaatctgtattttaacaagccctctaggtgatgctgatacaccattaaaatttgaaaaccactggtatagctacatcttagtctattgtagtaaatgcaacaataggaaatgcgtacatagtagagaggtgaaaattgttaactttattattggcagatgtggaagggtccagagaggctctatttcttttcttttcttttttctttttaggaagtgacgtaagaaatattcatgagacacaggattttgagtcactctgcagagaataaggtttcccagacttagggtttaggacgtctgtggggatagggtggcaggctttgcaaataacattataaagacttggaatgattaaaaactattaattgtaagcagtggttctaaatttattggtgggacttttgggtggatggggaaaacaaagtgttctcaaatccaaacagaattgagtatagcttggagatgaaataactgcttcattcatgtatgttttagaatatttaaagtcacaactaaaaataaaagcattttaaaatgtattaatgagctcacagtagccttttattattaactgctttatcaatagatagcatagcaagatagaggcatggaatctacagagatgtttggattcaaactctaactccccaactcactgtatgatcttgagtaaattactgaactcttctaagtcttaatttcttgacctagaatctagtaatagaaaaattcccacttcacatgattgaaaaataacaagataataaggcataakgcctgccacagtaagtgctcatgtaaccttaggtattattattttattacaaatcaaagaatttttataaaaacttggagtatttattacaaataaaagtaatcaaatgcaattttatcactaaaaattgtcctcaaattaaaagatgatctagatctagcttgtccaatctgtgagccacaggctgcatgcaactttgaatgtggccctacacaaatttgaaaactttcttcaaacattatgagatttatacaagaacttttttttttgtttttagctcatcagttattgtttgtgttagtgtattttatatgtgacccaagacaattcttcttcttccagtgtggaccagggaagccaaaagattggacacccctgatctagatcataatattgtgtttatctaatagaaaaacatgatttaacagatgttagtccgaagtcagttgctttcactaatgtatttctattttaattccagagacctttcagtttatttccaaaaggcatcatggtttccccttcagtctcacctttttcctgaatgggatgcaggtgaacaggttaagctcctgttgtgaatacaagcatcggaaaggttccaggcttggaggcaaacgaggctactttgggtttgtgtgtgttgagagatcatctccttgctacaagtatggaaacaaatgtcctttggtagagggcaagttttgctacatttttctttgaatgcctttactaatgcatttctcttcacaattattaaggaaattcagtatagatgggcctacaatatctaggttcagggttgtttattgtaacatggcgtgctgaatttgaaattataagatataaatcagacttacagaggtgttatataacgaagataaaagctagtgcattttaaattatttcactttctatctctcctgtcttctcactttaagaactgtttctgaagggaaggagagagatatttttgtttgcttgttgtttttgtttgtgtgtctgtttttcctcattcatcttagtaactggttttagactgagccttaaagtgtgtgccaagcatctgatttacatgactggacattttcggttatgccttttagaggttaggtttgcctgcattactgtctgacccaattttcattatctcccttagtttcaatcttgggcataacaaaatgcatgataaaaggtcagttttgactgttatcagctttcatactgaacattctgtttgaaatcaggagtcttgcttgtgggctttcatattttctaaaagtattggctagatgccaagctagaacacaagagtgaatcaactaaagtatttgtctctgtggaacttattctaatggaggaaaagctaataacgtacctacaaagcaattaatatatgtgagatggtcagtatgatgaacacaaaacagggtaagggagatacatggagtgaagggagacaagagtcatggggagtgtgttattttatgcaggatagttaggaagggcctctctgataagatgtsttttgaacagaaaccagaaaaaaaatttctttcttgaaatagcttttgagatagaggaaaagcatatacagaaggcatgaagcaggcacgtgtttgttgtgtctaaggtagcttggccagcacaaaaggaatagaaccatgaaattggagatggggtcgcagagaccatgaggctaagccatgtagagtcctatggtcattgcaaggactttaacttttatctgagaaggatgggaagcttctaaagcgggttttgagcaatgacttgtcatgatttaatagtaactcttatgggaaaaataaacaagggtgtgtggggaaaatatcagaaactgctttaatccagagaagagataatggtggaatgagttagaagtaattttaaaggtagagcttacagaatttactgatgaattggatgcagggaatgagataaagagcagagccaaagacgattcaaaatttttgtcttgaataactggaaagatgtccagttaacttattgagactgtggaagaagcaggtttttggggtggaatgaagtggttttggtcgaggacacattgagtctgagacatgtatgagataagcaagtagaaatgctgagtaggcagttggatatatgaatctggggtgaggtgagaggtccaggctggagatgcaaatctgagaatggtttgcatatagatgacatgtataagtttgcttaagaattgaacatagagaagatgtctgagtgatgagtgtcactccatttaaaaggtgagggaggtaaacaggaactagcctaagaaggaaaggcagtgaatagaaagagaacctagagagagtagtatcttggaaataaagaaaatggttaaggaataagggcatgattaagggagttgaatgtgtggatatgtgaagtaaaatgaagactgaggattggacattgatttggtactgtgttggttactggtgatcatggcacgagttatagtgcagcagttggggtgtaagctttcttggagtgggtttaaaaaatagttggagaaaaacaaaggctggagactatagagaagtttttaaaagagttttgctataaagaatggtaattaggtggtagccaggaggaagaatgtagtggttcaaggaagcctctttattttttaagatgggagatactataatatgtttatatgctaatacaaacgattgaatactttagagaataagaaacatgaagtatgacataaagggtggaaatttctggagctaaatgattgggtagactggagaagatgagatgtaggactcaattgggggtataagccttaagaagaggaggaacattcttgtatggtaacgggaggaaagaaagaaggcatacaagatagagatgtgagttgctattaatagatgtgctgggaacaactggaagctctctgctgattgtttctattttcttaaacaatacataaatttatcaactgaggataaggctgagagaagaggcattgggtgttttcagagagataagagtgtaaaagaatcatccagagaatggaagactgaatggcctagggcaagatagtatcaatgcccagctgtacttaggggccacctgaactgccttcctattccaactcaaatatgctgtctcctgatttgagagcaggtcatttaacacaattctatttaattcccagaaaagctaataaacatctacaatcagccatgtgcaaatatattgcattctttgggagttgtggtataaatccaagctgtaaattattagccctgagcactttctgtggaagtttaataatcagtaccaaaatctgactgatggcatttactctcctattcaacacccactagcctctgtacaattatttctatgatttcaacacttggtaccctctagattctttcttcaaccttttcaaataataatatcaaaatggttacaatattaaagaataaggcctatgactctcaactaaaatgcacagttcttatagaagaatggttttcaatttttttttgttaacttcataaccatttttccaatgaaatctgtgaatgcccagaatagaacagtgcattgtcattggatgtctccctgttgcaggtcaggtaaaagttgagtcagactggtttaaatggtacagggttaggtgagtaagtgctagagccttgtttgtttgtcctcttcctcacttgagacttttctggttattctagagaccataacactgcagaactccatggagagttgagaactaccccaaaggttattaccttctgtaaccttggctttgttgtcactcccataatgatacttttagttatgttaaacaatgtacactaattcctccaatacattcaaaatgaaattaattttaatttatttaaaaaataccagtcccagaaacatttgtgatgagaaaaaggagggcatggtacaataaaacaacakagaattatatttctaaatgattaggaattacctgtttaaggtcctcagaaaacaagaaaagctgagcagtggtcacttccaaagtgtaaggttccacaactgtactcatctctcaattataggaactgtttgaagaggcgtagtaattttcaattgctagcatgaaacttgggaagaattgcctaaccatgtagaatgcagactgctttgagctttagtaatcataatcaacacctcaaattatattcagaagtcaaataggtagtcartgacgaggagagcacagatgttactcactttgtttgtccaattcccttcagcagatgggcaataaaaagtctgtgcatgcagtagggaggcatcaaagcctttacgcagccacaacataaactaaaagtaacaacatatcagaggctccaaatcaatggatttggtgttgcaattgataagggaagaacagcttgaacagaaggcaatgctagtaatcacattttgtgaagattcatgacacctttactccaaggaaagcaatgtgctaagcacatcatcattatagtcaagaaatatttatcatgcttaatatgggtgagataagtataatctcattatctcattttttacagcctgatagttactttgagtgcaaatccttctagctttattttgtggggagatattgaaaagttaagtgatataactcagttctcatatttgcttgttgggaaaatttattaagatcaattcctttgctatttctacgctgcagatggctgaaatttagtgaaatcttcagtttaagtaattgccattggatttgttcaggttgaggcatttttgagattttacatattatttctattcttctgggactagcaagtcttgactgctttctgatccctttcacctgcccactataaattcagttctctggtagttgtrtcacatgcagagaggggaacgtgagtagttctagagaaagaagactgaagagactgataactaccagaaacatttttcagatcatggattttatccaggtcttgccagaaacttctccagattgtattagtgtctgctgagagagtgtgagtcctttctttggtgataagctcaaagtgtaacatttatgtaactagtcatctctactagttaaatcataactaggaactggaggcctacacctgtaatagactaatatggttgtgcttcagtatgatgtgatggagcctagcagtcttgagctagaatccagctccatcacccacgtactgggtgactttgagctgctagaaccttttaagcctcgattttctcatttgtaaagtggtgatgatagttcttaatttattggtctatgaggtaatgaattccttaagataatggatacagagtacccagaaaagagcttggcacagagagagtgctcaataatcttatcattatcataatcatcatttttattaatgtatatattattatcattggaattcttattttaatatcaacttaagaaatagaaagctrtagaagacaatttattcatattacttttgttataattgatttaaaaagttttaatgtcataatgcattcagattatctgcatggttcaccagatttgacttggaatgacttcataacctctataaattactgccatttttgaggaataagaacttattaccagcaaaaatcaccagaagactgtagtgcagacttcaaaaggccattctaaaagcaataatgacagttctatgaaaataagtgaacaaactcctgagttattcacttaaaagatgcagcaacatttgactgtatatatttctttaaaaaatcaatcatatttatttagagccaatcttgtaagtcttttgttactgttgttgtgttgttaaaatataacttatcagactgaatggcatcttgcttcttctgaccatttttatatcagcttctctatgtttgtaaatctgcatgttctattatcacaaaattctcatttaaggacttgagatatgtctttatgtatgaaaaattatatacccacctatatttctgtatctatgatatgtgttactgttcaggaccaaaaatatacttgaagacacagattttagtttgaaactatagttcttggttgacgagttattttattttgtttattattgtggataacgttattaagaatttgttgtttgtttacaagattttagtatcaaaaaagaatagtttatttttaattagcttttttaattgtttatttttattagtgtgtactgtaatcaaaacatttttgtgtctttttttactggaataagagataagtgctttcaaaagctttgaggttccattgtgctgtctacaagggttaacaaacacttcctgctaatatttttcataggtgcattattgcaatgggccttgacaaaaaaccgtctttgccgaaatctaggaaagaaaagagcactgagaaaggagaggaactgaagaaggctgaggggaaagtgaggaaagagagagagtatgtgataccaaaaagaaatgagatcaaggagaacaaaacctctgtttcagccaaattttcagctcaagaaataaaaacagggctcaaagaagtggtaactgctgtggaggaaatgacaagtaaaggaaaaccaggacaagaagtcttggaagacgaccaggaaaatactttaaaatatggtaatcaacaacacaagtttcttttgttgtagctgtggctgtttcgtttgtctttgaaatgtgatgatcaaaattttcaaaaatacccattaaatgttacccagctgtgttacatgtggkgtgcccctgacctccttcctttgctgttttgtatggagtcctgtgtcacctaccttagaggaaggcagacctagccccagaaaggttaaaggttctggctgcagagatgaggagagagaatgagtayatgtcaatgtgagttagagactctattgacttctgcagagaccattttcaccaaatagaattttacctattttaaaagtttttgaatgtactgtttttyatgaaattgatgaattgctttgacatcaggtaggtacaacctatatgattatatggtgatagagtatgccataactaaaggcagttgactataggcttagggttgtggaacctatctgtctgctttttttcttttgctttcttcttttttctctgttctctccttcctctctcctgccttccactgcttctctgtctccctctctccatacacatacacccacccacccacccacacacacacacagacacacgcgcattcatatatatacatacacacatatatatgcaggcacatctcattttattgtgctcactttattgtgcaagctttgcaaatatagcactttttataaattaaaagtttgtggcaaccctgcaccaaagtctatcagcatcatttttccaacagcatgtgctcacttcatctctgtttcaaattttctcaatatttctaactttttcattattatgatatctgtcatggtgatctgtgatcagtgatctgtgttgttactattgcaattgttttggggtgccatgagctgtaccatgtaagaaagtgaagttaatcaattttctgactgctccactgaccagctgttctccagtctctctccctctgcttggtcttctctgttccctaacccacaacagtattgaaattaggttaattaataaccctacataatacactctaaatgttcaagtgaaaggaagagtctcatgtttttcactttaaataaaaaaaaaacgattaggcttagtgaggaaggcatatcaaaagccaagacaggctaaaagctaggccacttgtgccaagcagttagccaagttgtgaatgcaaaagaaaagttcctgaaggaagttaagagtgctacttcaagtgaacatgtgcatgataaaaaagaaatcgttattgctgatatatagagtattttagcggtctcratagaagatctaactagccacaacattctcataagccaaagcttaagtcagagcaaggccctaattctcttcaattctatgaaggctgagagaggtgaagaaggtgcaggagaaaagtatgaagctagcagaggttggttcgtgagggttaaagaaagaagtcatttccatagcatgaaattgcaaggtgaagtagcaagtgcttatgtaggagctgctgcaattttatccagaagacctagcgaagatcatttataaatgtagctacattaaacagcaggtcttcagtgtagatgaaaaagccttacattggaaaaagatgccatctaggacattcatagctagaaaggagaagtcaacacctgacttcaaagcttcaaaggataggctgactcttcttttatgggttaatgcagctggtgagttcatgatgaagccaatgctcatttagcattcaaaaaatcctagggcccttaagccttatgctaaattttatctgcttctgctctataaatgaaacaaacaaagcctggatgacagcacatctatttacagcatggtttgcagagtattttcagcccactgttgagacctactgctcagggaaaaagatttctttcaacatcttaccactcattgacaatgtacctggtcactcaagaactttgatgaagatgtgcagtgcgataatgttgttttcacgcctgctaacacaacatccattctgttgttatccttatggatcaaggagtaattttagatcttattctttaaggaatatattttgtaaggctatagctgccatatatagtgattcctctgatggatcagggcaaattcaattgggaactttctggaaaggattcacaattctagatgccattaagaacattcatgattcatggaaggaggtaaaaatatcaacatgaacaggagtttgaaagaaggtgattttattcctcacaggtggctttgaggagttcaagcctttggtggaggaagtaattgcagatgtggtagaaatagcaagagaattagaagtggggcctaagatgagattgaatttttgcaatctcattataaaacttgaatagataaggagttgcttcttagggatgaacagagaaagaagtttcctgagatgaaatctactcttgctgaagatgccatgaacattgttgaaatgacaacaaagaatttagaatatgtataaaatgtattagttgataaaggagtggcaggatttgagaggattgagcccaattttaaaagaggttttactgtgtgtaaatgctgttaaacagcattgcatgctacagataaatcttcgtgaaaggaagagtcaatagatgtggcaaactttattgttgtcttattttaagaaatttccatagccaccccagccatcagcaaccaccaccccgatcagtcaggagccactaacatcaagggaatatcctccaccagcaaaaagacgatgaccagttaaggctcagatgattgttagcatcttttatcaataaagtgattttagttaaggtgtatacattgggtttttagatataatgctattgtatattcaacagacagcagcatagtagaaacataattttggatgcactgggaaaccaaaaaatttatatcactatctttattgcaatggcctggaactgaacctgcaatatccctgaggtatacctgtatatcgaatatatatataggtatacattcacagatctaggtrtgcttgtatatacttacatgtgtatataggtatgcctgtatatgcttatacctaaagcagcaataacaacaataatgaaagtgccaagcactgagcaccaaactaggcactgtgcacacactgtctcattttatcctcaccattcaacatgrtaggtattattactacttcaattttacaggctgggaaattgaggctyagatacacaaaaagaaagtagcagaataagaatttgcacccaggtttgtctaattccaaagctcaatctttcaaacactatacaaccttctattctgtacaagttagcctacccactaaatggttgtggatagtgtgtccaaagtatcagaaagggagagctgctttgtgtccctcatactcaagagacaaagcttggatagggggcacaataaccatgggttggggtacctgtggaagggctggcttcgggaaagggacaacttctaggtatcttcttccccacctcatatttttgctgcccaagtgtttcagaaatccaagagaataattacagggctgttatagcactagacttcatgtttgattattactgactaaagtgaatcttttacaaaagatttcacttagagcacttttaccagctcaccattcttcacaatctcttctagtctttgtcttatcttgggatgagaattttaatatatctgcagcaatagtaatcacagaggtatgaacaaataggatgtgttttcatgtgttttaactttgaagcatggtggtttatgaaagtcatgttcaatgaaagcttttcattttctttttttttcttaaaccaacataactagtgctatgagtgatgtactttatactcatgatacctatgataaagcttttcctgaattctttcttctgtgttggctagttaatggactttaaatgtccatttccttttttaaaaatgcagccacagccgcaagggtttagctctctgcataatagtcgctgatgtaaggacagcaagaagtttgaatcaaggtcagcaagagaaggttgtggctagattgatgttgaccccgtgttgactcacgtcctcattagtggggatggtaaacaacaagctaattaaattctctagaagaaggcaaatgggatgggagaacagaagaaattatgtaaaagattttagaaagcatgtcgctggyttattcgtatcaaaaacatgagtagatgacacaaaggtggtgtgctttgagctataatgacagtttggaaggtttgtggttaacagaaagctaatacttaaatgtgatgatagcagggatagaataaagccagggcagccttgactttcatatttgagagaaaacacaaaatacgatgctgggactgttcttgtggttcacttcgtgttccttcacttttgtgctgtgcctcaattatataactgtaattgtgtcctaattgtggacacttgtactgctctgattttaatcaggtgcctccactaaagtgtgttgctgtcaaaggagtacatatcgtgtgtgatttctcctgttctataatctactcccttcactacccaatcacaaggacgattactactaatccataatatttattatgcccctgatattcatggcactgtgctaagcatgttccagggattattgttctcaatactcaccatagcgttgtattacccatgttacagatggagaaactgaagcttaaagacaaattgcccacggtcacatagtcagtaagtgttttaactgggtcttgggcacatgaatgcctgattcccaaaccttgacatttcactactatgtaacactatggatggaattgcagcaatccactcatattctctctggccctctgcttatcttatggtcagtagcaaactcctgtagtgtgatatatgtatgtgtattctgtagctaaccttaccttcctcttttgggaagtcttccatgagtccctaaaatgactttccatcctcctttcattacattctgcttacttgacactacttcacataattaattatatgtcctatctaaaaatctatagcaacccagccccattgtgttgaaaaacattactgaggatcacatattaaaaactactacaaagtgagtacagtatttcttgtgtacctacatcttctttcctcaataaaaattggagagtctttcatggccgggattgtcttattgtaatgtcttctgtcttgcaattttatcctcttaatcatagaagattctcaaaaaataggcttattgattgatagttaacagggtcaggtgaggaattatcctataacttggccggcaatacttggatcaaaatatttactcgtttttattagtagtttctgtttgtgtctagcaacataaagcaaattcttcatcttcttgcttattttacaattttggtttactgatattcatattttatatttaaatgtattaaatttcttttgtggaaacatttttgtgattatctaattttctttgttataggttttgatttcacttttccccttacatctccctcatcctctgtatttacagagctttctgcatatgcacagggtatacatttctagattaagtttctttcactgggtggacagctctcaagtaaattacccgagaggcccccctcccccacagagaagccagaatagctaataactaaaacacacaaaattgagaaacatttattctctcggtaatttttactttaaggataattgtttatttgcttaattggttctgcatgagatccttttgctctctatccttggcatgttgtcacttcaagatttttagtttttggtggaagaaaaaggggaacagttaaatatgaaaggtgaaaaattataaccacgagggacagctggagtttatctgatgtgacaatttccttttcctgctacagatttatagcacctctgcagggaataaagcaaatatgtggctgtgacaggaatattctattttgtgtaaatttttatcattgaaatgtaattatttcatttattgtaggaatgaataatgcatatgatttcatttctggcctacatatagaatccttcataatgccttttcttgatgtccatttgtttcttaaataatgtgctattcacagtgttacttctcagggctcttggacttgattaattgaatttttccacttcactattcattaagttgatatccaaatattttgaacatttttcatatgaaatatgacctcactggatctccaaattaactttcattattataatcctgttctcttcatttttaatttatttctaatttattgttttatatcaagttcttctctttccattttggttattttagatgatgatgttcatttgtaaatgaacttttattaggtttcagccttgtcatttggagcttcatttcttttgtgctcttgtgtatgtaactgattggaatctttgatcatttgctgttagttttccatgttcactaattgaacgaaaaagaagaagcaaagaaaggctcagagaagagaggataatggagtcaaagttctcattagagagaaataggttaagtataaggggttctattttcattcttatagtggagattttcctatttcagagtatgaagaagactttgaagtagatgaggagaaacaaggtgaaaaatctaatgaagaaggacaggctgatgttcaaatgaatggaataccgcagtcacctttggatgataaaaaagataatttagaccctgaaaaagagagtgaaacctcatcacagaaggcaccagatgcccrtgacaatgtgaaagatgagaatgatggatgctctgagagtgaactggaagaggataaacaaggcgagttgttcagcttatcatgtaacataggctgtttactgagtgtgtttactacttttctttgttttctatttaatgagataatcctcttttttttctcttgaatgtatgttttctaacttttaaataaggggtacatgtgaaggtttgttacacagataaacttatgtcatgggggttcgtcgtacacgttatttcatcacccaggtattaaacctagcacattatttatttttcctgatcctctttctcctcccatgctccacccttcaataggccccagtgtttgttkttccccactatgtgtccatgtgttctcatcatttagctcccactcatgacagtatgaggtaatttgttaccttcacactttattaatgcagcttcaaaaacctaatgaaagaggaacataaaacaaatgtctctgtaactattttagaatgtaaaggaatcttaaaaaggacatttacgactatagccatatcctatcagtgttccaattacattgaaaatgtaacaaattgtttggaaggaaaaagttaaaaattctccatttccacagttcagtgtatctttccattacataaacttacatacaaatatttatgtaattttttacaaatatgtaagcatataattcatgttactcttgaaattatttttttcagtttaactgtgcacatattaagtatcctaaaaagtcaatacgtgtatgaataacttattattgytaatagcaatatgaaagtttatggtatgccaatttattgttttgtgtactgatatttctgtatctttaggctagatttccttaagtatttgcttatgtttgattttagtaaatcctggcagattgctttctgaaagggtcatataattcacattcctaacaaggatataagagaaagcctgttttgtgatacacccactcacctggattttattaatcttatttatgttaatcttatggacaaaaaaatactagcttcttgttttagtttttattaccctaactcctggtgggttgagcatctttccttatattcattgtccatttatatttccttttctgtgaatattttgcttgctttactcatttstctattggatattatggctattgaggggctctttattaggcatagtttatcacatgctgtcatgctttcattcaatttttttttacttcattaatatttggtcattcagaactttttaatttttattactctaatctatttatcttgtttgttattgcttaacagtttcttttctaattaaaaagccttctcctaatccaaaggttagggacatatccccaaattttcatctattttcattatttaattttaattcagatacttaatccctatgaaatttatgagtttttttaaacaacttggggtaaagattcttttcaatgcgagaccataaaatccatgtaataaatagtactaaatttcacttttagcataagttgaatcaatgatttttcacacataccttagcatttcagaaatataagaaagtataattttaataataggtaagatgggagaaagagagaaagctacatataagaaaatgtatggaaaacagcagtaggtagactttcatggtaaaagaaagrgaaataaaaaagtcctaagttagaaaagaaaatgcaagaggagtagagaatattggagaggatcgaaacaccagtggcagactacagcataagtaagtaatgttctcactagatgttaggagtttggaaactcaacagatgttcagaggatagatacaggagatgagacaaaatgtctgatccacatggttttggtggatcagacattttggttccacgtgaattttaaaataggtttttctagttctgtgaacaatctcaatgttagatttaggtttacttttaagtctttaatacatcttgagttgatttttttatatggtgtaaggaatcctctgcatattgacatagctgatttctcaaaagatattttttaaatattaagcaactacttgaatgctaacaccaataatacgaagatgtttcggttagtgccatgatatctagctacatttatactttacagttattggaattttcaatgggaaaaatctataattagcaacgttgtatagatacataatatataatattttaaatagatatgcaatgaaaactataagaacatatagctggttcacaaatattgggaaatttaagagccaaaattaaattggctagctattttcttttgttgtttcattaatgatgttattaagctatgcttttaaagggctcttttgcatgcttggtgttttgaaacagtgtcattctgaaatcaaatctcattgctgattatggtttttttttactccatcgtcagactttcttattttccattcctttattttgataacttgcctttgtgttattcaaggcataaacatgtcttttagtatgtggagtgtcagcattagagattttatccagcgaacaagtagcatgtattaaaaatgataatgacatgatggattccttggaatactctgttgaaaagccagacagcatttcatttccaaaagtgtgagaggcatatgtgaccactgaatcccagacaccagtacatcctttttattgacatgattaagaatcttgctgttagtatttggatgtgtttcatttgaacctgcctacacctgttcccagagggcaaacaattgcccaggctgtcactcttgtgacaagtcagcctcatttgaactgccagctaacaattgtgtcggcctgccttgatgaatacactgtgctgagcagcccatgagtgatagagtgctactggctgcaagctgactaagagaggaccctggtttaggaatgatgtgtgagacttcctatcatttaaaaagaacgacagcttccttttctctgcatttgtgttggcaaccccaggcactaattcaccagttgaaaatatattgtcatagatgaatgttataaggttgaggggaaaagtatcatgtcactgagaatatacttttatggacagtttggatgatagtgtccatgagtaagaggtcaacgggtacaaagttacagttagacaggaagaataagttctagtattttactacacagtagggtgactatagcgaataacagtgtaatatatatttcaaaatagctagaagagaagattttgaatattgtcgccacaaagaaatgatgaatgcttaaagtgatgcatatgtaattaccccaatttgatcattatactatgtgtacatgcactgaaacatcacattgtgtctcataaatatatacaataattatttgtcaattacaaatttaaaaattagtaatgaaaaaaaagactaactagctccttttgagaaagattagacagattgagattgaagtagagataaagagacagagaagagacttctcccagaatatgaaaaaaagaaagtaagacttgaagtcatttttttctagtaagaaagatgatttcattcatgctatttttcaatctgttgaagaagtaaatcttataaacttttaaagtcccagaatcacagtaatattctacttaattgatttatgattttaagaatctcacccttaatcttttggcttcaatatgggtttgaaaagaagtataggggtgtaggcttctcctgtgttgaaattctttgtgctgtgagacgcaccgttggacttcagtgtaatgtatctgcttcttggatcagagaagattatgggaatgttatagatggcttctgaccaaagactatataatatgtgtgattttttgcgtggtcaatcaaacttaaatgtttcttaatggtaataattccccaatccatagtcacttttcaattgtcgaagtaggaaggcataacttcaggtgaatacttaaatgtagaactatcctttaattcacacaaaaatacttttctatgaagtgtttctctacagtttgaatctgccttgtagaaaacaaaggcattacatagacactcagtgaactcttgtgaatgaagggctgattgaatagatcaacagatgaatgaaaataatgtatacagcacaatgtgacacatgatttgattgtattataaatattttaacagtttattttaatgtttagaaagtgaaattaaaggtaaatatggagaacattttattttattctcctcctgctatatctgcatttacctgtgaatatgtattcttacatatacttgtctccctgatgatttgagacatttcatctgataataataactatcagtatgtgggcatatgttccctcttaagactaaaaaccagttactgttcatagttggaatttgataatttatatttttattttcattaagcacagattcatcctacaacatttattgagtataaagcacttgtctaattagctattactgtacatgaagatattgattgaactgacatataatataaacagtttttcttgaacttgtaagtttcattaagacagaactatttatacaactaatagtaggatatataaattcatgtgtcatggctaatttgaagaaattaagagcagcatatatgcagattttgctgtgaactcttggactaaggaataggaaggagagaattggatggtattagaattgaaaagcatattggatccactgggttgggatccacggttatgtcactgagatcatttaaatttttaacttaatttactcattttagtttgtgaacttaaactgcaatttctgtaggtgcttccagctaataaaccaaaaacaaagtagttaaaatcaggacactaattaaggaaatggtgaatttaaactgtggtaaaattatgctccttgctagcaggtgagaaaatgattgaaaactaaggtcaggtctggtcattggtttaaaacagacaatttggctactgattgcaataagagtatggcaatagtttctgagagagttatcagcagtcactgttagagtgaaccaatacctttawgaacatgtacagtggatctatttccctcatgcgaamggaggtggataattagtcaatctctgttttgagtgtgtattataggtagaagcaaggaccaaggtttctgttttcttgtagaacattgcctggcacataggaagttctcgatatgtatttagtggacaaatgaatctatgtaagttggaaggaaagtgaggacaactcagaacctcagttatgaggagggagagcagactttatcctggatttgctggactggtgttgactttggatgtgtgtgtggctggtgcccttggtcaggcgtatcaagctagcaatcaggcagtataaacagtgaagactgctggcatacaaagcatacacacacacacacacacacacacacacacacgccccatttttgtgagtgtccccacagtgttctgtagttatttggtaaataactgaataacatgtatattttcataaaatagcatcatgataaatgttataaataaactagggaagactttgatcgctaccttttgcttttgctttgtattcatattctgtgcctcagaatattttaagtggactctgagctttggagtggtggacaaagttaagaatgaccagtagagataaaaaaacaaggacagactacacatttcatgagttctgatttttgaaagagaacaatttcctgtctgtcagtctcaagtggtaacagtgaaaagtcagctaagaggagcaatggtgggtccatggctgtgggtacttcctgtctgaaggccttttagcaaatagaagggtcttggttttattgcagtctatcattacaaaagaagcatttacaaaaacttgctacttactaggtaatggacattgggtactgttgaacctctttggacctctctttctggatctcaaaatagaagataattattatttcataggattaaatgagatgtttgtaaagtgctatgtcatggtttggtttatagtaggtgcataatcatgattggttttatctttatcatggtagctgtgatatcactcaatatcacaagaaagaaattacaagagagaaatttattagaatatgctacatgtatgatgtcatagaggaaaaaagactataaagaaatagttatttcatttgattaggttaaatatttttctcatgtaatttctacaattatgtaaggagaacaagtagaattatccccattttacagttaagaaaacagagccttaaagaaattaaatagcataaccaaagtcgaaactattaagtagctgagctgtgattgggacaccagggtttgtcgtacaggagaatatgttattttttctcaatctcatgctgtgtcaaacaagattttaattatagtgatgccaaaaaagaaagaaagaagcagttgtcaatgacatgaaaagggaagaagggcctggagagctcctgactgtggaaagagaaaagtcaaagaccttgcttaggacatggaacaatggcaccaaacttgctggcttcggccaagacctcacgcaatgagtgcagatcttttctttgccaaaacaagcaaaagcaggttcttatagcatcactaccagaagggaatacatgaacaaatggaattsggtaggaggcatagctgtttatcaacatgcttccaagataatttttccctcctaatgacaaagcaaatttacatacgtgctctcaaagttttttttaatataarcatttgctttatttctaagagaataaataaaattagttttgaaaatcctatttcataaccctgaagcttttttagcttttttataggcaaagtcttacccccgtgtctgtgtatgtaaatgagagaaagaaatgagagtgaaactaaattatagcatgaggttagggagaaatttgaaaactgaaatgagtttgtatgggaggtcaggtgccctggccacttcgaggccattcattctcctgatctttctcctctgaaggactgactcaaacttgaaccagagtatatttcagccctttgaaataaaataatacaattaatggaagctgctaaagaaaggcagaggagcactcatttttaaaaattatatgaccaactctcagagctaaaagtaggagtcatttccatattcagatggtagatatatttttggagttcagaaggagtataacattgagtcctagctaactatgtaattaatgaaagccattgattaaactgctaataaatcagagctgatgttctttttttaaagaagaaacataagactctgaagggaaaggggagttcatagaccctaaagtttctgaacggatacaaataagatggagaagaactctccttgatttgctacattttctaccagagagatggcatatccagattttataaaatggagaataaagaatgagtagctagagtatgtgatttatttgaaaaatagtggtcatctggtgtttgtcaaggtatcaggagataaaagcaaatggaattagacttcaggggctctgttgctgaaaggctttttgagtttgttttttactgctgtgtagcatctctcaaatctttgtggaaactctgatatgtctctgagactatatttaaaatgctaagacctgtcatggagagccggcagggctggaggcatggagagaagaggataagcgcaaagacaggtattttttatcttaaactctgcattagctgctacagccatcggtacagctgccaaatggaactgaaagaaataaagaaacaraaaaaagagtaaggagtacagagaaaacaaaaaaataggcagcatttaaatgtaggatgttttatttggaagtataaaaaaaacaattacagacctagacctattggttagaaaagctagattgtatttctctggcctgtagcaatgtatgcagtgattttttatgctgtccagcttccttattgagattcagtgtgtatggtactttactggaaattgttaaaacctttctaggtattacataaaccagctgtggctaccgtaagtttctagactgcgaatctgtagcaccctgtcgtcacactgcctagatctcccagaatctcttgccaactttgttcacccatttcccatcttctgctcccttcacctttttcagaggactgccctggactactggtggtgcttcaccctcagactcaaagagcctggaaatgccagagagtttacattccccctagggtggcccatagctaatgtctgacttttccgaagtatgaaagcccagctcctgcctaatataaattacatcctaatatagcttacatgtcagaagtgcccatgggatcaggttgagattgagatggggcttgaaatatytcccttgattgatttctgcccttccttcccttgcttmtgctactcccttaagagttctcctggagcacatcttaaatacttttctcacacatgaatcttcatctcagcttctgcttctgcagagctcaaaataagataaaatctccatctatgtacacacacacatgcaagtgtcacctaaaaatatttgtctatgtactggccaaatacacagatcttactgtgtccatataccaagatatactaggatggtggatagtacagtagacaaaaatttaagtttcatgcacacagaatactgtggtgatagaatgaaataaatttttttaaaaaaagcttttgttgaagagacaaaggattattcatttttttctataacaaagtgaatatttataaagcgttttcaakaaaaaatggctttcaaaaaacaacaaaaaaacagggatggttgatagttaaatgtgatctmttgaaaatttctatatactcatatattccattgatttgataggttttccttatcctaacaatgatttagaccagggatctaatccccgggccacggactggtacagggtccatggcctattaggaaccaggctgcacagcaggaggtgagtggtggggaagccagcgaagttttatctgtatttacagccacttcccatcccctatcgctggcattactgcctgaggtccatctcctgttagatcagtggaaacattagatcctcataggagcagaaaccctattgtgagctgcacatgccagggttctaggttgtgagctccttatgagaatctaatgcctgatggtctgccactgtctcgcattatctccaaatctgaccgtccagatgcaggaaaacaagctcagggctcccactgattctatattattgtcagttgtataattacttcattatatattacaatgtaataataatggaaataacgtgcacaataaatgtaatgcacttgaatcatcccaaaaccatccccactcaaccccagtccatggaaaagttgtcttccatgaaaccactccctggtataaaaaagattggggaccactgagtagactatatgggaaaaggatatcaggtctatattaaactatgttttaaaatttttagtattattaattgctaacataatttttacaattaaaccaattgctttacagaacaacaacaatgtcatcacttttattttttgtagatatgaaaactgcttyatcaacctcatccagaagtcacccttattctagtgacagtgaggatgaatctgcagtgggggacagggaagcccacactgacagcagcacagatgaaagtgccagaaggtcatcttctcaggaactgagtgaaaatgataagccaagaaagtctcaccttccarttgaggaatccttagaaattgaaattgaagacsaagaaataacaaaagcagatgtggagaccaagccgatgccaatagaygaaagctttgagaatgttcttaaagaaggaacrgagaaaggaacccaagagattgcagagggtttatctgagaagtccgggaaacrtgtttctgcagaagaaaaggaaaaggataagagtaagctttgggaagaaagcactgctcaggtgaaggacaaaaaggcaggtctccctgggttggaggaaggtggtaagtatggcckttgagttgagctgccatcatcctcatgcatggaagctgattttggtcattgcactatgccaaagcttgggaaatactactgtgacaatgctttagggattcaagattttttgctgtgtctctctttgtcacataatcatacatgtattttcagtttgctgtttgccttctcttgcacttaaaaaattactcgataatttctatccagcctgtttcctattttcggtaaattccctcctatgggaattccatctcaggaatgaaataaagcacagtatgtgtctgaaggcaaggatgtgtgtggcttttagagattatttaatactagaaatactatttgtttttagctatatatggagtttcagatatatagctaatgttaataggtgcttactacgttccaggcatggttctaaacacttagatatattaactcatcacgtcctcacaaaaatccagtctccctctaagttacattctattatcatcatctcttttttacagatgaaaaatgaaatgtagcttccaaaggttaaataagttaccaaagattacacagctaaaagaggcattcctaggatatgaattcaggcagagttgttccagaacttataaatattgcctattgcgtctgtgtaatatgaatttagatttagataatagtgtaaaattttcttacaagattccaaacttccctttgagttctctgaaactgagttactttctgatccctggggctcctgggtgtgtaagattgttcatttgacatggaaacagtaaggagtgtcaggataatcaggccccagaccttagacacatggaaggtctgatgcttttctcaagttgaggagcacagtggaagggctgaggggtgtcctgtggagagctggattgcacctgcccgatgcttgcctctcacctagcctcctgtgccctggaactggttcacagtcctttggttgctctctctcatctgtctcccctgtcaatgcaggagccattcttgattttaagataaaatttattttcacattttaatattactaaaattcagctgcgttttaaaagcatatgaatgcttttagcgtctatgttacttttagacccttaaaaactactgttaaaccactggggtctactaggaattgaagatgtcgaatagttatctattacttcaaccaatattattaatcttctactatgcacaaggcaccatagtcaataaaaaatgtgtaagacagagtttctctcataacttgctgagtggaagccttggcacaccaccagacaaaggttagtagtcccatgtaaaatagagaaggtaaaaaatgctatgtggcttcaaaggagagaagtcctgtttgttaaaagacaccttgaaagttttcacgaagaacgtatttgagaaactttaaaggttaaatacaattttgaaggtgggatacaggaggataaaggtgttttagatagtggagtatagcaatgcatatgacctttgaataagttaccaaaaataactctagaacagagtttgacaaactttggcccaggggccaaaccactactattttgtcttgttttctaaatagcctgcaagccaagaatgatttttgtatttttaaatagcccacaaaatcctaagaatttacaaactgggactttagagataaagttcataaacctctgccctagaataaaaatgcaaagaccctgaacatcttcaaaaggatttttgtcatatataaatcaagattctagctcaaatatatttgaaacccttttataaaataattcaaatctttgatcttgaatttcattatgaaattttcatacatataaggtatcatctagaaaatgtatacaagctgacaagctgctaatcaaaaaggtagaggtgttaaaggtcaatagaaacactaacattattttcattttttaaattttcacttcagagaaccagattgtttacctgaatttgtgtaagtagacatctttttgtaaagtaggatatacataatgagggtcataattaggctgtagaatatcagagatgtagcactatgatcatgtcacctggaagacagtagtttttttttctctgggtttgtaaaatgaaaagtgtattggcttattaattttctcaaatatattgggaaacctatggtcttgacttgataacatctataattttaaaacattttgttatctttttattaaggtggattcaacacaagatggcaaggtttgggactgtttatctttgattttaattttttttttttttttttttttttgagatggagtctcattctgtcacccaggctggagtgcagtggcacaatctcagctcactgcaacctctgcctcccgggttcaagcaattctcctgccttaacctcccgagtagctgagactacaggtgctcgccaccacgcctggctaattttttgtatttttagtaaagacggggtttcaccgtgttagccaggatggtctcgatctcttgaccacgtgatccaccygcctcggtctcccaaagtgttgggattacaggcatgagccaccatgcccagcctgtttatctttgttaagccgtaatatrtgtgcgattattaattttttattaacaaataatacacatggaataatatttagacaatagagaaaagtaattttgaaaaattactcataggtttatcacacacaaaaagatcacttttaacatttggtcgggctctttatttgtcaacttaggatttacaaagttttgttttcatattttgtaaaatatatgctgctttatatcttaacattataacgtgatcatttttcacatctttaatctttatgaacatatttaatctctgtgtgttatgccattctgtggttttctcataatttagccatttccttattgttggacatttatattttttcttactttcactattgttattagtactttagtgtcttattactaagattatttcaaatttataaacattttcttaagataaatttcaataagtataatttttgttcaaaagttatagatattttaaggtttttgataaacttttttctcacaaaaatttggtttaaatgtttaaacattacagaacagagaagaataaagtgaaagtgaaagtctttctcgcccaacctttactctttttctccagggataacggtggatagcaattttttggtgtgtgcatgattacagaaattataggtaggtagataggtatagatatattaatatatattgctatattacamagatacatatacatatgttatttttatgtatagatggaaacatactatacattttgttctgagacttgcttttttcacttaacactgtatcttgaatgtcttgtcacataagcacacttctcttttcttcttattcaccttatctgttattcttatattgccacagtattgtataactgcacgttttctttaaaatatgttgccttctgtgtaagaactcatagttttgttctattgttcatcttccacaaaagaacaaaatttgagggttgtgaaagccaggaaatatagaatcagggaatataaagcataagacattaacaggtaaaacagaacaaagaccatgtataatattcagaatgatgtggaaggattaatgctatcaaaaacctgaggctgagtaaattataacagttggggggctaatgttttctaaatacaaatactcagggaaatgattcaataaatttgttaatattttaaataatagatttaaaagtcaaaaatattcttgaaattttttgtatgaataacaatttctaagaaaattccacataaaatcacaaaatatgcacacatatatattgtacttagatccmtgactggaactgtaggtagaaatgaaagagggctgagagaatgtgtaaatgaccatgtcccacatttgtatggtatttaatyatttttcagttagaataaaagctgttattatgttaaagaataatctatgttacaaataaatctgtgggctaaaaatcatatacaattaatgatgttttatagactctaagctaacatgatttaatttgaattgtttttacttgagatcatagcagtggataaatgagtaaagtacagccattgccttcataccttttaggttgattgcataaaatgatattttccttctcactattttatagtatgtcatatttaattggactttgtccagtccatcaacaaatcagatgaattgaataaaagatgtactgtacacagtgaagcagataaagtaaaagattataattgctagctgcaatcagacagtgttcttgggtgttaatccagtattacagggcatagtgttattttaatgtttatttttctgttattttcagcttaagctgtcatgcattgtgacacaatcttggcaatatgttctaatagtggaataactcaagtgcattaatttgtaaacttaatttaatttatacatcataaatataaatgaaataaagagtagtgtatttaatgtaaattataatgtcaaatgcatatgggaataagcattttctatttttgtatgtgaatcaggaaaagtcatagtgcttgaccaggcaatttgaacttaaataatagtataactaaaatgaaatgcaattttgtcatcaggcaggcaggataaaatggtcctgatgaaagaacaagaaagtcaagtgttatgagttgaggtctaaatacaatttctgaatgacctgtggaagcatgtggttgttctaatagacctcttcagtccctaaatatttgctgaggatctgctttatgccacacactgttctcaatgtgaacataagagtccctttccacatgaattttatattctaggagagagatatgcctgccaagtgaaaaataagcatgtgatggggtatctgggctaagtaatagaaggaaaataaagcagggkaaagggataataragtgatggtttgaggaaggggtagtatttttgggatggcctctctaataatcggacatctgaacagagatgaatgaagtgcagggggaggccactctgtcatctgcagaaagaccacagggagcaggggtccagcaagtgcaatggccccaaattgggagcatagctgctgaatgaaggaattggaaatgaggccagtgtgacagagtctagtaaacaagtagagtagtacaagatgaggtcagaggaggaagctcataggtcatggggaggaatttattctgagttaggaaatctttcctctaggaagatgtgagaccacaatggcatgatctgaatgtttcgaaaagattattctggctactatatggaggctaaactttagcattctctgcaactgtctttgaacagctgtggtcttcggtttgtaattaatcctggtattttgtgggccatgcatcaatgtcaaagatgacagaagaacatcttcactgtgtaggtagatgatgttaatcatgaattttgtcatggtgagttgttgggaaggtaatcgactggctacacaaagaatgatgaaagcacagggatacttttcaaggtcaccaggaacttggaataagttgggcatatctttatggtgtttttatggcattctttcattcttaaaatacagatgaaaattcttgacaaaaccctcttctgatattcagttgctcaggattcttaacatgttttaagatgggatcaatttggtttgtttaaaacagtataggagagagaatgaattagatgtcattgagaatacacgataggaaatgtaaaagatgtaacgtataccaaattagagcatttgtattttgacatttgagaacctggaagaaagaaccgataatgaagattcaagtaagcatgaaatagaataaccagtatttttgtttcagggcgtaaaccatttattaaagttttatgtattagtggttctacttctccttacctttctactgcccaaacccctcagacactattggctagaaaatacgtagcacagttgacctgcttatctgaagtttcagttactcatggttaacctcagtctgaaaataggtgagtacagtataataagacagacagagagagagagaaggagagagagagagaaagagaccacatcaacataccttttattgtagtatattgttataattttctattttattattagttattgttgttaatctcttatgtacttaatttataaattaaactttattataaggaggcatgtataggaaaaagcatagtatatatagagtttgatactatctactgttttaagcatctgctagggttgtggaatgtatataccctgcagataaggggagactcctatactgtaaaaacaaacaaacaaacaaaacccctgaagcccccaagatatacagtacattgaagctcttggatgatttcttgaactttccttcttatgcctctgcatattttcctcttcatctgctctggccgacaatgacatctaaagctttaccatggagaactggcaactacaggacagaaatactgtggctttgttctgcccccgtttacattgttttaaaggagaaaaatggcctagaggatgtgtaaaattgtgggagggtcaggggagaaaagagaaagaaagaaacaaaataagcacagaattacaaaaaaatcagaaaagagaaaatgctaccctgcaactatgtttggcctgaaaaattacaactttcatcgtcatcattctaaatatttttttgttaaatcaaagtttatggtaaaaaatacctgaaaaattccaaaatattcatttaaaccacataaataatgcttcaaaatgatcataagaatgttttttgtttagtaaatatttaatatttcaatttgcatcttgactagtagatattaaagtatcaacttttacatcccacttgtgatggcctgaattttcatatgttatttgatttgtttccacaaaagcagttgaattattgcagtgagtttctaagtttctacattaacatagcagcaagtgatatgaaggctataaatcgacttttagggagaatgttaattagaaacactgtgaaatttatgtcatttggtaatatgaattcaggtacctgattttttttccctgttgtattttaaatgaggaagaaagtataaaaatagcagtttaaatgttttacaaagtttaaaaagtgtgtttttatatctaaagaaggtaccatccagatgtcacaaaatccaaggaatttgctacatgagggcaaattagagaaagacatcaggagctatcttgtgtttgtttcccatgagaaagaggagcatcctcatagaagttaaaaaagaaatcatcctagacttaaaggattagaagaggctggaagcaggggtgagccgtgaggaagtaaaaagccggtgtgctggcctctaattgttcagtgttctccactgttgccaccatcccaggaaagcttgtgaggcaacaccaacaaaaagtcagctacactggtgggtagagagtcttctcccctgaattcatagaggcacttccataacaaagaagatggcaatgtcaagactagagtagctgtctaaccaagcctggaagctcttgcaaccacagaaaagtaacgcagtgaattacatttctgctaagagggttcaaagccccactttcctttcctttctcctctagctctttggtcactgaattggaattggaaactatttcagcttaacgtttttgaggaaaatctgcatcccaatgggatttaagagcattcaagaagctatccactctcttagtggaaaatacaaaatgaataacgctcatttgtatataaatataaacatcagtccttttcataatacataaggacatagaaaaaatgattaatataatttagaaggttggtttatcatgtaactattattctccatgtgccttttttatagcagcacagagcagaatttgttgaatccacagtaaatgataacagtgcaataaagctataaattatttacaaaatataattaactctcaccagaaaaattgaaaatttaaaagcagtactctaaataattcttggatctaagagaaaaaaattcactggataattaattaattgcaattattagtgccaacaggtggtatttgtaaggtgaccaatttctcactatagcctcaaagaaccaccccactcacactataacaacaacaacaaaagtaataaaccgcaatggagaaatactcataatcagactttaagaaatgtataagaaggaaaaacctaacacatgggcttaataagaaaaatatgctattccacacaaagcagatgaaaaagaaatatgataaatgggaaatcactccaactatttgaatagaagactaaagatgatgataatttttgccagattaaatccaaaatttgttgtagaacatctgcamatcctaacaataatagtttgggatttgaaaaaaattcattaatttggaagaaatagtactgagtaatgtgaaattctttgcaataacagaaataacatacgactatacaggaaaacaaactctggaagaaatatttgccagatggatatgacaaaacatttatgtttgtatggacataaagatggcaacaatarccattggagactaccaggcggggaaagtgaaagggggccgtggattgaaaaactacttattgggtattatgttcactgcatgggtgatgggatcatttgcacaccaaatctcagtgacatgtaatttactcatgtaggaaacctgcatatgtaccccctgaatctaaaataaaggctggaaaaaatgattgatgtctgtaatacataaagagttcttacaaatcaatgaaaargcaaacatcataacagaagaatgtacattgtatagcaggaaattcacaaaaggaaagcttgctactaatattgacagctctatccttgccaccacttttcaattactaaattatcaaataaagaaagaattggtggaaattgtgaaaatagtgcaggcacataggactttcagtcattattgatgacattgttcatcatacctcctttttaaaagaacatttagaaatatgtataaaaagcttctaaaaattcatagcaattcatattccaggaatgtgtcctaagggaatagtcwgaaatatgtgcaaaaatgattataagtagtgtttaaaatagctttataatcacaattgaaatagctcaatatttaacaatagacattgatgaaccgaaatttagtaagactttattataatgttttatgtgttattgaagagtcttttaaatttaatgatatgggaaaatagtcacaatatattgctaaattaataaagtgggatattaagggctacctttagtaagaatcgagtaaaaaatacttggaaatctattaagatgttaactagtagtcttctctgagtagtgaaactatgataattattttcttctttgtatcctttagttttttcaagctttggataatctatctaaatactgtctccatatttagggaaaatacaatacatattatttaaaatatatttgtttttatactaaaaagctgacattgtaaaataagaatattttgatatttaaaaaaataccttaaagtatcattatatcatttgagtgaaaaaaaaaaagctgactttctaagaaattttctgtgtgtgacaattccatttggcaactaatgctgtgagaactgacaatcacctttgcctccagtggtcacctttattgataggtaaaagacaggagccttaggggatgaagggctaaatacagagaggcaacaaagtgatatgtcacattgctgaaatgggagtctcagcatgcacagtcctcttttactatgggtggaaaacagttgaggttagacaccagccaagttcttgcttttaagtttcagtttcagaagaacatctgagaaaaaacgaccaagtgaagccttttctggtttcacacctagtaagtccttgatacttaggccagcatcccattcttgctgaatctgaaataggcaacacctaactatacaggctctcatctacttccgaaggctaatcctccaggggcaagccagcagacgtgggcaagtggtgataacatccctgagacagagggactacaagcttcactatcatttctgagtgagttttaattttcagatgatgttagtattgtttggcttcttatagtagtcttttggttcagtacctgctaattgcttattgtttattattaatattatagactatatttttataccctgtggactacttggaaaaagctttgatgtcttagcactgatggaatgaagcttcatgtaattgccaaataaatttatatgcaaaacctaaaacattgcttatttgaactgtctagatatacagtattcacattattatagtaaaatgatatttaactcatgtattatgtttgtcaagtttctaaaatgaaaacttgatagtaaatccaactattacatcattgtcttgagtcgatataatctctaaactcttattgtaaaaaacttttgttatattggatgaatgaagaaaactgagttcaaatatttttaaaagagaatatatttgaactatattattcccctttttcatttctgtttgtcgtcctaatattgttaagtcacaattttccctccaaaaccgatttaaggcaggtatttcactattcgtttccaaatacagaggggtcagtaagtaattaccccttagcagttcactttaaactaagcaagaaactgcattccagttctgttttctcaaagtaaatccgttatatccgttgtaacagaatatcgggggaggaggaaggaaggaaggaaggaaggaagtaaagaaagaaggaaggaaaaggaagggaagggaagggaaaaagaagggaaaggaaaggaaggaaggaaggaaaaaaggacagaaaggggggaaaaaggaaagaaaggaagaaagggaaggaaagaagttagtttcagaaatactatgttcttaccccagaagacagatctaagtctagttttatttgaaataacttttgttaacaaggaggtgatataatggtaatgtcaggtatttatggaattcacgatatgggtaatcagatgataagcaagggatgtagaaagggaattgtcagaaactaaagacaaatttaattggctttacactttggcctagaatcataccacactgggtgatgacacttagaaatgcccatcacchtcatcatcatcatcatcatcatcatcatcattgctgttattattaagtgcctagatacttgctaataagtggaagatgaagatgctctctctatattatttcatttaatcctctcaagaaccattggatagataactctttttgacagacagataaaccaaggcgttggcttaggccaaagcatttactcaatgtgatatggttagtatgtaatatgagacttgaatttaggtctctgtgatcctgaagtctatgctagtaaccaactacagataacaggaattcaggaatttctacaatagcttttactgtcaaatttataggaatcgtgtaatagcttttttgcttctgtccccatggagtgaatattggggtcaaatcactaaaatctactaatggatgaaatgctcatagtttagtcagctctagtagttttagcaatttagaaaagcagtgatgattggtgtcataaaagccatagcacacgttcctagaagggaaaatgcaactaaactgtttttttcaattatttcattgcatgtgcatttggcaaatctgtcactgctcctggctgctctctctctctttttttaatgcaagtatttctctgcatggatttctttacttcatgatcttctgttgtgtattgtgttttctttttgaaatcatagcttgggagttgtttatgcttcagagatttttaaaccaaggctaccttttaatgtaaatgcacttaaattgaccccacttatttaaatgatgtgaaatagctcagcaatgttcccatgacctgtttttataccttttgatattttatgtgacctccaataagctggacagataataacagaacccttggcattgggctaccactgccactgtgatgctgagtctggtgtcagcagtgaagatgagggtgggaagccaccgaggaagctggaggttgacacaagtggcagtaagggcacatcattacctaggaagaaccttcagaaatcctctgcaaaagacggcctgtttccacccttcctattcttgtttcttccttctgccactttttttttttytttcaactaaggaatagaatggccagaagtagttgacaggccctaaggagagcttcacagctaacatcaggtataaatttattattattttttgaatatattgatgtctaggattaaataaaagaacattagattatacaatactggtaggaattttcagatcagtcttctttcaatagcctgcctcccagatagttgaacagctaggtgaatttgccttaactgacccaactggagagatggagaaccatggtacatttcacagtgattcatttgaccttttttttcttttttttttttttaactaggaaaggattcattgccattagcctatgtcctggctcttggtggtaagtattccatctgcaagaggtccaattagagtgatccaacagaccatgactcataaatctggtcaaacttcccatgttcttgaaatcactaggctttctagtatttattgaatgacttttaagaagtgtgcttatttgaatatatttatgtgtatggtggcaggaaaaggtattcatttattcatcatatggtcacattatcccaccttcaattttagtaattgtcatcaagcactgtgaggcatttgagattttacccttctttcaagcaacaacttagccagccacagttttatggatcatggcagaagacataagacacctgagtcagagaaaaaggactttattgttcatagcaaatagcagtagccagagtacctgtatttatgctggttccctgagctccatttctcacttggcaacatgaagagggccaggtaacacttgattgtgcagcgggctgacttacaggagaggcaccatgatcttagagaacccatatcttttataatgggcattcaactagaggaactcaggtgcaccttcccaaatatttattctgcaatgcagagatactggttgttattgatcaaattgtattcaagcaagaaaatctaattatttgtaagcaatgaaaggtgtgcacaaggaagattattagggctttctttatgccaggcactatgctaagcattttacataaattatctcatttactgtcaaaggattctgtgagtacagcattgctattcccatttcatgaataagaaaatgaaagattagagaggtgttatttcccagtttatacaattagtaaatggcagagctggcgttttttacccaggttagtctgacttccaagtacacactcattccacttcatcaaattgccattgtttgtgaatattgtttgctctcttatattaaatattttttcaaaagcccatggggttaccataaaaaaaagtcatgtttttatactaatatttcttagaaaagcttcaattactctttctcccttgcttgaggaacgtcatgtctgacacccttatagtgttgtgttcatataacatctcagctggatgccattagcactttctctcctagaatttaggcataatatattactacatggtggctaggcaattttatttccctgtttccctgaatgttctttaattaatccataaatttagaaaccagattagaaaaacagaagactttctttaaatgtttttataactgactttttagtatactttcatgcaggaatttgaatagcaacagatacactattaaagagacttgacayacrttattgtttcctattgtttcaatttaattttgtttcaaatacggtaataatctgtaatgaaataaaatggaccatattctctcaggtgaattggctatatgttctgtgaacaaatatttgattctacattttgctttggaagcttttaggtaaaagttaggaaataactgctgtgataagcagaggatgacctgtaaagtcaacctcagccctattgatagacctgaaatttttattttactcctttgaaaggagacatcacaaattaccttccaaacacattttaagggaaatgtaatatcagctattattgctttacctcaaaatgctttatcataatagctggcaagagactgaggaaatgcwacaaacgataaccgtgttttgtgttagaagcggtaatgaaatggtaagacagtcttggatggggtataaagtagagaagaagtgagtaagatcaggacttcaggcttctggtaggttgttggtgatgatgttgggggtaagatggctasccaagaaggcaagcaagtaaaaaacaaatgaggagcatcatacttgcctactttataagtttttttttttttaagttagagtttgacatcttggtatgataacttattttataaaatctagtccagtgattttttaattaataaaaaagattaaattgatataaattattaagatgaaccttttcaaagcttctagctccctaacctctattctgcagttgggaaattgaaatgctttaggtgtttggcatgacatgcctttctttacttattttacttgcaacatatatataactttatttaatagtaaaaaaatccactttgttccattaaaaacatatcaaacctatatttattgaactatgaactatgatagcttgtgcacccaggtttaccaggaaattatgggtgaacacttgtactctaagaagattatttatgctgaaaactgtcccggtctgcaaagtcctatcttgctttgtgatcctgtcttgccaaaggcaagttagcttctgaacacaggtgagaggtaatgcaaattggtgtctttgtagctttgtagctcaaggtaagacttacctatgtagctcaaggtaagactttttactaaagactcaatttgtgatgactaaatctagatatagtagcttatcatctgggagtgagaatcatcagttcacactgtawaatgattgtgttgctaaaggcccatgtgagtaccagaaacacatgcagaagacagacatattatgctgctacagaaaataatgagttcagggccagktgcagtggcccacacctgtaatcccaacactttgggagtttgagatccaagagttgaaaccagccagggcaacatggaaagaccctgtctctactaacaaaacaaaacaaaacaaaaaaattagcctggcatagtggcatgcatctatggtcccagctacccaagaggctgaggcaggaagattgcttgagaccaggaaatcaaggctgaagtgggccacgttcacactgctgccctccagcctgggtgacacagcgagaccctgcctgaaaaaaaaaaaaaragagagaaaaagagacaaataaaataataatttatatgaagattaaatgctatttttcttattgcataattttttccacttattattatttctaagaaaggaagcttgtatgtatgtgaaagagagagagagagaaagaggaagccaagagaaagagtgaggtggagattttgctgattccaagacatggggacatgagattttttttgcttattgctgcttattttaaacatctctgatgatcagcttttctttaatatcaatgtgttccttaaatttgaagacatttcttttcataatgaaaaaccattattaagtcatggtgcatgttatagtcagcatcctagaaacaatggagaaagtgttttatatataatacaatggcctcttgatatcacatataaatatctcacactgtaaataagtgtgatataagattatagtgtcccctcccttgttcgcttggattaaagtaatctygatttctaaccttatttttatagcaccaacaatgaatttcatggtggatgaaacagcagcaatcaactcaaacaaggaatcccagcaattggtgcaaaaaacgtatayactggagaagaaagaagcaatggaggaagatgaagcgccccagcacagagatgctgacatagtacagggaaaaggggaggcagcactgtggggagaagcaggagctgttcatgaggctcccttgagggcgtggaagccaacagcagagcagccagaattggcagaagagtttacagaaaaaagggagatccctccaggcatagaaaggggggcagagggagcagcagaagcagaaggggtcagaaggctgggtgaaggggggtcagaccccataggacaagcagcagcaaaagatgctgtgggtctgagtaaagatgaggctcctgaaaagcaagccttgatgctcacagtgcttgagacagacaaagcagcttctgaaggggaacagggtttagagaaggcagtgcttgcaaatgaagcagcagccctgaacttggagcatcttcatgaagtagcagccctgagagaggcagcgacatcggaggagggagaggctgagggtggggtggctgtgagtgatgtcggagaaagtgaagaggaagcatccatagacctagaggacacaggacccatggaggacacagcatcaaagagagaggacggttctgaagaggcaattcttgggggagaggaaccagccaaagagagaaaagaggttatgagaacagaaacacgcttgagccccttcacaggagaggcagaggcaagccggatgcaggtttcggagggcagccctgaggaaggaagccttgcaaaggaagccttcctttgcaaggaagatgtggaaggggaagagatggtgactgaggcagaagctaatagggaagatgataggaaagaaattttacccaaggaattagatttagcaagagagcgaaggaaagctgagaggccaaaaacatctctgaggaaaactgactctgagagagaagaggtgacaagggcaaatgcactcaaggatgaagatgcttttaaagaagagcaaaaacttaaagcggaagaaggggaaacagagacagaagtaagagctgaggaagagacaaaagctcccccaaatgaaatgggatctgatgctgagaacgaagcacctgtggaggcttctgagttgtctgacaatccagggcttctaggagaagattcactaaaagagacagtggttcccatatttgaagcaacgcctggatttgaaaagtcgctggaaaacataacagctctgaggaaagaaggaggaggggaaagactgagygaagccagagacacagagcacaaagacagagaagagctgtccagcagggagaatagggccctgaaggaagggcaccgccaagatggagagggggccttagcagctcctgaagctgagccagcaggaaaggtgcaggcccctgaggggctgatcccagccacaggccaggcagaggagctagcagccaaagatcacgactcctgcgcaggactggaggggagagctgaagggcaaggaggagtggatgtcgtgctaaggacccaggaagctgttgctgaggaagatcccataatggcagaaaagttcagggaggaagcggtggatgaggacccagaggaggaagaggacaaagagtgcactctggagacagaagcgatgcaggacaggaactcggaaggggacggggacatggaaggagaaggaaacacacaaaagaatgagggcatgggaggaggaagggttgtggctgtggaagttctacacggaggtggtgaaacggcagaaacagccgcagaggagagggaggtgttggcaggttcggagacagccgaggagaaaacaatagcaaataaagcctcctccttttcagatgttgctgaggaagaaacctggcaccaacaggatgagttagtaggaaaaacagcagctgcagggaaggtggtggtagaggaattagcacggagtggggaggaagtgccagcagcagaggagatgacagtgacatatacaacagaggctggggtgggcactccaggagccctggagcggaagacctcagggctaggacaggagcaagaggaagggtcagagggccaggaggcagccactgggagtggcgatgggaggcaggagacaggagcagctgaaaaattccgattaggattatcacgggagggagagagggaattgagtccggagagtctacaggcgatggcaacacttccagtgaagcctgatttcactgaaacccgagagaagcaacagcatatggtgcaaggagaaagcgagactgcagatgtttcccccaacaacgtgcaggtctaggagacttgctggcagacggtgagtttaagcgtaatgtctttgtaggactaaatagcagccctgcggtgggtctcctccccttggggctggcttgtccctttattggtgtctgtgcacatataaacacacaggcttcaattctgtgtcacttagccctaagcctgtcaggaaaggggctgggaaagacggaggaggggccaaagcatgcacagggacacactgctcttcccggtgtggcaagtcatattcagtctttgcaaggcagctccctgaagtagtgagatctgtgtctcccagataggacccccaaagagaaaatacagaggagaatgtgccacagaggacaggccacagaagtaaagaattaaactatatttcacaattcatttccaccttagtgttttaaaggatgagatgaaggttgtttgttatcatttgcctttaagtgggccctatgctttcatttctgcagtttcgcaaagtttttacatatataaaatgttttacattctatacgtaaaatatttaantatataaatcttgaagagtcgaactaaaaactaaaattattttttgcatattctgctatttcctttaggccctcacattcttagtcctgtttctactgttgtgagtgattttatcctggtactactatcctttttattgtttttcaggataatttaaagatgtcttctgaagatgtaaagagtggagaaagattcacgcaagcatctcaccaggattcttgattttctctctctcctctttagttgctggttgcgcttgtctgagatgattcccaatctgtcagccctggtcagtagctcagtaagcaccttgagaatagctcaagtagatctgtaggacccttcttagaagcagtggttcctcatggagaaacttgtgaggctgttacacattctacacacctaacattattttcaaacaaaaatgataattttcagatgcttgacttttaccaaagatcactggaaggcccagtcctaatgttaggggtttgtttaaagtcctttttattttacaatacagagccccagtcaattccacaatctcaatttcatacatgggaattttatttaaaaatctgtggtttggggctttaatgaattggcctgtgaaaatgagctctaaatttcctcccacgtacactcaaaactcaagattgctccaaatctctaagttcttccagcaaaagatttcttggcatgtatattcacttatacttagaaatattcattcttttaatttatgccagaataacaaagtggaaatcttatttcaaaatgctstttgtttttttgtgtgtgtttctgtagttctgctttctggggtagactagtaaaatggtagcttccagcattttgtccctggggccttctttatagggccactcaaatttaaataaaagtagtaaataatttagctaagtggaataagtataataattatagtggtaagcatagcacatcagcattatgccaacattctagactctttagttgatgtcattaaatggaaaagaaacttggattaaatragtgtgctgctcaccttcccaagttctgttatttcaaacctgtgaactaaccttgcagttcattataaatcaacagtaacaactgcattctaaattactccctgatattattttctagttgtgtatcagcctgtctcctaggggttttcatttccctgaagacatacaagtgccccagagcgcatgtatatgtctaccatttctctatatgagaaggtaaaaaaaatttccttaagcagtgattttccagccagaatatacattagattttcatgggacgcttttataaatgactcaacccttttccccaccccagagattcagacttaattcgttttagatggatctacacatcagtatatatatatttttaacttttcacttgattcttctctgtagccaaggttgagaaccgctgttctaaatcatcatataatccatgctggccacattacactcaaggtccctagggaccaggcatattatcatagtaggtattttccattttaatgtgtaatggagccattcaatgatcaaaaatacactggaccagatagtagactggtcccttgatcagaagcatcagcacatcagcatcacctggaaattgttcccagcctttgtctcctacctactaaattagaaactcttggtgggttccagtaatccatagcttaacaagccctgcagttaatactgatgtacactgatgtccaaaaactgctgtcatggactattgattgtattgaggattagtctcagttggaaagccaactacagaggcattttgaactttctttctttgcctctctatgtctctctgtcttttcctgtcttctgatttatctgtctttctttctctagtaaatggcactcaatataaaagtggtggagtcaatcttaaacttatttttattatgattgtattgatacatgcacgaagtccctctgccctactccctattcaaggatattactcactgcacatcataaatctccatcatctgtcttaaagttttatgagtagatttcatctacattatattcaagttcatttattactgagctgtattactgtggagctctaacagtatttgtttcctgatttcaaactcaatgctacagagcactttgaatacatcacaccttataggaaagatagtaaatgtattaatcccattgaaaaattagttttgtacaatgtgctaaatagtattgcattggattacttttatatttaacacactccatcaaaacatcccataacataattttacaatctgcatgtgaatttaactgtgaaattcagtattgtgatattttgaataagtgaattctttctctgcaaatactatgttgataaaattacttgtatgttcccctgaaatggtttgtttcctgtttcttcattattaaaacataaatcaatcatatgtttacagatacatgtgaatggttctttgtaaataagactcaacttttaaaatctctgtgttcttcccttacaatatttgaactccacagagcagagaagtttcactgggctgtatttttgagtacagtatatgatgtatttatactgaccgtctacactcatatgtgtctttcacacacataagataatttcagggagaaaaattattatcacctatcaccattttataggtaactgaacaaaagctcaataaagttaagtggcttgtctaaaaatcagtcaatctcaggtcatgtgacacaaaatttagaatttttcttatcatatycactacttctaagaagaggtatcttaaatagatactaagatattatatgtgaacatctacttgtttttgtttacttgtagaagggaaaaaaattaaacttcctcagtatgtcctctatcagtgagaagggagttatatttccagctaatgtcaatcaaagaacaaaggagattattaaaatagttcaaaagaaaaataggcaatcaaaggaaatgtaggtagaattaggttttctgcttgtacttcttgagttaagccttttctaagagtgttgtaaatttaaagtacagttgagttccttaatccttctaagattaataattttgccaaaattcttgcctttggaaaaattattgtttgagaaaagaaaagaaagccttaaggaagattcatctattaagtgaaatattccaacagtctcaaggacagcccagaagaggccgctcctgaccttgggtaatatttcctctctgttttctgtaccatttgattatgtcatttaaaaaataattccctgacaccatgggcagcagcaagaggtacaagagaacagggaataaatacagctggaattctttaaaagttgctcttaaactcaccccttttttttttttcctttgcttttttgttctttattctaatagcatgccctgtgacagggaaactaagctcttcaaaataactgaaactaaatctgtaagataaaatgctggaatttgagaaggcacatgccttttgtagttttctccagaaggctcaaggtgttcaataatctgtgggactcaacaatattttggaaggttgaaataccctcatttttaattagggaaaatgcagtacacagaagattcttgggacagagaagccggtgtctaaatcttgccgctttctcatatgtttcctggtctttattaaatatctacttataattaaatattatattagggacccataaattatgtgagaaatctcacagttgttcaggagattggtactaatgagacacagagactttcaaactggtgtaaatgtacctcccaaggaagatgaagcttttcatgggattcactgggaaggctagtttgcagatgcttaacctccgtatgcactttatcttaaaatggacttgagaactagcctgcagtcaatgttttttgtcagtcccccacttttcacaatagaggccaactcttcattcacttaccaagtttactgtgatacaatgacccctagaaatacacaaatcaaaggaacaaggtgaaatatggcataggggaggactttccttcctggaaatgactgggtaacaaatctctctgcaaatcaggtggttttcaattctttgtttacaacaaaattaaatgaagacgtgattgaattgccaactgataagtcattgaaatatttttggtatattatcagcctgtaaattttggcaaatcggaaggagttcaaataggagcattgttgtacaatataacaaaatgacttccattcccatccacttatttatgtgacatgcataattactatatttttatatctatgaaaataaaacagaaagtggaatagaactgatgttgaacactgttattccagcggtaaataatattcgttcgcagacatacaaacaaattaaaaatagaaatcactatcttagatgcatttttgcttttactttttatgtgtaatatttgccaaaatttatagtataaatgttgttttgattaaatgtgtattactaataattgcaatgatagcccagtccaggagagatttaacacatagagtcctatggtcacaagaaattttttaaattaaaatttaatttacataataatttaatggcagataattatgacagatcgagaagtaaaagacttttaagtataaaaatataccgaagtagcataaaaatctgtgggcaaagtggaacggaaatgtaagtttaagaaaataaaaaacgtgagatttttctaacaccaaagtagagcttagcaacatacttttgaaaatggatgtcttaggtcaggttcacccagaaacactctggattagaggtttgtgtgcagaaggtttattggggcatgccctgggaacaacactgtagagaactgaaaaagcagaaatgggccaagaaacaagattgatagagttgtagttgccacagaggtgcacctcatcaaaggggagctctcgaggtgggattgccaaatgcagttgaaggaccaggcctctaagtgcccacaacaggacagtcgcttgatgttggcttcctactcaggagcaagcataatcttggactgggtggtcccttcagtcaaaagcaattcctgtggagaaacttaggtagcataccccaccccaggctgctggaggccgatcatatccactgtgaagagactatcagggtggcaccccactgcgtccacgacatggataaaggtgatatggaattgctatagcattttcatttctttggatacatgtagaaaaaagatacaacaacttcatattaaagcgtcttgttttataaaataatagaagttacatctgtaactacttaaatatataaaaatgtttacatgtcaatataaaaatatatgagggcatatcgtttttcaaaaccctttcagaggtatgtgaacagaaatattgggagtccactagtgtaaaggacaagatgaatagctgagggccatgtttcttgtggcctggcagtcattctgaatcagtagccaaaattttgattaatgtacaaaatttgttttgtctacatactgctaaagtgatgtctgccagtaaaataaatgagtgggtcatccagcttggtgttgctataaggaagaagagtcctagcataatgtctagctgtttctaggaaaggaagtatgcccctctagtgtgtctgagtacaccatcagggcatgatatggtttggttctatgtccccacccaaatctcctctctaattgtaatccccacatgttgaaggtggggcccggtgggaggttattggatcatgggagtggtttctaatagtttagcaccattcccctaatgctgtctcgtaatgagttctcatgaaatctgatagtttaaaagtgtgtggcagcttctcccttgctctctctctctctcctgccaccatgtaatatgtgccttgcttcctcttcaccttctgccatgattgtacgtttcctgaggcttccccagtcaagcggaactgtgagtcaattaaacctcttttccttataaattacccagtctcaggtagttctttatagcagtgtgtaaacttactaatacagggcagttaacggttgtattcaaacaaaatctcactgctaatgagtagggattagctaatttttcctgtaaagaaccaggttgtaaatattaaatgttttaggctttgtgggatataaagttgcaaatattcaaccctgccattttaggatgaaagttgccatagacaatacttacaagaattggaattggtatgggtgtgttccaataaaactttatttacaaagaaaggcaaagtgtcagatttggcctgaggactgtgctctgcagacctcttctaaagtgctttcaacttaataaatagttctgtaactatgaagaataatcctcactctgccacagaaattttaattttcaaaaatgtgccttaaacacaaagatttggaaataactggagtaaggaacaaatgacctttaatctttcagtggaatggatgatttattagaatttgcttctccttttaagactattattttaaaagcttcattttagtcaggttttcaatccttcctttccattcccatcttctctgtcacatctgttagaatgcaaatgtgagatgtcgtgatgaagggaaaaataactttagaattctgacaattacatttcatgttaacacaggctgatttgttcttcaatagaacagtattagccccacgagagaagagatgtgatctgttctggtccacatgcagtcccctgtgccaagagcagtgtctggcacacagtacatgctcaataaatatatggaaatgaatgaatacctgaattgacatacagactgggggagcattgttatatgctgttctaaacatttttaagcccagatttgaatgatgctgatagcatgcatggagtatccgactttgttgactgaagagaaaaactaataattttcataatacgttagagttggtagggacattagatatcacacattctacctgttcccctttatgtatcagactgagaaagcagagaacaagggggtctgaggagtgggttacacattgattagggacaaaaacagaactggaacttctatctttagtctagagcttgtttcgcttcaaaatgctgtttctcattagtcagattttcttttcagagacacagaatcctaatttctaatcaaacatactctctaaaactcagtgtttttttttctgtttgtttttttttagaacagctaatttagttcttgctttgcaaacatggaaatacaagttttcaaatgcagtataaggtgaaacattttggttgtctggatcttagaggtcactgaaattggtcattgaccttttataatccccactgagactttcaaggtcagttagagagagacagtggttattttgcacacatacatacacacacccgtgcatgcacacatacacacctgtgtcattaacttaaagaaaagaaaatctctgagaatgaatggaaactcttcccactgaactaatcataatgttaatggctccctacttagcactgaactctccagtaaaattcaacaaattacaaacctatctaagcatacacaaattggcttaacaaactcaaatctaaattcctgcatattaacggtattggttgtacattagaattttcctgaagagattttttttaaatctctgggggtagaagttgggcataagaacaataaaaaaaaaatcttcccaggtgattgatacgtgcagctaaactttcccaccactgacctcaagtttgaatagctactgtgattaaaaagtagacctaaatgttatttcacaagccaatgtaaatcagtataacacatcttgacccattatgcttttactcttttactctttacttttcctctttttctcctttcctctttaaacctcagaatgccatgaggaaggcactattagcccattttatagatgataaaattgaagcacagaaaagtgaagtgacatattcaagacacagggcaaggaagtatcacagctgatattcagatcaggcaaagtggctccatctggaacaggagttctcaaagtttggtctgtgtaagactgaagggcttagtaggatagaattttctgggccttatccctagaatttctgattcaatagggctgcaagccacctgtaattctgtatttctaacaagtttccacgtgatgttgatgtcgctacaacagggaccagattttgagaacctagaattcaaattgtgttggtaatatggatgtaagctagagtttgagaatgactagtcagtggttctcagcctaggctacacatggagtcctgtgggaagctttaaaaatcctgatcctcattcaccccagacaatttgaatctctggggtaagaccaggacatcaatactttttaaag

SEQ ID NO: 12206 - DNA, 41823 bp, Homo sapiens
  misc_feature (1)...(41823): n = A,T,C or G, or insertion/deletion polymorphism (see Tables 1-2)
tctctactaaaaatacaaaaattaaccaggcgtggtggcgagtgcctgtaatcccagctactccagaggctgaggcaggagaattgcttaaacttggcggggcagaggttgcagtcagctgagattgtgccactgcactccagcctgtgctagacagcacaggctgtctcgggtgtgggggaaagagacaaggtccaccaaaatcaaatatgggttcctgcagattatatggggcagaaagaaaatcaaacatgaaaatcagtgattaagagaaaatcttaaaagcaaccagagaaaaagacaaccctctataattaaaaataaaaaacctttgatgtcttatatgctaaaggctaagaatctccgaagaaatacagtgactcttttcttctaaatatgacttttccagtatacagttaccttgtttaccatgacttcctttatgctaaaaatatatttttgaatcttttccaatgtgatatagtttgactgtgccccgacccaaatatcaacttgaattttatctcccagaattcccacgtgttgtggtagggacccagtgagaggtaacccagtgggaggacccagtgggaggaatcatgggagccagtctttcccatgctattcccatgatagtgaataagtctcatgaaatctgatgggtttatcaggggttcccacctttccttcttcctcattttctcttgccaccgccatgtaagaagtgcctttcaacaaacctgcatgttctacacatgtatcccagaacttaaattaagaaaaaaaaaaaaaagaagtgcctttcaactcccacaatgtttctgaggcctccccagccatgtggaactgtaagtccaattaaacctctttttcttcccagtctctggtatgtctttatcagcagtgtgaaaatggactatgcatctcttactttattattattcccttggttttcaaaaatacgtacttaactggcttttcaaatgtatctaagtttgcttgtgagtataaaagtttccttcccccgtggatcccaggtataaaaaataacttgttaattgaagagttaagaactgaggtggatatatacaatggaatactgcctggaaataaaaaggaatgaatgcattatagagtagccaaaatgatagagacagaaagctgaatggtaggcgccaggggctgggggaagggggttacagtgagtcagtgtttaatgggtacagagttataggaatgcaagataaaatgagttctggagatggatggtggtggtgggtgcataacaatataaatgtactaaatacccctgggctgtatacttaaaaatgtctaggatgataaattttatgttatgtatattttaccacaataaagaaaatgaatatttttagaaaagggaatgaagtactgatacatgctacaacacggatgagccttgaaaacattacagtaactgcaagaaaccagacaccaaaggccacatattgtatgattccatttatatgaaatgttcagaataggcaaatctatacacagaaagtagattagtggttacctagggctggggagtgctggggcagaacaggaggtggctgttaatgggcacagggtttcttttggggtgatgaaaatgttctaaaattgactttgatgatggttgcacaactctgggaatatcctaaaagccaccgaattgtgcatgctaaatgggtgaatcatattgcataactgtatctttttttttttttttgagacagaatctcactctgtcacccagcttggagtgcagtggcacgatctcggctcactacaacctccaccttccagactcaagggattctcccgcctcagcctcctgagtagctgggaccactggcgcccgccaccacatccggctaatttttgtatttttagcagagacagggtttcaccatgtgggccaggctggtctcgaactcctgacctcaggtgatacacctgccttggcctcccaaagtgctgggattacaggcgtgagccaccgtgcctggccccaagaactatatcttaataattctgttattagaaaaaaacaaaaacaaaaaacttgccaggtatgatggctcaggagcacagtcccagctactgaagggctgaggcaggaggatggcttgggaccaggaattcaagaccaatctggtcaacacagcaaaaccctgtctctaaaaaaatatatatatttttaattagccaggcatggtggcatgcacctgtggtccttgctactaggaagctaaggcaggaggatggcttgagcccaggagtttgaggctacatgagcaatgaccctgccactacactccagcctggatgacagagtaagacctgtctctaaaaaataaaataaactgaagtggaacagtcacccagcttctgactagtgaatgatcctcccccttcttccttagtgccatttttaacaagtggcaaaggtcctattttaaaatatgccaagtgtgttgtcttatttcaacaacattccatctcaactgtccccatgtggtcttagttaagttacttaactgtgataatcatcaattctcttcatctatcacccacttcttcctctataaaaagagaacaacaggccgggtgcagtggctcacgcctgtaatcccagcactttgggaggccaaggcgggcagatcacttgaggccaggagttcaagaccagcctagccaacatgcaaaactctgactctactaaaaatacaaaaattagccaggtgtggtggcacgcacctgtaatcccagctattcgggaggctgaggcaggagaattgcttgaacccaggaggttacagtgagcagagattgaacccaggaggttacagtgagctgagattgcacaagtgcactccagcctgggtgacagagcgagagaccctatctcaaaaaaaaaaaaaaaaaaggggcaaaaagcattcttaggaaaaataaatgagctacaaaaagcctctagaataaaaatcataggtgctcattcagtgtttgtagacctaaaaaatgggtctatgcagaataatcaagcaatgaaaggtaggctgccccagaattgtaacattaaccgtggcaaattctctcaagtcacgcctccttgcatgacccctccagaaaggtgaagttttagatttacttttctccttagccacacatctccattcctgtagttatttcatactaacactttcatgttgaccctaaaattcaaattttaccttttatggaaggattaatattttacatatatctccattggacagatacctctatctgaattggaactttttttttttctcattctctttacctaatttcctgaggataatgaataaagatggatttcctgtcttcccttatcacaaattctctggtaccataaaactagagaaaaatctgctcaactgtctatatgcaacaccacctctagaaatccaggaactcaggcactcaggcaggctgggtttttatttatttttgtgctgttttttgtttgttttttgttttgagacagagtctcgctttgttgcccagggtggagtgcagtggcacaatcttggctcactgcaacctccgcctcctgggctcaagtgattctcctgcctcaacctcccaagtagctgggattacaggcaactaccagcacgcccaactaatttttgtatttttagtggagatgggatttcaccatgttggccaggctggtcttaaactcctgacctcaggtgatccacctgccttggcctcccaaagtgctgagattacaggtgtgagcccctgcgcccagcctaggcatgctgtttttattcaatgccttttacatacacaaagagcagctctaagcaaaaaaaagcggggagagtagatctgcaggtcctgatactgaaaattgttcaaaattttctaaattctattaatagtagaaaaagatagtagcaaattagtatagaatataatataatctgtaaaatatatttaaactaatttttgagcttatgactatgcacatatacacatgtacaaatttttaaaatctggaagtatatacagaacaccaatagcagtgggcctcactcaaagggagggattatggggtctatcactgcctaccttccacatttctgtactgtttgaaatttctgtagcaagaatgttttaattttataaccaggacaaaaatagctagaaggaataaaggagaaagttgggagaactacagctaaattgcagaattgtagctctaccatccccttaacctcctatacacatcaccatcacctatagggggccactctgctcaggaacaaaagggacctttctccacaaagaaaaaagacacaattctaatacgctcttctgccctctggagaattccagaataccagagccatgactgaggagaaaaaagaatcccccacaactcaccagagttgccagacattcccagatcacttcctccttccttttgttggactttctttactttctttttaacaggcccatcattttccaatggtctcttctttcttctgtcaatttctgtagcctatatcgggaaggttagaaaatgatgtgttatctctactctgagaaggcctgacgtatgtgaagcaatttaaaccttacaactgaatgacaaggttccttgccatccactcttcaaagaatcctctacttttagctctggaaaaccctatgggtgaactgtttttaacaccataaaagacaaggtagagtctgatagtcaggagcctcagcaactcaagccgtgtttagaattaattgaaaccaaggctgctaccggtcttgattcaatgagccttcagctttctctaattataaaacttgaatcaccctacttacatatgctaaataaaatacctctaagaaataaacagttatgtagcaaaggcacagaggggaaaagataggtaataaaagaacagtatcatttttgacatgttcattgcaatttaagtgtttcctgtttaaaaggtttatgttcatcactaaagatgtgacaagattatgaattttttcttggcagaaaacttgccaaaagcatacataagtccttcaccagctaccctttaaatggtgggtgcaaaattttggtgaattcatgaaaacgtagctcgtcctcaaaaaaaacagaagaggagtaatcattttaagggagaaatatatacgaaaggaacaagattttgaagcacccaagctgccacctacattaaaacacggtaggtggctaaacaccagtcttcaatgcccttccacagcctcaatctgaaaaatactgtgcaggtgacccaagtgaggggtcacccttgggcttttcctgtggcagtatctctggtttaaaaacaaacaaacgtacttattgcgttgaaggatggcaacaggaaggactccatgattagtcacatctataccatcctaagaaactttatccacccaaactgtatttcagactttataatctaaactacaaaaagagttcactggggaactgcacaatatgactgcttttaaccgtagtgatttcaaatattgagccatgctgttgcagtcttaaaaactggagacctaagggcagctttcttctagtcacccaatccagcacttttttaaaaaatcagtaaaactcttcgaccaccaaggaaaaaaaaaaaggatggaggttaaaagacgcaccccttgcccacaagccccctcatcagaatgggagtcaggagacctgagttcctgtctcaggcctgccattaaaaacctgcataacctttgcctatctcctcaaacggaagtactaaaacctcagcgcttcacccaatttgtagccccggctgggctcttcccaccttccccttcttcagcccgccccttcctcctccagccctatcatcgggcggagggtccacgcctccgcccgccttacccacaagccccgcccccccagccccgatggccctgcccagtcccagacagaacctactaygtgcggcggcagctggggcgggaaggcggscgctgsggscgctgcrgccgctgcagcgccagggtccacctggtcggctgcacctgtggaggaggaggtggatttcaggcttcccgtagactggaagaatcggctcaaaaccgcttgcctcgcaggggctgagctggaggcagcgaggccgcccgacgcaggcttccggcgagacatggcagggcaaggatggcagcccggcggcagggccyggcgaggagcgcgarcccgcggccgcagttcccaggcgtctgcgggcgcgagcacgccgcgaccctgcgtgcgccggggcgggggggcggggcctcgcctgcacaaatrgggacgagggggcggggcggccacaatttcgcgccaaacttgaccgcgcgttctgctgtaacgagcgggctcggaggtcctcccgctgctgtcatggttggttcgctaaactgcatcgtcgctgtgtcccagaacatgggcatcggcaagaacggggacctgccctggccaccgctcaggtatctgccgggccggggcgatgggacccaaacgggcgcaggctgcccacggtcggggtacctgggcgggacgcgccaggccgactcccggcgagaggatggggccagacttgcggtctgcgctggcaggaagggtgggcccgactggattccccttttctgctgcgcgggaggcccagttgctgatttctgcccggattctgctgcccggtgaggtctttgccctgcggcgccctcgcccagggcaaagtcccagccctggagaaaacacctcacccctacccacagcgctccgtttgtcaggtgccttagagctcgagcccaagggataatgtttcgagtaacgctgtttctctaacttgtaggaatgaattcagatatttccagagaatgaccacaacctcttcagtagaaggtaatgtgggattaagtagggtcttgcttgatgaagtttaccagtgcaaatgttagttaaatggaaagttttccgtgttaatctgggaccttttctcttattatggatctgtatgatctgtatgcagttcccaaggttcatttaccattattaaaaaatttttgtcttagaaattttatgtatgtcaacgcacgagcaaattatcaggcatggggcagaattggcarctgggtggaggcttcggtggaggtkagcactccgaaaggaaaacagagtaggcctttggaacagctgctggaagagataaggcctgaacaagggcagtggagaagagagggtaaaaattttttaaggttacatgaccctggattttggagatctsgaatttaaaggtsatgcaccagggatgaacgctcagattttcagtttgaaagctggcgtgacatgtaaaggagtggagaataatgtaccattgtaatgatgaggcgcctctaggacatctaggataatttcaggcgtggggatctaggtgaattgaactgttggagggaagggaataaccaaggaaaagaatgtgggggttgagagatgccccgtttaaaacctaagagacctggatatttatggttgtaagaggaggcatggcagaggaaatggaaacagtaagaaaggagcagatgctgcatctctttaatgggacagatacaaggcatttgggtttgacacttaggtcactggtagagatgatgacaagagcccgtagctaaagaattgataaaagccagtctcaaaaatcccaatatagtctggtaatgttaatgtttctttggttcagatagctgactctcaaagttattttcctaagaaactgaaccaaaagtggacgctatatgtaaaaagtttttatagaagtgttataagagtaggatagagacataattaaacatgttttaaggtaattgagtggaacattaagcacctatttttaaaagtatgatttaatatcaatctacaaagtacacaaatataatacaattgtatcagacagttgtgacagcactgattagaggctgaacattattctaagtctttaattcccacaacaaccctagaagcaggaactattgttatctctattttatagataaagtaaaccacaaggggttaacacgwtttgtcttgtggrtgacaaaatgcattcaacttgagcactttgactcagaatctttttttttttttttttttaagagggagtcttgctctgtcgcccaggctggagtgcagtggcgcgatctccgctcactgcaagctccgcctcccgggttcacaccattcttctgcctcagcctcctgagtagctgggactacagacgcctgccaccacacctggctaattttttgtatttttagtagagayggggtttcaccgtgttagccaggatggtctcgatctcctgacctcgtgatctgcccatcttggcctccccagaatctttactatgtcatacacaattgcaaatgattaaaactaaatattggatataaattggataatgccaaagggaaaaatagttagatttaggtaatgagtgataagtatgaattttggtaagacttttaagttcagttttttaaaggagatctctgccaaaccccaaaaacaaagagccctaacatcagcctaaccagatttcaaatttcatcttttggcggtatgcatttttaacagtcacccctcaactaacacatcatcctccctcaactcmcattctactaaccccatcaatgcaactccctgcccaccttactcaacatatacaccrctgctagccccataccccgaaccaaccaaaccccaaagacaccccatatggtttatgtagcttacttcctcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccctaaccgtgcaaaggtagcataatcacttgttccttaaatagggactgtatgaatggctccacgagggttcccctgtctcttactttcaaccagtgaaattgacctgcccgtgaagagacttttaagttcagttttttaaaggagatccactaaatgtcaggatgtccatcatatctatgcacatagataagtcctcaatgtcatctgtgagttcttggaaactgtgactttaagtgaaacaatgtakagcaaaaccaattttaccataggctactggatgtacacaagagttaagttcctagggcatattgctggtcacaaaaacatcaccaaacttctaaatgaaggccaaaaacacttctaatagaaaacactgaagtaaatatgagctatacatacatttaagaagaataatgtgcatgtctttgggatgtggaaggaaactggaatacctggagaaaccccatgcagacatgggaaaagcatgcagactccacacagacggtggccctggccaggaattgattatttttctcatcaacgttagaagaaaacgatgttattcaaggacatgttgtatataaatacatgaaaatatatgtatattcccaaaatatacttaggctttctttgtgattttataggtaaacagaatctggtgattatgggtaagaagacctggttctccattcctgagaagaatcgacctttaaagggtagaattaatttagttctcagcagagaactcaagtaagtaccttaacataaattcaccacaagaaaatcatgtctcatagtggagatcagtatatgataaratgaaattgtataaaaggagctattgatgaagctgcttaatatcacaaaggtgattatagaaaattaataagcagttatttatactacatgacaataacttattctactacctgagtaattgatttcatcaccttgaaaagttacattaaacattaaatagctcactgtggtatcagatttgcaagttatcttgaaccatcattcagtaggcccaaatataaattatacagtgtaatcaataacctgtagtttcacataaagtcaaaacaactattttttgggacttgctaaaattaagtgatgatcccctttctggacccaaccctaaatgcaatmaaatgtgaattttaggatgggctgaaatgggtcataatcttctactctgttattcctagttaaccacaayacccaataatattttgtacttaacattcattacccagtgtctgaaggtaaaacatttcaaagtattgaaatggttctagagatcctggagagaagcgggtatctccagttagcctctgctaagaattttcctgtcctccaacccagggttggagtcagtagttcatgaagcctggatatgccctggtgactggagagtgggaggggtaatcatattaagactgcccaggaagtcaactccaatggcttgggaggttgaggggtggccagaattggacctgtgttaatccattctcatgttsytataaagaactgcccaagactgggcaatttgtacaggaaagaggtttaattgactcacagttcctcatggctggggaggccacaggaaatttaaaatcatggtggaaggggaagcaaacgcatccttcttcacatggtggcaggaaggagaagtgccgagcaaagggggaaaggccccttataaaaccatcagatctcatgagaacttaactatcacgagaacatcatggggggaaccaccccccataattcatttatctccacctggtatcacccttgacatgtggggattattacaattcaaggtgagattttggcggagacacrgccaaaccatatcaggatctaaggggaaggtctgggatctggcatgttaatcattcttagtctaataatataatcaccaaaaagaatgcagtatcctagggcactactttcttgggaacagtagtcatagtattcttttcccatgtgtattggtgaagattcaaccaaagaagcagaaccagtagtagatagatacaggtatattaaagagttttattgcgaggaattggcttacacaattatgggggctgggtacgtgagtccaaaaatctgtaaaacgggccatcagaaaggacaagctggaattctccagcaggggctgaagtgstacaggtgaaatttcttcaggaaagcctcaactctactcttaaagcctttaaactgattgawtcagcccactcagattaaagtctgaccgggcacagtggctaacccctgcaatcccagcactttggaaggccaaggcaggtggatcacttgagctcaggagtttgagaccaaccgtgcaacataatgaaaccccgtctctacaaacaaattagccaggcgtggtggcatgtacctgtagtttccaggaggcagaggttgcagtgagccaagatagtaccactgcgctccagcctaggcaacagagtgagatcctgtctcaaaaaaatttaaaaaaaaaactgaattgtaatcacatctacaaaatgccttcaaagcaacacctagatacagtatctgaataaccaaggactatatcctagtcaagtttaacactatgggaaggaaagaactacacagctatataggctaaggggattcaggcttacatagattttctcccaagttcttcctagaatggcataggtaaaaaccgagaagaaagtgtatagaatatttgcattgattgcctctgggcgacggggcagatttgttgatgtgcatcttgctgcctgcttccatcttcatgctgttctttcttctggttgctaggatgctctgattatctctttccttggtagatttcaaattcacagactatatcgccattccaagaaactctttaatgatatttttgartactactcaagtttgtttatggctagcttaagctcamacagaaagaaatctcagtgggggagatgttcacttgagccagcatttctcctcgaatatgatgagtgtaatttttttttacgaccttcctgtgatgcatgtaattgggtttggttgcttcttctgtatttatatataacatatgttggtgtcttgtgctttttttttttaaggctgagaaaatttaaagtctttgttatcaagcatgccagggaaatagtgataccagttagtaaaaaatgttagagctcttttttgttgttgttcttccttccacttccttacttgttggtcagtcccacacatatagtgaacagctgctgagtgccaggcactgcagggtcctgaataagagggcagagatttatacatggaaatcacttgcttatgccaactctaaagatacttcatttttcacccctctcccccaatgtaagaagaaactgaatcctcaaagtgatcacaaaattttctaccaaacactatagtaatttagggtaaatatttcttaagtaaggtattgagggaaaatgcttttccaaagttgtctagacagtcaagttgtggctttaaaagaacttgaggtgagaagggtgggaatggccactgatgagtacagaatgttttcttttttggtgtgatggaamtgttctaaaagtagataggagtgatgcttgctcgactctgtgaatctactaaacgtcactgaactatacactttaaaagggtraatgttatggtgtgtgatttatatcaataaagtggcttttaaaagtctttggaaccagccgggcacagwggctcacryctgtaatcccagcactttgggaggccgaggtgggcagatcacgaggtcaggtgttcgagaccagcctggccaacatagcaaaaccccgtctctactgaaaatacaaaaattagccaggcgtggtggcaagcacctgtaatcccagctactcgggaagctgaggcaggagaagctcttgaaccaggaggcagaagttgcagtgagccaagactataccactgcactccagcctgggcaacagagcaagactccgtctcaaaaaaaaaaaaaaaacctcgttggaaccaaaaattaaataaacaagttttactgtaatgctatagtagcctggacaccatctttagaaaatccaaaatkgcctccattatgtaagatttaaatagtctcccatccacgaaagttaacttaatttcatgttataattttttacgatctcactatcagaatctccacagtgattaaaacttcttgaaggtgcagttctctctccccctaccactcacacacttggagtagcaaacactgacctggtttctgatgtctactatggcacctaataactttgtgactttaggcaggttacaagtaagccttgttgaacctctttccttacctattaaatgagatgaataatgacaacttttttgggtgattttgaagactcactgaaattttgtatgtaaagtttctggcacacagaagggtatagatatcagttcctacccccacccccataaacttgctactttatatcttatagaacatacacattaatattaatattaatgaaatcacagtgaacagactcatgatctcattttcaccttaacatattactttgttcttgtttccctccatcttgagacaaaaatccactgccacctaaatcaactctctcatctcccctgacttgattctggattcctttttttctatcttcaccttgctctgctgtcccaaccttttagtattatcaaaggcaaaataaaaattttgcgatgaattctctaaatttaacattgtgtttgggaagaaaaaattgcagtttagggcatacatgcagacaagtgaccttccatatgtctgaagaacaaagggaaggttagaggttttatttaaaaggagaaatgttactgctctttgagaaagttcattggcactactaaggtttgggggagctagcaagctccgactggcgagcagtgagtggtgggcaaaatcagttctagagttgcagcaagttatctcagaagctatagataaaactggtttcaggttacaacaagcagttccagcagtcaggcttacagagaattacattcttggagcaatgttttataccctgagtgcttttttcccctggcccctcaactctgatttagttgggtatgacaagaatgacccactgtcacccaggccagagggcagtggtgtgatcgcggctcactgcagcctccacctccctggctcaagcaattctcctgcctcagcctcccaagtagctgggataacaggcatgtgccaccatgcccagctaatttttgtgttttttagtagaaatggggtttctccatgttggccaggctggtctcaaactcctgacctcaggtgatctgcccacctcagcctcccaaagtgctgggattacaggcgtgagccaccgtgttyggcctaccctgttttaaacctcaccatagtttacttttcttctaccctcaactttctcagagctttcttgtattaaataactttagtatgattaaaataaaattctatactacactttggttgtagtctgtcatgcctgtgcctttgcacatgtttttatctcctttgacactcagttaaggagtcatgccctgaggagtattctccctcatcaccccrgccctgcgttcctgtatagcgtcctctgcatgtcttcgttgtatgtcctttcatacattatagtcactgctgagatatttctgactgctatcacaatctctttgagttcagggactgcatattttatctctatccccagaatctagcataacccctagcaaagtaggrattcaaaaatcacagaatgaatagtacataggtgatttataaaaatagaaccatcccacatagtaccactttgtaacccacctctttttccctcaatatattagaaaataaagtcctgtaaatatttttagtggctgcatagtattccattatgaggctggatcatacccaatttttaatatgagcatacctcagagacactgcaggttcagttccagaccactgcaataaataaagcatatcacaatataggtagtcacataaattttttctcagtgcatataaaagtyatatttacactatactgatagtctaatagatgtgcaatagtatatctttaaaaaatgtatgtaccttagttaaaatatgactggaaaatgctaacaatcatccgagccttcagtgggtcataatcttctcactatggagtgtcttgccttgatattgatggttgctgactgataaaggtgatgattgctgaaggctggggtggctgtggcaatttcttaaaacaagaatgaagtttgccacattgatagactcttcctttgaagaaagatttttctggagcatgtgatgctattttataggattttacccacaacagaatttctttcaaaatgggaatcagtcctctcaaaccttgctgttgctttattaacttagtttgcrtagtattctaaatctttcgtgrtcaacaatgttcacagcatcttcactgggagtagatttcatctcaagaagccagtttctttgctcatccataagaagtaattccttatccattgacattttatcatgagattccagcaattccatcccatcttcaggccccactttttttttttttttttttgagacggagtcttgcctgtggcccaggctsgagtgcagtggcccgatctcagctcactgcaagctccgcctcccgggttcacaccgttctcctgcctcagcctccctagtagctgggactacaggtgcccgccaccacgcctgctagttttctgtattttttagtagagacagggtctcactgtgttagccaggatggtctccatctcctgacctcgtgatccgtccaccttgkcctcccaaagtgctgggattacaggcattagccaccacacccagcccaggttccacttctaattctagttctcttgccatttccaccacatctgcagttatttccacccccraagtcttaaacccctcaaagccatcatgagggttggaatcaactaactccaaactcctgttaatgttgatattttgatctcctatgaatcatgaatgttgttaatgccatctagaatagtgaatcctttttagaaggttttccattgactttgcccagatccatcagaggctattgcagctacggccttacaaaatgtatttcttaaatagtaagacttgaaagtcaaaattactccttgatccatgggctgcagaatgagcaggaatattttgaaaggaatcttccttcctgagaagtaggtctcaacaggaggctttaaatatytagtgaaccatgctataaacagacgtgctgtcatccaaacttcgttrttccatttctaatacacaggcagagtatatttagcgtaaytcttaaaggccctgggattttcagaatggtaaatgagcattggcttccactgaaagtcatcagcttgcattagctcctaacaagagaatcagcctgttctttgaaactttgaaactaggcattgacttctcctttatagctatgaagtcctagatggcatcttccttgaatagcaggctattttgtctccaytgaaaatctgttcttagtgtagccaccttcatcaatgatcttagccagatcttctggataaacttgctgcagcttctacattagcacttgctgcttcaccttgcacttttttcttatggagacagctttttccttaaacgtcatgaaccaaacccttgctagtttcaaacttttcttctatagctttctcacctctctcagcctttacagaattaaagagggttaaagccttgttctagattgggctttggcatraggtactgtggctggtttgatctatccagaccactcagcttcctctacatcagcaataaggctgtttgcttttytgtttttgtttttgtttgagacggagtctcgctctttcgcccaggctggagagtgcagtggcgtgatctcagctcactgcaagctccacctcctgggttcacgccattttcctgcctcagccccccaagtagctgggactacaggcacctgccaccatgcctagccaggcatacacttttttgtatttttagtagagacagggtttcactgtgttagccaggatggtctcgatctcctgacctcgtgatccgcccacctcggcctcccaaagtgctgggattacrggcgtgacccacygcgcctggccaagctgtttgctttcttaccattcacattttcactggaatagcacttccaatttccttcaagagcttttcttttgtatttacaacttggctgttagatgcaagaggcatggcttttggcctgtcttggctttgatgtgcctccttcactaagcataatcatttctagcttttgattttacatgagaaatatgcgactcttcctttcacttgtacgcttagaggccattgtagggttattaattggcctcatttcaatattgttgtgtctcagggaattgggaggccagaagagggggagagaaacaggaatagccagttagtggagctgtcagaacacataacatgtatcgattcaccatcttaaaagggcatgatttatggcaccccataacagttacttgcaacagtaacagcaagatccccaaaacgtattttaataatgaaaaagcctgaaatattgtggaaattaccaaaaggtaacagagatagaaagtgaacacatgctgttggaaaaacttcaccartagacctgctcagtgcagggttggcacaaaccttcaatttgtaaaaaagaaaaacacctttatatctgtgaagcacagtaaaatgaggtatggcttagtagggaaccccatttttaaaggctcagtatgaagggtcttaaattgargatgtatttttgcrttctggttaagacactattccatttcagggttttttgtttttaagtggtttcccaacactcctcagggaaattgagcaagaattccatcggcagtcctcacatcaggaacagtgaaaaaggataatgtttatatggcacccgagataatcagataaggccagaagacaagagtcagagggttctgcctaatctaagccccaccatcctgatgttwaagggcccctgaatcggaggaccctgccacaggcaccaactgaagtcttttgtccatgtaacaaattgcagctcaagtttcaaagtcaaatctgttggagttcaactcggaggtccatcatttcccggctgtgtgaccagtagtttcttaaccattcagcctcagtttcctcatctataaaaaggaatgatagtaccacgtacaattgccagttaaatgcagtgtgtacattatctcatttagtcttcatgcaaaccttcaagactcaatcacaaagaaatgtccacacatttcttaacaaagaatacatatgctactacataccaactctcctttgtcagggaatccaatctagattggtttaaaataattataggaaagraattcagcagtgaaatatgtgactatattggatgcttgctatttgtcatttactgtatttctagcgcttgtgccaygtaagggctgatgaactcaaacmgtagctcagctttttgcatgytcttttttacccacctagagrtccagtgtttcctgtgatacttacctctaaactgctaaatagccacattttacggaagcatattcttcatacctttgctctaacttaaatctctaactttgcactatatttaatwtgggttttttggggggaaggggggagtggagttggttttttttgagacagagtctcgctgtctcgcccaggctggagtgcagtggcacaatctcagctcactgcaaactctgtctcctggattcaagcgattctcctgtctgagcctcccaagtacctgagattacaggcacgtgccaccacacccagctaatttttctatttttaatagagacggggtttcactttgttggccaggctggtctggaactcctgacctcccgtgatccgcccatctcagcctcccaaagtgctgggattacaggcgtgagccaccacrcctggctaatctgttcttcactttcttttctatactcactacaaaaaagggcaaggaagtcttcacagctgcacttactaacaccgtcacggctctgttttggccatcatctgtttattaactaaactctcttctctcccaactccaaatctttgtttcttctagattgagttctctccctgaagagcctaatccaacctggtccctgtaactgccctgataccttaggagatacctgggcttatttaacttctctctggccaccatgtctttttccagcctgagtcaaagtatattctttgctctaacctaattcttttaagaatgacmgagtaaaataagtaaaatttatatgaggagggagagggaggaggcaatcaagagaatgaatagtccctattcttgattaatccttattataactatgagttcaagggcaattatataatcttgttaaagcaccaggctaaaaacttgacatggaattgtaatttctgttgtgtatctaattactatgaaagcctagttctacctgtttcatcatttataaagggaattgcaacccccaccacgaccaacaaagtagtttcagagattgggagrgactaagctagtcaatgtaaaccaagcttgtccagcccatggcccgcaggcctcagtgtggcccaggatggctttgaatgctgcccaacacaaattagtaaatttccttaaaacaygcacagatctttttttttttaaagctcatcarctattgttaatgtttgtgtattgtatgtgtggcccaagacaattcttcttccaatgtggccaagagaagccaaartattggaccacccctgagtaaacactgaaattaattaacttcttcccttttggattttaattacataagtaataataagctcattttttaatacttcacccattcctgtattgtttgaaacataaatcctttccccattcccaaaggtaacaacatattaacagtctgaatgtcattccargcttttctgcagtcattcaaacatatcactctttttctaatattaggaaaatcttcacacatacagaaagaactttacagtaaactcaccacctagatctaccattaacattttactctactagtttcatcacatttcatccatcaattggtcttgttcatttttgcatttcataataaactgcagacattagtatatttccacctaaatacttcatcattcataccattaatgattcagtcttggccgggtgcggtggctcacgcctgtaatcccagaactctgggaggccaaggcgggcagatcagcaggttaggagattgagaccatcatggctaacacggtgaaaccacgtctcttctaaaaatacaaaaaattagccgggcgtggtggcaggcacctgtagtcccagctactcrggaagctaaggcaggagaatggcatgaacctgggaggcggagcttgcagtgagctgagatcgcgccactgtactccagcctgggctacagagcaagactccgtctcattcataaataaataaataaataaaatgattcagtctttctttacagtttttttctgaagtaaatattacatgagacacamgtcttaaatgtacatttgctaagttttgataaatgtatacacctgtgtaaccccagccctatcaaagatacagaatattacctatcacccccagaaagttctctcctgccctgtccaagttaatctttatcccacccctccagaaataactactattctgatgtttttccaccagagatatcacaagatatcacatggttttrtgattcattgtgaaccacagatgtacaaatataggttaaattattggtcagaggccatactgatgttaagtgctttttgttgaaaggattcatrtttatgatgattttagttctatagtcactgcatcttagtcagattatttgactagtatggatggattttacaaacattttgtggaattctttttttaaccttagggaacctccacaaggagctcattttctttccagaagtctagatgatgccttaaaacttactgaacaaccagaattagcaaataaagtagacatggtctggatagttggtggcagttctgtttataaggtaagtgtagttgttggtaaataaaaacaaatgttctgttctactttcagcttccttgccatttaaaggaagtggaagaaacaggtataactcattgtctgaacctttaaaaaattaagccatgcrtataggaagcagcacattatctgtactgtaaattatttgttgttagttgaaattatttgttgtttgatactatacaaactaaatagaaatgcaaaaataaatattttagtctgtatcagccttttttatttattcatttatttttgagacagggtcttgctttgtcacccaggctagtgtgcagtggcactgtctcactgtagcctcgagctccaaggcccaagcaatcctcccacctttcctcccaagtagctgggattataggcacacaccatcgtgcccggctaatttttgtatattttgtagagtcaggattttgccatgttgcccaggccggtctygaactcctgggttcaggcaattcacctcccaatgtgctgggattacaggtgtgaaccaccacacccagcctatttatctttttaattggcaaataattgcatatatatatatattawgtacaacaygttgttttgaaatgtgtatacattgtagaatggctaaatggagctaattaacatgtattacccacttattttgtgtggtaagaacacttaaagtctactctcttagcaattttcaagaatacatttgttattaactaaaataatagatgttgtacaatagatctcttgaacttactcctcctatgtaactgaaattttgtatcctgtgaccaacatctccccaataccaatctactttcaaatcaaagaataattgatgtttccaatttaaaatccattctaaatcttttcctgagaattgtacttgcattgcactggtttctactccctgaatgtaccctagatacactgagttatgcctttgtctttcaggatgaatatatctcttactgagaaagggttggggctctcagttgatatacactaactagatgtatatgaatttattacaagtagaaaacttcttcaaccaatttttttttgttttgtttttgtttttttgagatggagtctcactctgtcaagactcagtcgcccaggctggagtgcagtgacacgatcttcggctcactgcaagctccacctgccagattgacgccattctcctgcctcagcctcctgagtagctgggactacaggcgcatgccaccacacctggctaatttttttgtatttttagtagagacggggtttcactgtgttagccaggatggtctcaatctcctgacctgctgatccacgcacctcggcctcccaaagtgttgggattacaggcgtgacccactgcgcccggccaatatacctcttttttaataccaaatgacttccagctttaaaatttttgaggataacaaatagaattctttgccttttaaaacaccaatgaaaaattaacatttatgaggaggaagaaaaatctagtttctgccatgtgggtggtcttgtggtaagatatatacagtgaaattattttagaaagaagaggtaggccgargcctgtaatcccagcactttgggaggccraggcgggtggattgcttgaggtcaggatctaaaaaccagctgggccaagatggtgaaactccatctctcctaaaaatacaaaaattagttgtgtgtgggcgcgggcccctgtagtcccagctacttgggaggctgaggtgggaaaatcacttgaacatggggggcagaggttgcagtaagctgagatcgtgccactgcactccagcctgggtaacagagygagactctgtctcaaaaaaaaaaaaaaaaaaaaaaamctctcagtttcttgggctcctgtttctagaacctcttatkttccccatttgtaatagaagaaaagggacattttttcttgatatttttatccaagtatgaatttcttctaagaaaacaagttatttattttgttcagtgcctaccacactttgaatgattcattaccatagtcacttgaaaatgtattctttaagcaatataagtacgtaaatgcctttatataatatgataaatctacatatagataaataggaagtagaaccttcgaatggtatttttacacctgcctcacatcacaacagcttgtagatatcattcaggcttatcttcctatgggccaaatcggacctcccagcctgtttttgtaaagaaagtttcagtggaacacagmcccacccattcattcagttctgtctgtggcctgcaaaggtaggaaaccctatggccctcagagcctaaaatatttaccatcactccytttacagaaggtttgccttgtataatcaactttttttttctttttttttgagacggagtttcgctctttttgcccaggctggagygcaatggtgcagtcttggctcaccgcaacctccgcctcccgggttcaagtgattctcctgcctcagcctcccaagtagctgggattacaggcatgcgccaccacgcccagctaattttgtattttaagtagagayggagtttctccatgttggtcgggctggtctcaaactcctgacttcaggtgrtccacctgcctcggcctcccaaagtgctgggattacagacgtaagccactgcacccgacttataatcaactttaatgcagracttcaccaccacagtcaatctaataatccagacagctcctaagtgactaaggggcaggtaacatagacagcatgtgcaggacaaagggataattcacgccctaggcaggacagagcagaayggctcaagatttcttcacactacttagaacagcatgtcatttaaatcttatgaattatttctggaattttccagttaatattttcagaccacagttgaccatagataacaaactggraagtgaaactgcagataaggggggagtctgcattccactttttaaatttttggtacagtaagaattagtagagcatctatttggttgtagcaaagataataaatgatttaatataaaatgatatattgaaaataaaaagtgaaatttgttctgtacccttmkttggaattttaaaaataaacacttggatttgttgtgtgtgtgtgtgtgtgtgtgtgtgtatttttcttttctataaactatttgagatcaagaattactgctttgttagaattgcaattaagacatactttttatgaatgagaattttaatacactcattctagggcaactttttctgtagaaattatcaaccatattttaggcagtagttagaaaagtcatgtacaatataaagccaaatgttaatacaattgttagcaccaagaagcagaaaaattayctatctactagcattgtaattatcttstgagaattggaagcattacraaattttatgtatatgtattaagtatgctcttggggttttccatagtcaaggtctcattaaattgtactatcttattcatacaagtttatgtaaatttttctatggagagcaactagataatttggggctcttaactctaaacagccaaagggaaaacaataaaagagaatgcttaaattaaaaagttcttgtaagcaaactggaggccagactatatttaaactcagtctctcataattattgataatggttagtgtcattctcaatataactaaggcatactttgcagcaccccagatgaaagaatagtatattttaataatatgctttggcagcaccaagcatatttttaatacctagtataaacttaactaaacataaatcttagagtttctttgtcttttgacacacattaagaaaactgatgttgttttatttcaaaggaagccatgaatcacccaggccatcttaaactatttgtgacaaggatcatgcaagactttgaaagtgacacgttttttccagaaattgatttggagaaatataaacttctgccagagtaagtataaggttattaattagtctgaagcactttggatttcctgcttaagactatagaaaataacatgtcttttcagactacaaattgggttcactgtgtactgctaggatgatgggtgcaccaaaatctcacagatcactactaaagaacttactcatgtaaccaaatacaacctgttccccaaaaacctatggaaataataaattaaaaaaaaaaaaaaaaagcttggcacagtgactcatgcctgtaatcccagcactttgggaggtcgaggcaggggcagatcacctgaggtcaggagttcaagaccagcctggccaacatggtgaaaccccgtctctactaaaaatacaacaaattagctgggcatggtggtgcatgcctgtaatcccagctacttgggaggctcaggcaggagaactgcttgttcctgggaggcagaggtcgtagtaagccaagatcacgccattgcactccagcctgggcgacagagcaagaccgtctcaaaaacaaacaaamaaaaatattaagtattttaacacctgagcatgtgatgtctttccccttgtttaggtcctatttcgttcagcgatgttttatacctttcagtgttaatttcatacttatgtattctattccttttgatgctattgtaaatggtattttctttagtttcagactgtttattgctagttacagaaatgcaaatgatttttgtttattgatcttgtatcttgcaaccttgctgaactcatttgtaattctgtcaatagattccttaggwttttctctatacagtataatgtcatctgcaaatataggtttacttcttcctttttaatctggattttttctttgcctaattgccgtggctagacctgccagtacagtgttgactaaaagatagcaagagcagacttacttaycttgctcctaatcttagaggggaagcttttctctctcatcaagtgcgatttaagctgtgagtgcctttatcacattgaggaagatcccttctgtttccagtttayttagtattttttatcatgagagtattatacattttgtgacatgctttttctgagtctattgagatgatcatgtggtttttgtcttttatactaatattttaatgtactattaatatggtatatcacattgattttcatgttaarctaatgtttctgggataaattctacttggtaatggtatataatcctttttatatgttactgggcttaggttgctagtattttgttgaagatttttgcatttatattcagaagggatgatttatagttttttttgttttaatgccttcccctggttttgttatcaggataaaagtgacctcatagagtgagttargagatgttctcttcccttctgtttttttgaaagagtttgtgacagattgttagtacttcttaaatgtcttagaaaattttaatagtgaatcgattgagakaggaatayggaaattgctccaaagtggagattctaaacaaggctatgggagaaagcaaaaaactcttccattgcaacatttgatggtcatttgtactttcaggcatgtactaacataacatcataacagcctctttaatggaatggagggaattctctaacgggagacctagagtaagtcagtccttcattctatggagaaaaaggaaacctgtgaagataaagtgaatatactttgtccctggaaaacacattgctcagttctggagcggctttctctccagatctctgtgcgctggggaacttagatttgctttctactgtcyaaatataaactttggtcattctccacctcccctatccctttccccacagctactcacttagtttaagtcccgttgtctctatcagttaacctcttgtggttatataggtttctgttcaaacataaagtcttttattaacaccattcttcccgatttaaaaaataaacagactaatatagtgaaatacagatgaaagagagaacttgtgagacaagaagagaataaaattagaatgtggaaggagccayaagtgatgggagccagagcagacggtcatattaataaagtaaggtggttttactttgtgtctgccgtcagctctgtacgtcattgtgcagtcgatttttcaacagcactgtgccagcctatcctctagggctctgctctcattcatcttgcctggaagaaatctttctcagactatttcacactagaccccaaccaaaccagcaggcccagatattttatattggcagttttctacttaatgagccccaaacaggcttttacttctagttaacaatcttctgtgtgaccacatagtcaaagagaagacagattaaaagaggcctgtggaggcagtagttggctccagagctgggacagatgccccttatcagtggacaccttgaagtaggttttggatgggctgatgtttcttcttctgaccctaaaacttcctgtcaggatgctggcatactcgtccacatgactcggatatccctttgctcctgagcctgtgcttcctgtagagtcttgattttaattgtattttggttttttggtttattttttgtttttgagatggagtcttgctccgttgcccaggctggagtgcagtggcacgatcttggctcattgcaacctccacctcccaggttcagcgatkctcctgcctcagcctcccaagtagctgggattacaggcacgtgccgccatgcccagctaatttttgtatttttagtagagacagggtttcatcatgttggccaggcttgtctcgaactcctgacctcagatgatccgcccgcctcggcctcagcctcccagagtgctgggattggaggcatgagccaccgcacatggcccaaaaacttcttgatatgttgcttttgtcttatgaactgacaatcttgacacttgagaattttgcacaaaaaatgtatgtagatgttacttttcatgactcattccagagagactaaaattataatagaaaatggttaatagaaacattgcttcttcccctgaaatataaattattccagaaagtatctttttcttttccctataattttgttacattgtatctctgtttttgttttttttttaccaaaaatgcataatctctaattagtcagcaaaggttaatgtctattattactcagcaatgtattgaatatcatgagacttaaaagtttactgtgttgtccctgcctacaatgagtttaaaaaatagagaaacgaggcgggcggatcacgaggtcaggagatcgagaacatcctggctaacacrgtgaaaccmcgtctctwctaaaaatacaaaaaattagctggatgtggtggcgggtacctgtagtcccagctactcgggaggctgaggcaggagaatggcatgaacccaggaggcggagcttgcagtgagccaagattgcaccactgaactctagcctgggctacagagcgagactccgtctcaaaaaaaaaaaaaaaaaaagagaaatgaaacaaaccaataatactagtaggcaccatttatagaacacttgatrtgttaggcacratgctacattcttttttggttttgggggatgggggcggagtcctgctctgtcactgaagctggagtgcagtggcgccatcttggctcactgcaacctctgcctcccaggttcaagcaattatcctgcctcagcctcctgagtagctgggattacaggcacccgccaccatgcccgggtaatttttgtatttttattagagacaaggtttccccatgttggccaggctggtttcgaactcctgacctcaagtgatccactcaccttggccttccaaagtgctgggattacaggcgtgagccactgcacctggccaacaatgctacattttttacaaggatgaagactttattgacagccaggctcggaggcatgtcacacagcagaaccagagtgaagcacagtctgattcaagcaggcgttcctgaccacctggagcatactggggtgcagcctgcatagtactgaagaagtaaccaaagattggggttcattggaggctggaakggtcagaagattcctcagtggagaagctgggtttggaaggggagctggagagaacacaggcttaagtgagagttagggaacaggaatagcagatcctaataaaggaattacaatctgccacacattgtggaattagggcagtatagtctccatcaatcaracagaagcagagaacctgtcactgtccagggcacataatttcagttatgttctaaacagcttcagattgtatttttgtcttttgcttacacaagaaatgtgataccaaatgtaagtcttgcaaaaaattcttaagaaatttcctrttagctgggtgatagagtggaaagatacaagggaaactgctgactggtttttgagagaatgaggaatccaaaggaaacaaaaaaggagaaattacactttttgttttctaactttctatatagtttacagtttttttcttaccatttgcatatgtagtatactagcatgatatttatccaacttgacagtggcttaccattgtgaagaaaaaagggaaacyttttatttgctttatgcactattgatgcatttaaactgagaatcagggaagctgtgtttttaatggacacataatttaattatatattttttcttacagatacccaggtgttctctctgatgtccaggaggagaaaggcattaagtacaaatttgaagtatatgagaagaatgattaatatgaaggtgttttctagtttaagttgttccccctccctctgaaaaaagtatgtatttttacattagaaaaggttttttgttgactttagatctataattatttctaagcaactwgtttttattccccactactcttgtctctatcagataccatttatgagacattcttgctataactaagtgcttctccaagaccccaactgagtccccagcacctgctayagtgagctgccattccacacccatcacatgtggcactcttgccagtccttgacattgtcgggcttttcacatgttggtaatatttattaaagatgaagatccacatacccttcaactgagcagtttcactagtggaaataccaaaagmttcctacgtgtatatccagaggtttgtagataaatgttgccaccttgtttgtaacagtgraaaattgaaaacaacctggaagtccagtgatgggaaaatgagtatgtttctgtcttagattggggaacccaaagcagattgcaagactgaaatttcagtgaaagcagtgtatttgctaggtcataccagaaatcatcaattgaggtayggagaaactgaactgagaaggtaagaaaagcaatttaaagtcagcgagcaggttctcattgataacaagctccatactgctgagatacagggaaatggagrggggaaagctggagtattgatcccrcccccctccttggttgtcagctccctgtcctgtgtgtgggcggaacatagtccagctgctctatagcaagtctcaggtgtttgcagtaagaagctgctggcatgcacgggaacagtgaatgccaaasacttaaagcaattcgatgtttaagtatgtaagttcttttttttttagacagcgtttcgctcttgttgcccaggctagcatgcaatggtgtgacctcggcttactgcaacctccgccttcccagattcaagcgattctcctgcctcaggctcccaagtagctaggaccaggtgcgcgccaccacgcccggctaatttttgtattttgtrtttttagtagagatggggtttcrccatgttggtcaggctrgtctcgaactcgtgaccgcaagcgattcacccacctcrgcctcccaaagtgctgggattrccggcttgagccaccacacccggcacatcttcattctttttatgtagtaaaaagtataaggccacacatggtttatttgaagtattttataatttaaaaaaatacagaagcaggaaaaccaattataagttcaagtgagggatgatggttgcttgaaccaaagggttgcatgtagtaagaaattgtgatttaagatatattttaaagttataagtagcaggatattctgatggagtttgactttggttttgggcccasggagtttcagatgcctttgagaaatgaatgaagtagagagaaaataaaagaaaaacyagccaggcacagtggctcacacctgtaatcccagcgctttgggaggctaaggcaggcagatcacttgagaccagcttgggcaacatggcaaagccccatctctacaaaaaacacaaaaattagctgggcattgtggcgcacacctgtattcccatctastcaggaagctgagatkgaagaattaattgagcccacgagttcaaggctgcagtgagtcgtgattgtgccactgcactccagccggggtgacagaagagaccttgtctcgaaaaggaatctgaaaacaatggaaccatgccttcataattctrgaaagttattttcaactgataaatctatattcacccaaataatcaagggtgaaggtaaaataatacatttttagacaagcaaagactcaggggttacctccatgtgccctttttagggaagctgttggagaaaatactccagcaaaatgaaggagtacacaaaccagagaatgacatgaatccagcaaataggatccaacacaggcaatattccagctatggagctagctttaaaaaggaacagtaaaaatattaatcggttagctgggtggaatggcccatgcctgtagtcccagctactcaggaggctcagcagcaggrcgacttgagcccaagagttccagaccagcctggccaycttagtgagatcccttctcttaaaaataataacttattgccagatttggggcatttggaaakaagttcattgaagataaagcaaaagtaaaaaaaaaaaaaaaaaaacaaggggaaagggttggttaggcaatcattctagggcagaaagaagtacaggataggaagagcataatacactgtttttctcaacaaggagcagtatgtacacagtcataatgatgtgactgcttagcccctaaatatggtaactactctgggacaatatgggaggaaaagtgaagattgtgatggtgtaagagctaaatcctcatctgtcatatccagaaatcactatataatayataataatgaaatgactaagttatgtgaggaaaaaaacagaagacattgctaaaagagttaaaagtcattgctctggagaattaggagkgatggggcaggggactgttaggatgcattataaactgaaaagcctttttaaaattttatgtattaatatatgcattcacttgaaaaactaaaaaaaaacaataatttggaaaaacccatgaaggtaactaacggaaggaaaaactaagagaatgaaaagtatttgcctctggaaagaacaactggcaggactgttgttttcattgtaagacttttggagccatttaattgtacttaaccattttcatctatttctttartaagaacaattccatcttaataaagagttacacttgttaataagtgctggcctcctgttgttctttgtacaccccacacaaaatttcaaagaaactttgatggcaatatatctccatggtcagcttaaaaatagagaaaggaaaacatagaattagccaagagtcacacaaaacaaagatcagttgtttgttaggaaacaatcaaaatcaagtctcactttttccagattggcttatggaacagcactgtaaggtgataacttggggcaaacatgtaaataataaaacatatgttttaaatattcaggttagcacattttatgtttctgtgagattaaaattgtgtgtgacatacccgcttccttaaaggcaatgtttctgaaaatgttgtacctgctattcctgaatcagggatgggtcccagaatctgccttttaaacatctcagataatctgaagcctgcttaagtttgtaaggcactgcttttgcactctaaggaagaaaaaaacaagttttaattcccgtctctagaacatctcagtgaagcaaaacaggaaagcaaattataagttagtatatgtaagatttcagaaggcaaagttgtaaagattagatttccttagcctgggaacatggcaaaaccacgtctctacaaaaaataccaaaaaaattagctgcgtatggtggtgtgtgcctgtaggcccagctacttgggaggctgaggtaggaggatcacttgagcccaggaggtggaggctgcagtaaaccaaaatcgtgtcatcactccagcagcctgggtgacagaccaaaaccctgtcacaaaaagatttccttgttgctgatctgttttaagaacaagacgttcttaaatgtgtaatgcaaatacatataaaactatttaatatcagtaactccaagagaacgagtaaacaaactagatttcccttagcaagatgcttttcttacacaggtagtaaactaaaaactgtaaagttaatggcctaattaggcaacatgactgtgaggaaaagattggctggccagccgttgaaaggattcagacaaacagttatctatgaaagattgaaccttgtaattaaaaatgttccagcggggagaaagaaaagaagtgcatgattaaatgactaatgggaatagaattagagactctataaggagaatactttttgtttttgagagtctcactctgtcgcccagcctggaatgtagtgatggcagtctcgactcactgcaacctctgcctcctaggttcaagcaattctgcctcagcctccctgtagttgggattacaggtgtgtgccatcaagcctagctaattttttttgttttttgttttttttttgagacagtctccctctgtcgcccaggctggcgtgcagtggcgcaatcttggctcacggcaacctccgactccagggttcaagcgattctcctgcctcagcccccaattagctgggattacaggcccccaccaccacgccgggctaatttttgtatttttagtagagacaaggtttcaccatgttgcccaggctggtcctcaagtgtcacccaggctgcagtgcagtggcacaatcttggcccactgcaacctctgcctcccgggttcaagcagttcaccctcagcctccccaatagttgggattacaggtgtgtaccaccacccccagctaatttttgtatttttagtagagacaggtttttgccatgttggccaagctggtctcaaactcctgacctcaagtgatccacccacctcggcctcccaaagtgctggggttacaggcctgagccaccacgcttggccaatttttgtatttttagtagagacagggtttcaccatgttggccaggctggtctcaaatgatcaactgctggtctcaaatgatcaactcctggcctcaagtgatctgcctgcctctgcctcccaaagtgttggaattacaggcatgagctactgcacctggcccaagatattattacaggcccccgccatcacagggataaaggggaataaagcccctggccaaacagaagaaagaaggcctataaaccacatgaagtgctgttcctgttacccgggggaattactttaatgaccgtttctaatcatctgctcctgtcctttctgttccccagctgacctcatgtgtaccaggaagttactctgtaaatacagtgacatttctgttgaaactttttcttaaaaaaaaaaaaaaagatgatctaatacacattggttgtgctagatattttctaatatacgtcctatgttatgtatgatttttctaaattgttgaaagtctaaatcagtcaagaataaaatttagaattgtcgtctactttagcctagagaggccctaactaaatgactaacagcactaatgacaaacgcctaatacgggcatagagttttgtctgcaaggaggaaaagacttcatggtgctggaggtcaggaaaacctggggggaatgagagatttttttcagcacctaccagctaaagtaattagggaaagggatcctgaattagactgcctctttttcagtgcctagtcatgttcccctccaaaaggccagagacaaggagttaggaggcttctagttgacctgattcactgtccacaggttgacttctcactgccagttgtctttacttttgatatgtgaattggcaaaacttagactagggattcctccccctcccccaccatgccatacccctcaacattttataatgactaattcaagcacacggaaaggttgacagaattgtacagtaagcacccatttacctatcacctagatcctatcattaacactgctatctctgctttatcacatatggagccatccatctatccatcctatattttgacgcattttaaagttacagatatcactattcttcatgcctacattcttcagcttgcctattaactatagttcacttttttggtaaaatttacataatgaaatgcagatcttaaggataacatcctacaggttttgataatggcatatacctttctataacccaatctcttatcaccctagaaaactccctcttacccctttccagtcagtcctcaaccccaacccccagaggtaaccactattttttttttctcattatagattagtttttcctgtttctgaacttcatatgaatagaatcatataggatgcactcttttgatctggcttattgcagcatgatttgagtttcacccaagttgttccatgtatcagtggtttgttcctttttattactacgtagtgttaaaagataagtcaagtcctattaaatgttttaaagggtttgagcaaacagcaattcacaaattgggcagctccaaaccaagagtggttcagggctctaccaagagaatgcaaggaaaaggcttttgtaacttggaagcaaggcaaagaaaataatggcttggttatgactgtgtagttgccttatttggtctcccccccgccaagtcccttgttatataagtcagttggtggctactgattgaacttaaacttcattttgctttaatgcaggtatttacaaaaaaaaaaaaatagtccaagttaagtttagcttatcaaggtcaagtttgtgtccaaggcttaactggctttgtctgctgaagagatttacagtcctggtccccattttctcttattctaacggtaatattccattgtacagatgtgccagtttatccattcttctcttgattttaaggtgggactcaagactggccttgaagaggctagaaaagcaatgactaagggtcaggacaagaacaaatacatattccaggcagagggaaagccatgaagaaacttcatctccagattctaaaacccaggacaagcccttagcaagggtgggtgagttgttattaggcctatattagtccgttttcacactgctatgaacaactgcctgagacttggtaacttataaagaaaatagtgttttttttgtttttgtttgtttttttgtttgtttgttttgagttggagtgttgctctgtcacccagcctggagcgcagtggcgcgatctcagctcactgcaagctctgcctcccaggttcacgccattctcctgcctcagcctcccaagtagctgggactacaggtgcccgccaccatgccaggctaattttttttgtatttttagtagagacggggtttcaccatgttagccaggatggtctcgatttcctgacctcatgatccacctgcctcggcctcccaaagtgctgggattacaggcgtgagccaccgtgcccggccagaaaagaggtttaactgacttacagttctgcatggtttggaaggcttcaggaaacttataatcatggcagaagaggaagcaggcatgtcttacatggcacaggcaagagagaagagagcaaaaggggaagagccccttataaaaccaccagatcttgtgagaacttgctccctatcatgagaacagcatggaggaaaccacctccacaatccaatcacctcccaccaggtccctccctcgacaggtggggattacaattcaaattacaatttgagatgagatttgggtggagacatagccaaaccttatccaggccccacctccaccaagtactccacctttgctgtgcctttcaatctgttctctttcataaccgcatctagttcatgtctttttgtctcttacttagacggctggagaaaactaaactgatagtttctcaatctctgatctccgtctccaacagtctctcataaacatggccacaaagacaatctttatttatttattttttttttttgaaatggagtctcactctgtcgcctaggctggagtgcaatggcgtgatcttggctcactgcaacctccacctcctgggttcaagcaattctcctgcctcagccttccgagtagctgggattacaggtgcctgccaccatgcctgggtaattttttgcatttttagtagagatggggtttcatgatgttggccagactggtctcgaacacttgacctcaagtgatccacctgcgtcgggctcccaaagtgctgggattataggcgtaagccaccgtgcctggcccaagacaatctttctgaacagcatctctgattatatcactttctttcttgcctccttaatgctcccccggctaaggcgaaaccccactttggtctttaaggccctctacagtggcattaaccaaactctccagatttaccatctaccattttcactccctacatgttgtacacaagctacctcggctcttcacaaatccccagacagaccccagctttgccactcccatgctcttctttatgccactctctctgcctataattcctccctcctcacatcctccaatgcaaatcctacctgttcctcaaagcccaacccaaatcccaaattgaacctgtcatgaagcctgccttctcaccctcttctgaaccatgcagcactacctatttcagcccttaaatactgtttttccttacagctgtttgttattctcatctcctctcctttatcaatgaggaatgttttcagctgcgagtgctagaaaatctaacttacagtaactaaaacaaattgggattttgctgactctgattgattgattgattgattgattgaktttgccctcaaaaaatcaaaccaaacttggcattgcaagatggctgctactgctccagagagcaggcccatgttcacagtaggaagaagaaatatagtgtcaggcacatatttcctttttgtctagaaagcaaaacttgcctcaaatcctccttccccaagcaaactctccccttatatttcagcggctagaactggggcacgtggccactcctcgctgcaaggcaggctaagaatgtggaacaaggattgtagtcactgactcattcacatcagtggttcttaaccctggctgcacacagaaccagagggattcttcaacgtctggcttcacccccagagagtctaattctaatttatgc

SEQ ID NO: 12207 - DNA, 34688 bp, Homo sapiens
gagtaatttcatgaatgcagactacatggttgtttatttagtgatcagttacttcatgttttgtgtcagagaaaacatgtacaaaacatttgagaaaatattttaggacattatgtctaaaaattgtatactgagaaaaatcctatgaatgtggcagactataaaagcctttggtgggaagataaaccccctcagaagtgatcatagatcatgaataaactactaattcgtggaaatgtaataattataggaacgtctttgcccaaaaataaaacttcaacagattgagagagttcacactggagaaatactttcctctggcaaacccctgtggcagggttttcagtaaaatgttttgcctcatcgtgtgctaggaaataatgcagaaaaaacttatgaaaacattcaatgtagaagacttttaggaaaatatcagagaatttaatgaaggaaagaagccttggcaaaatgatggatgagagctttctgtcacaattctaaccttaacagataatatgcctcatgtgcatttgggaacaggatagcttgagccatattcctagttgccttgtcactgattttatacattttaaattgtgacttcctctaatcacgaactaaaatttaatattgtatataataccggagtattttatgcctgcctcattttattatatgattagctcctgcatttctttggttctaagtttgtgttatttcagaataactaaagtacttcagaatgaaactggatacagtatattcagttcataagtgtaattgaccatacttgaatatgtttaagtttataagtaacatcaggtgttatgaaattaatataaataagatgtttttgtaagtttttattttgaaataagtttagattcacaaaatcttaccaaaatattccagagttcttgcccttaacccagcttcttccaaagataacaacttacataagcatagttcattaccaaatacaggaaagtgaaattgttacaatactgttaactacagaatttatttggaaatcaccagttttaacatgcatgcatttttgtttgttttttatatgtagctttaagaaatcttaacacatatattgattcatgtcaccaccaccgtaatcgagattcagaatgttgcatcaatgcaaactccctcatgctccttgtttatagtcacaacctctcctcagccctaacccttggcaatcagaaatcttttcatctttagttttgtcattagtagcatgttataaaaatggaatcatacagcatgtacccttttggtattggctatttcaactaaagcagattaacctgaaatccatccaagttgttctgcatatcattgttctgtttttattggccactaataatctatgatacgaatataccactatttgtttattcacccactgaaggacattagttttgttcccggtttttcttactgttacaaataaaaatcctatgaacatttgtacacacaggctttgtgtgagcacaattttttacttctctaggataattactgcagagtatgattcatgggtcataaggtaagtgtatgtttacctttgtaagatactaaccagagtggtgtttcattgctcaccaacaatatatagaaaggttcagttgctccacattcttccacttgatgctgtcagtattttttttgttttgtattgttttgttttgagatgtagtcttgctctgttgaccaggctagagtgcagtggcacgatcttggcttgctgcaccctctgcctccggggttcaagtgattctcctgcttcagcctcctgagtagctgggattacaggtgcctgccactgcgcctggctaatttttgtatttttagtagtgacggggtttcatcatcttggccaggctggtctcgaactcctgaccttgtgatccacccgcctcagcctcctgaagtgctgggattacaggcgtgagccaccacgcaggactggaatgttttattttacctattctattgtgtgtgtattggtatgaatacaaacataccaattgtatgtggccttccatttgcacctccctaaaggctttttttttttttttttaagagacaaggtctcactatgttgctcaggctggagtgcagtggctattcacaggcaccattatagcacactacagtctcaaactcctggtcttgagaagttttctgtcccagcctccagagtagctgggactgcaggcatttgccactgtgcgctgcttagagcattgtttattaatgctggataaagattttatccagctggataaaggttttatatcacttgcaaatatttttccatagatgtggttctttctttttttttctcagagaaaaagattttaattatgatgaagtccaacttttttttttgagatggaatcttgctgtcttgcccaggctggagtgcaatggcatgatctcggctcactgcaacctctgcctcccaggttcaagtgattcttctgcctcagcctcccgagtagctgggattacaggcacctgccatcatgtcccactaatttttgtacttttgtagagattggggtttcaccgtgttggccaaactgggctcaaactcctgacctcaggtgatctgtccaccatggcctcccaaagtgctgggattacaggtgtgagccattgcacccagcctttttttttttaatggattgtggggttttggcattacatctaagtattccttccttactgtaattgataattctttttccacttcctttgacaaaataatgtagttttgcttctttttttttttttttttttttttttttttgagacagagtctcactctctcacccaggctggagttcaatggcatgatcttggctcactgcaacctccgcctcctgggtttaggtgattctcctgcctcagcctcccaagtagctaggattacaggcacgcaccggcatgctcagctaatttttgtatttttagtagagacggggtttcaccatgttggccaagatggtcttgatctcctgacctcgtgatctggccacctcagcctcccaaagtgctgggattgcaggcgtgagacaccacgcccagccagttttgctttttaatatttagcaatatccatttaaattcatctttgtatatagggtaagggttaatttaaagttcagcctatggttgcccagttgattcaacagtattgaaaacactgtcctctttccattaaattgattttgaacatttgtaaaaatcagttgcctgttcttgtgtccatttcttgactctattctgttgatgtgcgtgtctatcactccactaataatctacggtcactcccatcagaaatgacataatatgctctatgaggtaaaacagctatgttacctcatataaaatgttcaaagccagaacctggactttgggaaatgtcccatatccctctccggaagcccgcctcccagtctctcggtgttcttagagatggcgaaggatggggttgcagcaccagaattccagaatcggaagtaggttctgatacgtgttcagcctttggcagctgctactgtagccttgaaagcctgatgctgcgtgtgaatccggatggggagcttgtggggacgaccatgaagtggaaacgcatgtgaatgtccgtgttcaggggttttatttcagtttagtcaccgaggaatatgggtgtgagaaagagacccttgggatgtcaaaggttaaggcttagttttaagagtttaatgactgagggtcccacggacagagcttgaggtctatatgttcacttttcatgagtctcagtaatagaaaactggggaaagtgtgtctcagtgaatgctgttttttgctcagatttgcaatttaatatggggctcagatacagagaagcccgagctaggaagaggagtggcgtgaatgaaaggtctagggggaggagtgtcaaaggagtgcctctgtggtaagttttaaattgaatttgaaggcaattttatttagaggaagacggggcttgtctgtgtttgagaatgtaatgaggctggaggctttcaggtgtgcagttgaaggttagtggttgctttgagactaactggatgctggaaacacttcctgtcagtctttcaagtccaaatctgtcctgaaggtttctatttaaaaactttttcttcctaggtccactattctcattgtacccataaaaatcagagtaattcagggtgacgaagtggtgtctttaccgaggagtcttgctctgtcgcccaggctggggtgcagtggcgcgatctcggcttactgcaacctccgcctcccggattcaagcgattctcctgcctcaggctcccgagtagctgggattacaggcgcgcgccaccgcgtccgggtaatttttgtatttttagtagagactggtttcgctttgttggccaggctggtctggaactcctgacctcagatgatccgcctgcctcggcctcccaaagtgctgggattacaggtgtgagccaccgtgccccacttcactttcttaaatgttgtgtttagaagcacaaacttaaaaaaaaatcaagtccactttattaattttattttgttttgtgggtcatcctttactctcctctcagaattaactcacgtccatgaggattatctcccttttccttctctaagttttatactttctcttaaacttagatctatgatctattttgagttaacttttgtgtatggtttgagggtcctaactcatttttctggatgtggatatccaattatcccagtgccgcttgttgaaaagactattcttattgaattgtcttggcacttttgtcaaaaactcttaacaatatttttatactctcaattctggctctgctcttcccattggcacctttactaaaagtggcctttctaggaggcccaattcctttagtctgtcgtggccaggctcacatcgtaattcattctcaaaatctcttttctctcctctcctctcctcttttctcttcttttctcctcttttctcttccttctcctcctcctcttcctccttcttcttcttcttttttgtaaataataatcattttttcgaggccaggcgcggtggctcacacctgtaatcccagcactttgggaggccgagacaggcagatcacgaggtcaggaggtcgagatcatcttggccaacatggtgaaagccagtctctactaaaaatacaaaaattagctgggcgtggtggcgcgtgcctgtagtcccagctacttgggaggctaaggcaggagaatcgcttgaaccagggaggcagaggttgcagtgagcccagatctcgccactgcactccagcctggcgacagagcaagactccgtctcaaaaaaaattataatttttttctttcttcaccacccgcccccccgaatacctgctatttttctgttcttaaaaaccgcttcctgcaagctaattttcgccagacgctttcccgtgggtgtctgcctacctgatgtgttgccttttccctttctacctgatctgttaccttttccatttccaattcattctctgggatacctacacctggctgcactgttacttgtctttttcaaaacctttttttttaaatttaacaaagtggatggaaaagcgctaaaggcaatttagcttgccccatatttgcctgataaagcctgagtctctgaaaatctgccccctttcgcaagactttaagtgccaggaaacgaggcgatttcagtgacttctcttcttccctggctcctggctcaaaaacctgccactgccttctgtgcgtccaattttcaaacatggctgccgtcaggagccacggctatgggcgcggccattttacagagtaggaaatgccgtaaatgcgcttgtccttgctcttttaaacattttaggttctcctcggccgccgtaggtggaccataaacccgtgcgaggactccagaagtaggagcagtttacggaagtgtaacgttgaggcccttcttgtgtatctggagaaaatagaggtcagtgtgtggttttgtccctgaaagttttttgtcctagttcaggttttgtctcagtggaaggtttgggagatctgaggacgtggtgtaccctggaccacatagtttttggcaggaagactggggagcgccggggtataggcatttgggaggtacctggtgggagtctgtgatccccctgtctgtggtccgcgtgcctttggtgtgagtacagtgactaagggtctgtagtgatcaacggccgtgtcctaactgtcaaggtatggatcactctgcttgtaaaggatggaggtggcgattaggatcgatgcggcgtctgcttcgggttcaggatttaatttggaactcagtgatgttggagtctgggaggatgtccatcgctgtagagtgtctggtccgtggttcggatgagtaagaggcatggggccagtgtctgtggtacaaaggcttgtgagggctgaagctttcgagactttggagccctgggtcctgggttgaggttcgaacctcggttactggggcaaaaggcgacacagcccccagcattagttcgaaaccatatatctactcttctgatccttggggtggctatttacagatcggggggtcaagttcagtcataccctccgattatatattgtctatggctgcaaaggcagcggttgagttgttgtgacagagacctcgtggccggcaaaatcgaaaatgttgccaacctctgcattcacttcttttattttttatttattttttttattttttgagacggagtttcacttttgtctcccagactggagtgcaatggcgcgatctcggctcactgcaatctccgcctcccgggttcaagcgattctcctgcctcagcctcctgagtagctgggactacaggcccacgccaccacgcccggctagtttttgtatttttagtagagacagggttttaccacgttgggcaggttggtctcgaactcctgacctcaggtgatccgcccaccttggctttccaaagtgctgggattacaggcgtgagccaccgcgcccggccttcacttcttaatatatagtgagtgttgcttgcccgccttatattcacactttcttaacagaatctccatttcgtgaagtattcatccctgtggcaaggcgacccaaatcccagtttcttagtaaggccttgttggtcttagccaatcttgctggttccaattgccattgctagtgataggtttgacatggaaatgagcttaggcgtatggtgcaattctagccaactatgtatgtgaaaatctgcctgggagtttctgagggagcrttttcttttttaaatatgtaatttcttgaatctctttttccatgttcgtgatgatatcgcctgaaaataacattaattttctgtcttactttgtaatgcttataattcattcttatcttaatgcattggctcaactttccagtataaagtaggaaaatagggtgttagtggacgttcttgttttattacccacctgtaaaattcacccgttgtgttgtctggagttaacacctttcctggaggtaaactgtttggtatggttgatctcttcctttactttgttaatttttctacatttatatattttaaatgtacaatttaattatcatggaggcaatatatgtataagcagtcattgcccaggtcaagaaatagaatatggtcagcacaccagtggtgttctgtgagtctttttccattctcacaccgaaaagtattttaggcttttctttatataattaatcattatttatcattgtagttaatacagttttgcctattttaaactctgtatatcagtggaattgtacatcactctttttttgtgtcagccttcttttgctcattattggtgagggtctttcctgttgcatctgagtatattttctttgctcaatgacaaggatcaggcgaatttacagtaaatattttagggcttgcaggctacatatggtctcttgcatatgctaatttgctttttgttttacagtctttcaaaaatgtaaaaagcattcttgcaggctggaccaaaggtataataggttttctatcacattccattatgtaaaatatagcagttttttctattattaattacatttgtattacctaaagcttgtattattaagaataatgcatgtgtgaaaatttgtgtaaatgtcttttggttcatatgtgctctcatatgggggaggcagagatgtatatctagaygtgcacctcggaggaaaattgctgcttcatagagtgtgtataaactccgtctaaatagatgtcaaactgttttctaaagtggttgtaccacttacagttcccctagcaggatatagtttgctttatagggtgctttatgtggcctctttaaaatatctggccataccctaataacattgagagattctcctatattaatgttctttaaagctttattgatatgtttctaccattgaaattgacagttgattctaaaatggtttttgtgtatgttgtgaggggggttttaactttctgtccccatccccagtaccatttattgatttttttttttttttttaatttttttagatagagtcttgctctcgtcgcccaggctggagtgtagtggcgtgcttggctcaactgcaacctctgccttctgggctcaagtgattcttgtgccacggcctcccgagtagctggaattaccagcaggtgccaccttgcctggctaatttttgtatttttagtagagatggggtttcaccatgatggccaggctggtctccaactctggctcaagtggtccacctgcctgaagggggcctgcccctccacacctgtgggtattttttgcaaggtggaaatgagagactgagaaaagaaatcagacacagagagaaagtacagaggaagaaaagtgggcccaggggactggtgttcagcatatgggggacccacaccggcactggtctctgagttttgttagtatttattgattactatttttaccatcttggtgaggggggtgtggcaggactatagggtaatggtggggagagggtcagtaggaaaacatgtgagtaaaggactctgtgttataaataagtttaaggaaaggtcctgtgccttgatgtgtacgtaggccagatttatgtttgactttacacaaacatcttagtgtagtaaagagtagtattgccgccagtatgtctcacctttagttataaggtggttttctcctatcttagtaaatagaatgtatgattgggttttataccgggacattccattcccagggaggagcaggagacagatggctttctcttattttaactgtaaagaggtcttcctctttcactaatcctcctcagcacagaccctttacgagtgttgggctgggagatggtcaggtttttcccttcccacgagaccatatctcaggctgtatcagtgggaggaaaccttggacaatacccaggctttcttgggcagaggtccctgcggccttccgcagtgcattgtgtccctgggtacttgagactggagaatggtgatgacttttaccaagcatactgcctgcaaacacattttaacaaagcacgtcctgcacagccctaaatccattaaaccttgagccaacacagcacacgtttytgagcacagggttggggctagggttacagattaacagtatctcaagacagaggaacttttctttgtacagattaaaatggagtttcttatgtcttcctctttctatatagacacagtaacagtctgatctctctttcccccacaccttcctcagcttcccaaagtgctaggattacaggcgtgagccacggcgcccttagttccatttattgaaaagacagcttttatctacttccctgtagtgctatcattgccattgagtctctatatgtgcttaattctgcttataaggattttattctgttcctttgtcctatttgcctgttattgtactaatattgtgctgtcctaattaaagtagctttataagtcctcataactgatatggcaagtcttctaacttttttttcaaactttaaaaaaaagtttatagctatttaaacttttcagtatcagtttgggattrtgactgtgatttcattgaatctgtagatttgggagacttgacatttttaaaatgctttgttttccagcccatctttatagtacatctttgcatttatttaaaactgttaaaatttatctcagtaaatctaattttaaaaatatattcgagttcttctaaatgatatcgtttatgtcagcctaaaagaggaaactgcacaaaatacaattttaaagagtttacttgagccaaaatgaggacagctgcctgggaaaatactttcaggttgccttggttaagtgctctgttaggattttgttagaaacaggttttaaagtcaaaagggaacaaaccgtgagctgacataaagttgtttggcaagaattctcattggtttacagaaataatatcaattaacaattggctgtacattgttaactatggggttttatgagttaggatgtccagtgaatggcattttatggctactcagtgtgagttagtctagagcctacatagcaagtggctttaagagataattatttagcttgagggggaaatgagatgtgactattgtcacattaaattttttttttagtttttaattttttcttttttctttttttcaggggaacccctatcagaaagactgctgtcacattttaatgcctctctagacctgataatttaaagggagtcacattcctcagataaaagattcatttctttctcatttataaattttattttgtttgttgatggtctgttctgtcagttactaggaaaggtctgttaaagtctttagtctgaattttctatttcttgtttttggttctattttttgctgtatacatttcaagactgttgttaggggtatacatatggtgtatttctatgaatgaagagccaaatttcacctcttttcagtgagcattgtttctctttctctctgttaattctttaggatttctggtcagttttgtctgagatatagttataacagattatctttggttactctctctgtggcatattgtctccaaccttttattctcaagcttcccatatcattttggttcagacatatcaactataataaccgcatgtggggaggctgaggcgggtgtgtgatgagatccggagttgaaggccagcctgaccaagatgctgaratccgatctctactaaaaatacaaaaatcagccaggcgcggtggcgggccgtaacccacatggacccatgggactgcacaaatgggggtgaacgtgggaataaagacaggagacaaaagagtatatttgggagaaggggtcagggagcaccttacctctagtggacaagggccctgagctttacacagccctccgtatttattaggcaaaagagataggagggtgggggggtggaagaaggggtcggctgctcagttcagagtaggcttgcaagactgcattctctagatgtcgcagtagataacctcggtgccagggagtgattgcctccagcaaaccttatgttggcaggagcagtcctgagtttgctcacrtcctgtattcatgataaacagtttgctgtttgatcatatagcctccagcagaatgctgagttggtcacgtcccacaggcctttggctccctgcatatccccctttctgtttatgtattaattgaaagaatgtaaggctgggctgggmrgctctcattctccaattggtggtccatccgattttacagactataaaccgaagacagagacaaaacaacattattccaagaactacatataagatgttaatgtggtgccttagataggtccaagggttgaggctctccaggccttcctggaattcggtccartcttctaaagaaggctgaaattcttgagtttgcctatttaaatcaataattttgttttgtaattcaccaatatcaaaggtgatgttggatgtgaaagctccttgcaaatgggctttcacaaggtcccacggatactcactttggttatattctgagttagttacgcaaatatgaatgtgattaaaatgatgacgcaattgctgctgcaactgcaagctttgtacctgttctcctaaccacagaaccatggatttcaacattgccacttcagtttgtaactcagtgttaattttattctgaagtagcctcgcttggtcagctgtgcgtgtccagttctccacctactgagatgtttgaatagaattatgcagagttacagaagatatcacaacagaagttattagtttgaccaaggaaacaatagcaaaaattatgcctaaggctctatggacacagtgagtaagstgagttagaagaagtgttacaaaaatgcaaagcaggtgtggcagcccaaggctcagacagattaacaagaatccatagcccagggatgcaacccaacattatcaaagtagagatattatgtgttcgtaatgtgctatgattaatgcagtgtgatataactggcaagatttacaggtcaattgggtattgtttacctgaagctggttcttcttagctgccaaaaaggcataaggattaaaaacacaaactgtaaactgagtggtgatattctttacaaatgcaacattaagactgtgttgcttactattgctattattagacagtgttccaatccagatgttgccattcataaatgggagtgctgccttccatatagtttcttgaattggtcctttcctccccagataatgcaactgaggaagaggtgggctaaagcctgctccatgccaagcaatctgagcagcagactgggattggattctgctgttgtataaagaagaagcattaaaagcttgccgccaatgccagtgaagtttgtgccatgatttctgactttcaccttttccatctaattgacctttaggttcccaatccacagtgtcttcagttgacatatattgtttactagccagtggatcaagacactgggtccacagagtggggtaggaactattgaatggaatccattctgtataatcagcacaattagggtgactggactgggaatgattggttagcacaccagttacattaatagaaccaagacctaataagtacataatttttccatagtgactcaaccatgtttgagcttgaattgcaagacagctatggctgagcgacgtctttgtggtgataaacaaagggagtccttccagtggagtggtataattaatgacattgttctgagagtctaacttttctatgtcacggggagttaggggtcctggagcccactctccctgatcgtgataaatctcaggaggagtgagctccaaagtataggccatactgctgggggattgggaacatatgcccaatatgtttttgcctgtgcacagggaaaacgtagtgcacaggacattatggctaacatggccaagagcatggaatcaggggttttgcctgtccctgacactccagtagtttctcagcttcctgtgtggttttcttgagttgtccccaggttatgggggttgatgtcatcatgactctggttggccttctctccatctttgcactcaggctcagctgactcatagctcgtacaggagggactgggcccatggttggccaccctgggttcctccagtctcccattccatggtcgcatgcaccttgagggcacccacatggcttgtcccatctcctgtaaacacacaagcataccctcttccccaggtcagtaaatctaccgggcctttccattgttgtccttctggggatttccataacactttcagataaactttgcttttttcctctaacacttgccaatgtctttctgctggagtcttaccatccataccgggagtcagaaaatttaaagtaaataaggctaaatgtagttttgattgaggtggtagttggcctcctataccccctttttgttttttcaacatgcgttgtaatgtttgatgtgcccatcctatagatatgactgacacatcagctcccatgtccataagcccataaaatttctttcctttaatgtgtactacacaggtaggtctattagaggctatgggttgggaaagatagatttcccatgtagttgtgctcccaaaccctttatttcctcatttctcttttcatggggaagggtgtaattcacagggaataagcaataattgagcaatatattctcccagttcaaaaacccaaagattttgtgacattaaaactacttgaatttctccttcataatcggagtcagtcattcctaggactacagtgatgccttgcaagttaaggcagcttttacctaaaattagtcctgtgtatcctgtcggtaaaggtccccaaatacccaaataggtttgtctcccctaactaatgtgattctttctctggtgggtagatctaatcctgcacttcctggtgttcctgggttgagggaatcaatgtgcctccaggaacccatccctgaagtggggttgtggtctgcattgggaatgccctcattgtttgaggggcccgggtgcaggcccccatctcatttaccaatggggtgccattctgatgaaattttgagcagcactgggtagcccagtgatttcctttgttatggcgagtacagagtcctgctgttttttctgctagggagtgaactgcattgtaatatcctttctgtcctgagatctggcggcattccttttttagatgtccagtttttccacaattacaacattttcccactttagggtttgacccttggctccttttagatttgtcaactgctaaattagccattgcttatgctaactttgcagatcgatgaatctcagttcctacatcctgacaagctctgagaaaatttcccaagttttttgtacacctcactggtgccagtgcacgtttacagtacacgtttgcattctcaaaagctaaagttaaggttagcatttctgcagccacagtatgaggaatctgacgcttcagtgcctcatgtaatcttgcaagaaattgtgcatagggttcctgcaacccttgcatgatatgtaaaaaggattgtacagggactccctcttcaggattgtggcccaggcgcatttagcggcctgtgtacactgctgataagcagcatctgggagtgccatttgacgttctacatctgaataagggccatgacctaacagcatatcctctgtaatgtctccgtgtccagcagcatggttctgtttagcctggtctgcacacatttcttgccaatttaaattccatgtcagatatgcactagcagacaagcaagttcgygccaagtgtctcacatcaaagggtaaaaaacgcatagcaccaaacacagattctagcaatcctaaggtgaatgggctctgtatgccatcatttaccactcttgcttttaattccttcaacaacttaaactctagtggggtgtgttcatgaataacctgctgtggattttttggatcaggcctgatggaaataggaaaagcacaatgtcctaagggctctccagctatggcagcagagcattaaattctttgtattaggrtttctatttctgccaccgaaggaggcagtacagatgtttctgcaactgaaggaggcagtataggccaatttttatcctccctctcctgttttttatttttaattggagctgtgggtgggtcaacaaattctttcagatttttagattcagcttgctgtcctgcagaataataatgagataatggcagaagtacagtacgaactaaactccaagtggagaaaacagaagaatcgactttaagacctttttgatgagcctgttttaatccttctcctgctgtatcccaattttccacatcaagagtgcctgcctgtggaaacsatgggttatgtgtaataaccttttgtggcttctgcaggaggttagtgtctgygaattaacctgagctgcagactgtctcaacagaactttaagcaactgcacataatgtttttcttcaatagacaaattctttcccttgttaccctgagtcagaaaacttcccagtacttctttaaagcactgctcccagtacctctttagggcactgaccttatatctgctgccggcagactcttcccagggtcccctttcrccttgtcaatttcagttcctctgctccagcagaccttcttcattcacgtccttgaagtcccatgtttggatgctgctagttgggcgtgcttggagtccctgttctggttgccatttgtaacctgcacggacctaggtggactaaacaaagkggggtgaacacgggaataaagatgagacaaaagagtgtatttggaagaagggatcgggggcgctttgcctctaggggacaagggccctgagctttacacagcccttcatatttattaggcaaaagagacagtgagaaggggaggtggaagaaggggtcagctgctcggtccagagtagtcttgcaagactgcattctctagatgtcgcagtagataacggcgccaggggtccagagtagtcttgcaagactgcattctctagatgtcgcagtagataacggcgccaggggtccagagtagtcttgcaagactgcattctctagatgtcgcagtagataacggcgccagggagtgattgcctccagcaaaccttcatcagccggagcagtcatgagtttgctgacatcctgcattcatgataaacagtttgctgtttgatctgtagcctccagtggaatgctgagttggtcacgtcccacgggccacgagccttcggctccctgcagcaggtgcctgtaaactcagctactcgggaggctaaggcagagaattgcttgaacccgggaggccgagatcacaccattgcactccagcctgggcgacagagtgagactccatctcaaaaattaaaataaaataaaataaaccccagatgttattggattttaatttttaatccattctgacagttttgaggcatttatatttaatgtaattaactgggatccatgctctgtttttacttagcataaaatacttaatgtaatgtaattttcttagtacattttattttaaaacagctatctaaatgcattgtatttgctctttttgctctgtttttgattctcttcttttggatgaatttcttgttattacatttcccccttttgttggcatggaacttacgtactttaaaacaattactagtttttttttttttttttttttttaagacgaggtttcgctctttttgaccagactggagtacaatggcacaggcttgtctcactgcaacctccatctcccggattcaagcaattcttctgcctcagcttctggaataactgtatttttatagagatggggtttcaccatgttggctaggccggtctcggactcctgatgtcaggtgatccrcccgcctcggcatcccaaagtgctgggattacaggcgtgagccactgtgcctggacttactagtgttaattgtaactagagattacatgtagtgtgcaacctttgtcatattcttctgctaattggcacttttccattctacagaaaccttagagcacgtcaactttattcaccacctaattatccagtaaattattgtgtattttagctttttatgtatttaaaacctcctaaaatattgtcagtactgtttttatgacaatgcttatgatttgcccagtacattggctttcaaactgaagtacatgtcttcacagggtgtatgtacaaagacttttgaagaggtgtgggagcacacatgatttaaaggaaaacaaagaccaggtcctctccttgctgattgtctcttttctaaaactaatctgcctaagagttcaccatctcctgaggctggtgctatggtgggtctcatttcctacctgccttcacagtcyttccacggaaacgtcacagagsaaaggcatacctccaccacattaagaatcctagacattattggccacaggtataaaatccgctggggctccaaacaaaggtatatagttaactatattgggggcattgctttaagatgagtgcctagcagcagtgacagtatctgggcctggaaaaaatgtaccacttacattgaatttgctcttcaacccacaggttctgactcctcaggagcaaaaaacataacctgaagagggaggaagtggatttggggttcaccatttcttggggcacacttgattgaaaactgagacttctgaagagaaggccagaagatacaaagacagaccatcccagttgaatgctgtcttccaagaacagaagaaaatgatccaggcccaggtaactgacttttggtttgttttattctttcctttgttccataatagatttgtagaagcctataaacatcaatttcactaatataaaaagtakaaatttcaaaaagcaggatctggagagaagtaagcttagtttttaaactcaatatcatgcaaaatagtaggataaggaatataatgttcatwgcattaacactaaattatgaattttgtgacaccatgcatggctggaggatcctgtggattatattagctgtcagcttgcatctaatatctctgacagccaatgtcacaagaaaatcataatttacatggtatgtcctgtttttgaagataaaacagattacttcctgggggttgccattatttcatggcactttggtctcaggaaatttcttcagtggttcttcctagagttgatgtggtggatggtgtccagaatagcagccttctcataaattcagatgcaggtttcctgtggctgtttcttgaaggactccttatatactgttacggaatagactaagcaaacagtaaacacagggaccaacacaagttaatttcagccttgtggcagtctggatttaacttggaataaaacctagacatcctgggaatatggcaggattccaggactttcaaatggttctcaatgaacagatagctgaactggtgtttgaatatagatttggagacagggagttgaaagtgatattgtctgaacaggacttggattggagtttacagatttcctttagactttcaccttgtagaaaatgccaagtccttattgtatagtaaataattgaacaaagggagttttggcctttgtgttcaagctaatggagggtgagctctgggcttctggaatatcttgctaatggtagtgtctttgtttgcttgggtcctttggccactggacagcctaaaaatacgaactatgatagatctgtgatctatgataggccagaaacttccagaactagaggctaaagttaaaacctgacttctgggagggtgtggacctaagatcagccacataggtcatctgtgattgtgtcccagtaaagtaagaaagtacacatatcaaaaaataaatttcggctgggcgcggtggctcatggctgtaatccagcactttgggagaccgaggtgggtggatcacgaggtctggagatcgagaccatcctggctcacaccgtgaaaccctgtctctactaaaaatacaaaaaattggtcgggtgtggtggcaggtgcctgtagtcccagctactcgggaggctgaggcaggagaatggcgtgaacccaggagacggaaattgcagtgagccgaaatggtgccactgcactccagcctgggtgacagagagactccatctcaaaaaaaaaaaaaaaaaaagtttctggctgagtgcagtggcttatgcctactttgggaggcttaggcaggaggattccttgagcccaggagtttgagactagcctgggcaatctagtgagaccttgtctatatttartaaaattgaagaaaagagaaaaagttttcttttcacatattttcttcctaatccacttctgtaaatggttggtaatatttacttcctgtcactgtatctgtttgtggatcyatgtctatatatgtattaataaaagtgtgagtatatatgaatctatctgtagatatatatatycattatgatatacacatatatatattttacatgatagaatcatatttcaaagaacatagcagccaacttgaagggactcttcattggccgaagatgctacactttgaacatccaaagaccaatgattgcaaatgattgaagaacattaattatataaaattccatcagtttatagctatacttgaaaaaaatgcatttgtcaccattgggggttaggagagaatcaagtatttaatctgaaaaatgataaaagatcataaaggttttgtgtgtgtgtgtgtggcgggggtgggttgactatgagtttattttttacttttacttttctgctttttttctttyttccttttttttttttttttaattgagatggggtcttgtcatgttgcccaggctgctcttgaactcctgggctcaagcaatcctcctgcctcccaaagtgctgggattacaggcataagccattgtgcctggccctcttggtaattttgtattactgacccatactctgctccttggctataaattcccacttgcttatgctgatatttggagttaagtccattcaccctctaccactgcaaaatcccattacatttgtctatatacctgtcataatggccctgaataaagtcttccttactgtgctttaacaattctcattgaataatttttttaaacatgtatagcttaattaaggaggtgagattccaacgcctttgccatattctgaatagaggtaagtcactaggccagtccctgctcaaggagagggtgtagagcacccaattctgtccctgtttgggcgccacttgtaacccgcacagacctagggggactgaacacagtggggtgaacacaggaataaaagacaagagacaaaagtatattcggaggaaggggtcagggggtaccttgcctctagtggacaagggccctgagctttacacagccctctgcatttattaggcaaaagagatagttgggggggtgcagtggaagtaggggtcagctgctcagtccagaggaggcttgcaagactacattctctaaatgttgcagtagataacctcagcaccagggagtgattgcctccagaaaaccttctgtcggcaggagcaatggtgagtttgctcacatcctgcattcatgataaacagtttgctgtttgatcatatagcctccagtggaatgctgagttggtcacgtcccacggacctttggctccctgtaagtgggaactacataaaggtgtgaacactgggagggtggagttcattgagccatcaaatctgcctgccatagatctgtcatatagtaaactatttttgagtgtggattgaggtaagactttcactttacttttttccaaatagatagctatctcacataaataatttagaatgggtaaaccaaccaggattaagtacttgtatcatctaccaagtgtgttcactggcctctgtaataaaatgagtatagagtgtaccttctgctgttccctgggtcttcaatgactcaatttcccaccagcagtatcctttaaagccatcctgcatcctgagacaagagattgacaattcattgataagtagtcttaattgtcactattacagggctgtaggtcctttgccagccatgcctttcagtcctaaatggtcttcaaggttgggctgtgttgtccaagagctgaggaccttacatttattgttccaatatttattggctataatgatttctgtggagcagtcagctgtcagaaaattttgtctcctttgtaggtaacctgtcattggtctttggatttttttatagtctccctttgtatctggtgtaatttagtttcaatctgttgtgcctacgtgtagacttcttgcttgaaaagttgttggatttcttgagtttgaattttggagtgtttaatcagttctgaaaaattttcagtgttagatctttggatattgtttctccattacttgattttctccttcttcttgagaaattatcaaactcaaggaggtcataggaaccctcagtttataattagtccatcagaaaaataggaggcctggatttgtgatatatggttggccctccatatccatggcttccacatccatggattcaaccaactgaggattgaaaatatatattttttaagcatctgaactgagcacatacagacttttttattgtcatgattccctaaacaatatagtataacaactgttaacataccatttacattgtattagatattataagtaatctaaagataatttaaagtatatggggctgggcacggtggctcactcctgtaactccagcactttgggaggctgaggtgggtggatcgtctaaggtcaggagtttgagaacagcctggccaacatagtgaaaccccatctctactaaaaatacaaaaaattagctggttgtggtggcgggcacctgtaatcctagctactcgggaggctgaggcaggagaatcgcttgaacctgggaggcggaggttgcagtgagccaagattgtaccattgcactccagcctgggaaagaggagcaaaactccgtctcaaaaaaaaaaaaaaaaaaattagccaggcgtagtgtcacatgcctgtagtcctagctacttgggaggctggggcagaagaattgcctgctcctgggaggcggaggttgcagtgagctgagattatgccactgcaccccagcctgggaaagagagtgagtctccatttcaaaaaaacagaaatgtatatgggaggatgtgcatgggttacatgcaaatctgcaagtactattccattttattttattttattagagacagtcttgctctgttgcttaggctgcagtgcagtagcatggtcataactcagtgtagtctctaactcctaggctcaaatgagcctcctgcctcagcctcccaagtagctgggaccacaggcactcaccactgtgcctagctaattttttaattttttgtacagatggggtctcatgttgcccaggctggtcttgaactcctgggctcragtgaccctcctgccttggcctccgaaagtgctgggattacaggtgtgatctactgtgcctgaccaatactgtgccattttatatcagacacctcagtatcctcaggaggtcctggaaccaataccctacagatactaaaggatggctgtatatatgtctttcatttgcatgtatctaaaataaatatatgtacatatattcatatatatttacatatataaaatgtataaatatattgtttttaggttagcaagatttaacttctacactttatagaaacttccaattgggtgaatggaggatgactgaatatacagttacagaatattatattaggactttacttcttccacattgtattaaaaaaaaaactatttggtatatgcacacagcctgtagagtggaaatgagcagaaaaactttagcatttcttccacatcatcaaaaagacatcactttattaaacaggactgttattacaggaatccataacactggaggatgtggctgtggacttcacttgggaggagtggcaactcctgggcgctgctcagaaggacctgtaccgggaygtgatgttggagaactacagcaacctggtggcagtgggtgaggacagctgccctgtgtcactcagagggtgcctagtcagtggccttcctttctcagatgcctacctctttggaatgcctgcagtactctgaagtggtagattctcagatccttctcttgctcccacacaagacggtgtaatctaccctcttgtaagagaaaaaccttgatgttacagatatgaaaygaaactttcatagtttcagataagaaactaaattttgggtattttaagaaactcaagtttcttgaaatgtaacattcttccttcttgacattgccagcccaatttgatatgtctaagtcctctatcattttccatgaacagggtatcaagccagcaaaccggatgcactcttcaagttggaacaaggagaacaacygtggacaattgaagatggaatccacagtggagcctgttcaggtgagagaacccacaagrcagaaggctatggaagtcacattctagwcagtcagagaaggcarcacagctgtgaagggggtttgaggatatgtaaacagttcctctactcatctgtctcccagtgtgagaccagtttttctttgtaggaatttagagttaaaaaaaaacaaaacaaaacaaaaactctttatctcctcagagatctgattattttatctacatattgtttgtttgcctgcataattttcttcttcctcgggtttcaartatttcccttcttcatgttgttccacctctcttgttacgaaattccaccttccaggcctctttccaaagaggaaactttgaagtcctcactgttttcggactcccacccctttgtgccccttggctaatgctgacctcccctcctaacacctcccctgtgwtggatgtggcttcctcagggtaaactggactttcgctgtgccttggcttccttcgcttctctttttccttattcttaggttctccaaaggtcccgttctccattttctcatctgtgcccttcactcttcaaaattgccttcattctagtaagtttaaactccttccgctccctggaggagagtcccaaactgacatctccctgttgttatctaacacagattttagttctgtgtaatttacttcatggcaactctcccctgagttcctagtaactgcaaggaactagaatcatctttcctccaagaaaaccattaagtttggattttcgtttgttcctgtacatcctgaatcttggccatctgggtattacctgcctgaagagctctcttctttaaaggtctctgctagtcatgatgcatctctaagtaaaaaagtcatttttttaacatcctacattctcaactcccgcctacttccatttggttcctttctgtatttaataatttgctttcgtttttttccccatcgtattctgatgacaccaagtcccagtaaaccatgttacctgtcaaatttctcatttcagtgatctctgtgatataataccatcttgctcacaaagagatttccatcctctttcctaaaccctgcctggtgtgttccacacatatgattacttccctgactcattcccttaaaaattattcattattattatttatttttattaatttattttttttttaagacagagtcttgctctgtgcccaggctggagcgcaatggtgtgaacttggctcaccgcaacctccacctcctggattcaagcgattcttgtgcctatccccaacaccagcaccatacctggcacacggtgatcattcagtaagagtatgtggaatgaatgaatctgttctttggacgaaatgggcctccagcctctggtctgctggtcacagtgaattgcttgtattttaaggtctgttttgcaaggcacatttagaaagcagccaaatctgtctttattattagtgatctaaccttgttttatgctaactgctttcaccttttagtttgtttatactattactttttgccaatgtgcaaggaacattaaacatggagttttatttacactcaggtcatagggttattactaagagacacctcacatcaaggcattaaaaaaaagaatactttggggccgggtgcagcggctcacacctgtaatcccagaactttgggagactgaagcgggcagatcacctgaggtcgggagttcgagatcagcctggctaacatggtgaaacgccgtctctactaaatatacagaattagctgggtgcggtggtgcatgcctgtaatcccagctactcgggaggctgaggcaggagaatcgcttgaactcaggaggtggaggttgcagtgagccgggatcatgtcactgcactccagcctgggctacagagtgagactccgtccccaaaaaacaaaaaaaaaacaacaaaaaatactttggctgtgagccgggattgtaccactgcactccagcctgggcgacagagtgagactccgtctcccaaaaacaaaacaaaacaaaaaatactttggctgagcacaatggctcacctgaggtcaggagttcgagaccagcctggccaacatggtgagaccccgtctgtagtaaaactacaaaaattagccgggcatggtagcaggcacctgtaatcccagcaacttgggaggctgaggcaggagaatcccttgaacccgggaagcagaggttgcagtgagctgagatcgcagcattgcactccagcctggacaacggagtaaaactccatcttaaaaaaaaaaacaaaaaaaacaaaaaaaccacaacaaacttttaccccaaatctaaatgatagaaatctttgttcttttctttctagacatatggaaagttgatcatgtgctggagcgcttgcagagtgaaagcctggtgaacagaaggaaaccatgtcatgaacatgatgcatttgaaaatattgttcattgcagcaaaagtcagtttctgttagggcaaaatcatgatatatttgacttaygtggaaaaagtttgaaatccaatttaactttagttaaccagagcaaaggctatgaaataaagaactctgttgagtttactggaaatggggactcctttcttcatgctaaccatgaacgacttcatactgcaattaaattccctgcaagtcaaaaactcatcagcactaagtcccaattcatcagtcccaagcatcagaaaacacgaaaattagagaagcatcatgtgtgcagtgaatgtgggaaagccttcatcaagaagtcttggctaactgatcaccaggtaatgcatacaggagagaaaccccacagatgyagtctatgtgagaaagccttctccagaaagttcatgcttactgaacatcagcgaactcatacaggagaaaaaccttatgaatgccctgaatgtggcaaagcctttctcaagaaatcacggctcaacatacatcagaaaacacataccggagagaaaccctatatatgcagtgaatgtggaaaaggcttcatccagaaaggaaatctcattgtacaccagcgaattcatacaggtgagaaaccttatatatgcaatgaatgtggaaaaggcttcattcagaagacgtgtctcatagcacatcagagatttcacacaggaaagacgccctttgtgtgcagtgaatgtggaaaatcctgttctcagaaatcaggtctcattaaacatcaaagaattcacacaggagagaaaccmtttgaatgtagtgaatgtgggaaagcctttagcacaaagcaaaagctcattgtccatcaaaggactcatacaggagagagaccctatggctgtaacragtgtgggaaagcgtttgcgtatatgtcgtgtctggttaagcataagagaatacacacaagggagaaacaagaggcagccaaggtggaaaatcctcctgcagagaggcacagctcattacacaccagtgatgtcatgcaggagaaaaactctgctaacggggcgactacacaagtgccttctgtggcccctcagacatcattaaacatcagyggcctcctcgcaaacaggaacgtagtccttgtgggacagccagtggtcagatgtgcagcctcaggagataacagwggatttgcacaggacagaaaccttgtgaatgcagtgaatgtggttgtgccttccgtgatcaattatgtcttattttatgttacagaaaacccataggaagaaaactcagatctatgtggaaaagggttgagcaaaaatttgtagttcattatgtggccgaaaagcatayactgagagaacatgtataaggctgagatagcctgataaactcatcctattaaaatgtatgctgtgatacacaggcaaatttgatgttaacctaagcacatacacagcaattgctcgactgtgtcaattaaatgagtaaaggaagcccaagtacttttaagtggaggaaatgaagtactgtgaatttttaaaacagatgagataattggtgtygggagtgttgcagtgactgaaaagcttcataaggggcagttggtgggaaagggctaatactgtaatggtggaatgtgggacacatatgtgtcaattcagtttccttagaccagtgccagtgtggaggattaattgaaaaccaggaccataaactttcagaactttgtattatgcagagggatctgtgaaactagtcaatttgtttcattaaacaaatattttaaaattatttcctttgtaccttgtcctgttccaggagctgaggtcaaagaagaaaaagtttgtggtctcctggagagtttgtggggttaattttaagtggtatcattacactcaggcaatctagtcaggcggtgcaaatatctacattaggtgaaatggacatggagtaactgtgtccaggggacgcgataatttattgttcaaggagtagcagaaggactgctgttaatggtacttaagcaccttagtacaaaaaggagggctttttgtttgtttgtttttgcccgtgtcttatctctccaagagattacaaattccctgctaagttttgtagctacttaaattttagaattaaagaaactgaacacaaaatttaaaaattcagttccctcactgctcaagagctgtatatgtgagtagaggctactaaactggacagcagagtgaacagaactttcagacaatgaggactctttgtcattatttccaacatcccagaaagttatgctggagaggctgctttgcatgatctaatatttcccaacacatagaaaaacaaaaactaattatgtattgatttggagagagaatgatttggaaagagaagcgtattttgtcattgaagggaatgacagttgtaaagaatagaattgtcactcacaacttttgtgtgattagaaagacttagccaaatataaaaggggcagagcagaaaaggaaaaggactcttagaataagtagaacacaaaggaggaggaaaatcttagtctctgagaatggatgagactgtaacagatgggaggaggtgggtttcttttgggacgtcttagagatgacgcttttatttgtccataagacctatcacccgctagggttaccatttcagagatcccagcttctctgtgacctgctgaactgagatgtgatttttcttttcttttttttttttttgagacatgatttatcttcatcattctcacttttctgggagtaggtctcttggccttctttatctggttttttaaccttcatcccatatggatacactgtccaagttacagtaagtgctgctcataggaaaataaatggaaatttgccttgtggctaggtcagaattcaacagaaatcctgggttactaggtaaccttttttttgagatggagccttgctctgtcgcccaggatggaatgcagtggcacgaactcagctcactgcaaactttgcctcccgggatcaagcgattctcctgccttagcctcccgagtagctgggattacaggtgcctgccaccacgcccagctaattttttgtatttgtagtagagatggactttcaccatgtttgccaggctggtctcaaactcctgacctcgtgattcacccacttcggcctcccaaatgctgggattacaggcatgagccactgcgcctggccactaagtaacttttatatatcatcactgtgcaaggcactgttttagatacagtaggatggatcggtgaacaatacaggcaaaggaataacctttataaactttaccattgagtgaggcagagaaacagattgtacgatgttaggaaggagaaaaagactagtagtggatactaatgcatacgtagtgatgggggcttttaaaaatatgttattttttttctccaagggaaggcttttctggatgtaatttgagccaagacctaagtgtactgaggagagcctgttacagcatttgtaagcacagaatactccaggagtatttgtaattgtctgtgagcttcttgccgcaagtctctcagaaatttaaaaagatgcaaatccctgagtcacccctagacttcctaaaccagatcctctggggctggaacctggcactctgcatttgtaatgagggctttctggtgcacacctaattttgtgcatctttgccctaaatcctggattagtgccccatcattacccccacattataatgggatagattcagagcagatactctccagcaaagaatcagaaatgggcgctccaccaaccaggccctatccacatctggcctttgtgaatctgcacatccttccatggtaaggtcaggttgcttatgctctatcagggtctaaggatgagttggccaggcctaccctgagcaattgcttaacgtacctttcagagcttgacctcccagatgaaggaggctcagtgcatacctaagcttggtacacatcatgtctgctcccaaacccaagatccttatagtttcactgaagatcacccttcatctgctcccatgacctcagtccctcctgggccaagaggcagtcctgcatagtgatttggaatgtatcctgaagtcacactgcttagtttgaatcctgccctgccatgcccaagccatgtgccatagagcaactaatttaccaaggtcttgactttagctttaaaatatctgcctcaggtttgttgtgagaagtaaatgtaaagtccttaaaacagtgtctagcaagaaacacaattaatacaagtaatgttattagtcccagtgaggggaagaggaggaatcaagagtataggtgtgcctgaacttaatcaaaactgtgacttgatgacaaaaaggttgccacgcactgagccaaggattcctcatatagcatactttttaagcttaatagagctgtgattatgaaactctctagctttaaactttgaaacttgcaatgactgttctgcttggggtctggacaatggcaaacatccttaaaatggccatcaagtctgcatgttccggttctttcttccctctcccatactccaccttgctctccctgttctgacacactggccctcttttggcccctcatatgctgctgacatcctttcatcaccttcaggcctctgtgcatgctctttcttctgcctgaacttttctttccccccattttctgcatttttcctccttcaggatcttcaaacatcactaattcagagcaactttccctcaccagtctggccttccataggatcgtgttcctcttcttcctagcacttaggggaactgcagtttaacattttgtagatttccatgtgcattccccatctggattctaaacttcctgaaggcagagagtgtggggaaaagaaagagagatcagactgttactgtgtctatgaagaaagtagacataaggaactccattttgttctgtactaagaaattcttctgccttgagatgctgttaatctgtaaccctagccccaaccttgtgctcacagaaacatgtgctgtgttgactcaaggtttaatggatttagggctgtgcaggatgtgctttgttaaaatgtgtttgcaggcagtatgcttggtaaaagtcatcaccattccccagtctcgagtacccagggacacaatgcactgcggaaggccacagggacctctgccctagaaagcctgggtattgtccaaggtttctccccactgagacagcctgagatatggcctcttgggaagggaaagacttgaccctcccccagcccgacacccataaagggtttgggccctggaggattagtaaaacaggaaggcctctttgcagttgagataagaggaagccatctgtctcctgctcgtccttgggaatggaatgtctcagtgtaaaacccaatcgtaaattttgtttactgagataggagaaaaccgccttatggccggaggtgagacatgctgggggcaatactgatctttactgcactgagatgtttgtgtaaagtcaaacataaatctggcctatgtgcacaacaaggcacacacagcacctttccttaaacttatttatgacacagagtcctttgctcacatgttttcctgctgaccctctccccaccatcaccctatagtcctgccatatccccctcaccgagatggtagagatagtgatcaataaatactgagggaactcagagaccagtgctggtgtgggtcctctgtatgctgagcgccggtcccctgggcccactgttctttctctatactttgtctctgtgtcttctttcttttctcagtctctcatcccacctgatgagaaatatccacaggggtggaagggctggcccccttcaagagagcaggtctgttttttcctcatcatttcacctccaacattgggcactagatcaggcacctcgcagatgctgagacagtatttggttgaattaaggagtgttgctccaacagctttcaagctacttagctgccaagtggcaggctgtagattcaaatgttttctggcatctaaaactttttttttttttttttgcttggagggtttgttttattttatgatctcatccttagattaccctgtgatcagcctccactcctagggcgatagagactctactggctgtttatttttactctgaaatagtttgactaggtcacatagtcatgcgattcaaaacttaaagctgtacaaaaaagcacatttgtgaatatcttatcctgttctcaatcctagttttcccctgaccttctagcttttacaggtaaacatgtttactgtgaatccgtccagtgtttctttttataatacaagtatatattatttatttgtccttttttcaaaaggtggcatacagcatacactcttttgcatcttttctatgttttgtttgtgacggagtcttgctctgttgccaggctggagtgcagtggtgcgatctcagctcactgcaacctccgcctcccaggttcaagtgattctcctgcctcagactcctgagtagctgggactacaggcacgtgccaccacagccaactattttgtatttttcatagagatggggtttcaccatgttggccaggatggtctctatctcctgacctcgtgatacaccgcctcggcctcccaaagtgctgggactacaggtgtgaggcaccgcgcccagctgcatcttttctatgtttaattatcactgagcagcagcacagcaccttgagggtaagtgaagaaggaaagactgtagcctgtcagccaaatatggttatttgttcaatagtcttattattgaagtgctgtgttccagtttttgttctgagcactggggctaaaaataaattatagacttctgcctttgtggaactcacagtccattctgaacagcagttaagtgagcagatgatgatgatcaggaaaaatgatcttcaattattcccggaagagagatgcttcctctatttccctattgaatgccttctatagttcccttccttagccccacttaagagttgcaattttatatttaatgattgcattattataaataagacaaaactgagaggcatcccagaatgctgtctgaagaagtgacatttcaaatgattcatgaaaggacaagtatagtaactaatattccctcatgttttcctgtgtgccaaacacttcacaagaagggaaagtacttgcaaattcctggtagcgtataagaccacaagatacctcagaaggggcggaataagaatcaaatgtacagcatagagtaatggaacctgagaatggagaatctggtgtttgcttgtgtacagctgaagggggccagcccctccacacctgtgggtgtttctcgtcaggtaggatgagagactgagaaaagaaataagacacagagacaaagtatagagaaagaacagtgggcccagaggaccagcactcagcgtatggaggacccacgccagcactggtctctgagtttcttcagtatttattgatcactatctttacaatctcggtgagggggatgtggcaggactatagggtaatggtggggagagggtcagcaggaaaacacgtgagcaaaggactctgtgtcataaataagtttaaggaaaggtgctgtgtgtgccttgatgtgcacgtaggccagatttatgtttgactttacacaagcatctcagtgcagtaaagagcagtattgcccccagcatatctcacctccagccataaggcagttttctcctatctcagtaaatagaatgtatgatcaagttttacactgagatattccattcccagggatgagcaggagacagatgccttcctcttatctcaactgcaaagagatcttcctctttcacgaatcctcctcagcccagaccctttatgggtgtcaggctgggggatggccaggtctttcccttcccatgaggccatatctcaggctgtctca

SEQ ID NO: 12208 - DNA, 67067 bp, Homo sapiens
atgagagcaaagagagaccaagagacaggctctgctttgtttctgtttaactttctagttcttagtatgagtctctcaggaagcccagccattttcaggttccacaatttacttgaatttttcagcaaatttttctatttgctggtttgagtgggtttctgtaatttataacaacttgactaagacaaaatagaacagctggacgagtagggaagttggtaaaccttcagtcttcttaagactgtaattaatgccacacaaacattaacagaaaattctgatagtggctactcacaaaaagaggatgagcaaatttttttttttgttttacacaaaacagaagttgtttctagacataatattgccagaaatcatatcacatgagaagctgctgaagatgcttaggaagtttacccaaaaaaacaaagggctgtgatggatagtttttgaacttgaaagaccatcctatataagaataattagatgttttattgggagtcacattctgagttaatttaggaagaagtttctaaaaattttagtggttcaacaatggagcagcctggtgcttgatcttagatttgagaaagtgtaagaagtaagcatcctaaaaaaagaccaggaggcccttgagttcaggggctgtgtcttgttcatcttggtattctcagtacctaacacagggtctagtgcttagcaggttctctttcaatgcttgcttaataaataaaagaattaagagcagaagttttaacagaagttgagtgactatttggggtgatgtcaaagagatagaagactggactgaagaataatgattattaataataatgacagctttcatttattaagactttggtttgtgttatcttattgattgattgaggcagggtctggctgtgttgcccaggctggagtgcagtggcgtgatcttggctcactgaaacttctaccgcctgggctcaagcaatccttccacctaagcctcccaagtagctgggactataggtatgcaccaccacacccggctaatctttgtatttttttgtagagatggagttttgccatgtttcccaggctggtcttgaacccctgagctcaagccatctgcccgcctcagcctcccaaagtgctaggattacaggtgtgagccaccatgcccagccgttatcatcttatttaatcttcaagaaccgtatatggtagttgcccctgttttgcagaagtgggaactgcaacacagggaggttaagtagcaaactctacacaggcagtaagtggcagaatttgagttatctcctaatagtcagaaaaattactgcacatgtattgaacaattactatgttctaagagttttatacacgttgatctctaaggtgttttacaatgatgagtctatgatttcttgatatctgccacccatgttcttgcccaggaccgtcctctgcctgggtaagtcagaggcttggggccctcagcataaccagcttcctttaccattctgaagtctgaagtagttcagttttcactgctcattgactcaattatctgctcacaccttagaaaagacaaagcactggcctcatctctccaactcaatccaagtatgttgttccttaggagtcagacatctctcattaagaatggagaagtcttcatcctttcagttagcctctttaatttaggggaaatgtaagttaacaacaaaaaaagattttcaaatctgatttactttctaatagtataattaaccttcagtgggctatccatttctagctgagtggcttttttgtttttgtgttgcttttcctgggaaggctgcatgcctgtctgcctgtctattggcactaagaacataccagccttctatcattggggagttgctgtgaacagcctcagaggagcagccccatagctgctggccactggtttttgcagcctcagcacccctaaccccttggggatgggagattaaacactggtcttaggtctgaggtgcaggtgctatgtgactttagataatccatattcctccctgaaataatatgcactttaatatttaactttatacatattctactgttctgtatacttcaagatgaatacatgtttctgtctttatttatagcctattttgtatttttaggaagcccttgagccaaacaagcatgacttgtgggtggcagtcataaagcaacttaataattgtcttctagtctctctttaaatttcctctgtgtggccaattatttccctgcctgtgggtaaactcagttagatgctgagacttttatggacctttgtaggtgttaaaacacagcctcaatacaattgctcaaatgttctgtctaaggtgataatcaaaactgttaaaaagttgcagcttctctcctattttattttaggcctgctgcagacaagagacctacagttggagaatggaagcatagccaccttcttctctcctttttgttgcctttttgtgggttcattgacatctctacacctgtaccctcagctggagaactctttcctggcctctctggcattggggcacgggtggaggagaggaaaggacaataagaaagtttttacttgtctgatactgctgtgattaagctgatacatcctctggtggggcattttcaagagtctttcaagataacttaccctcgttgctggaaatccatatcctgcagttctcttactgggacatctttcttttggctggttctttcctttttcttgacccctgggtaactagcgataccctcagtatgttagtcagtttgtgctggtgtaacaaaatacccaagactgggtgatttataaagaacagaaatttatttttcatggttctggaggctgggaagtccaagatcaaggcaacaacaggtttgttgtttggtgagtgggcagtctctgcttccaagatggcaccttgaatgctgcatcctctagaggggaggaacactgtgtcttcacatggcagaaggcagaagagtaagaggcatgaactccctccatcaagcccttttataaggtcattaatcccatacatgcgggaggagccctcatgacctaatcacctctttaaggcttcacctgttaatagtatcacattggccattgaatttcaacacatgaatttggaggggacactttcaaaccatagcactcagttttccttttctgaaacctctatctaagagatggaaagggtctaaaatgaccctgtacaatctctcttgaatgaacttcatctccttcatagaaagcactcacacatcttttatctgtaaatcctaggggaagaaggagggttgttcctaaccaagcagttcttctttgcactgctgactgctgactagtgagcatatctcttgccctttttagcatttccaggtaggattcagacacaagcccactgtgccctctgaactgtagatgccacatattaaacacccagtggcttcctcaaagcccttttcttttgactggagatttggaggtgggactcacagctcagctctttttgaagaaatccttcatgaagatcttctttagaaatcctcttaaatcccccactcctggcccctcccccccttttttttgagacggtgtttcgctcttgtcacccaggatggagtgcaatggcgtgatcttggctcactgcaacctccgcctcctggattcaagctattctcctgcctcatcctcccaagtagctgaagtagctgggattacaggcaccaccccccaccccgccgccaccatgcccagctaattttttatatttttagtagaaatggggtttcatcatgttggccaggctggtcttgaactcctgaccttaggtgatccacccgcctcagcctcccaaagtgttcggattacaggcgtgagccactgcacccggccttctcctgactcttttatacactcagtgtgcggaagatttaagagttgcctaacttgttttacttctaaattcttcatctatgttctttatttgaaatttgctatttatcatgcctctaccaaaatgtctattttaacatctgtaatgagatttcacttgtttattcaaatagcattaagctcccactagaccagcacagtccactagcaatataatacaaggtgcatatgtaatttaacactttctagcagccagatttaaaaaaagaaaaaaacaggtgaaatgagttttaataatatatcttatttaacataatatatctgaagcattatcatttcaatatgaaatcaatttaaaaatactaatgagatattctacattcttgttttacactaggtctttgaaatttggagtctacacttactccacattccatttaggaccagctacacattcagtggtcgatagccataaatgatgagaggcaactgtagtggagcagtagtacagcagtagactgtaagttctgtaggcaaagttggtgtctgtcttgttcattgttataaacaacagtgtttggcatagagtaggcattcaatattgtgaaattgaactaaatataattgaaagaatgaagacattaccaagggaatccttcaatgtttccccacagcacttacagtctaaatcattcaattctgcacgcaattagttggcccacatagtttgtaattaaattattccacaagcatttaaggttcacaaaggaggaagcatcttcatcttgttatctgttgtatctcccagtcaaccacagttcctagtattgtgatgtgtagattcatgcaatcaacaaatatttatttagtgtccacgccaggccagttactattttaggtgctggggatactataagggggacacagtctctgttctcatggagctcacagacaataaaaagttacaagagctttgaaggaaataaataaggtgacatgagagagtgtgatggaggacagagcaaggaagtacggaggagaaggagacagtattgtgaagagccagggaagggcaatctgagtgtgtctttttgaggcagccacattgacttttcattttctcgaattctccaaactcatttctgcctgtaactttctattcctttttcttgtgctgcccaccctctcccttgctcttctatagctggtatcttcccatgtctcagctcaaacgcaactgtctcctcaaagacaccctccctaaccacctgtctactgggctcatcacccttgacacttcctatcacatcctgacattttgtttagtaccacaacctgaaatgatcttgtttatgcttctatgaaattgccttgacaattgctatctttcaatgctgagaaaagtgtccctatgacaaatatatgacccacaattagtgatcaatagatatttattaaatgaatgaatgactgaaggtcaagagttaaagcatttgggagatgtctcaagtcatggtttgaataaatgtaaatgaagtctaggaagaaccacactctatttgtctggtttctctgagaaggaagatggggttaatggatgtgggatttatactcttgcgccgtctcgggcatggggcaacctgagttttggttccagctcctttgagaatctacagctatggaccatctgaccgggtaaatggccacaaacttttgcttataacttaagggggttcgtggacctcctgaagaggtcaaaggaccacaggttaaaaattcctgtagagataagagatttccacagcaacactgggaggcaggaggcaggtgttcaatgagataatgcacgaagcatctttaaagaactaggcctggcgaagtgtggctttggggagaggtggtgtccgaagaatccttggaaaccaaattcttttgcacctagcagctggggcggtggttgctattgacgcttgcctcctccaatcatcgcgcggcttgctaggctgtgcggctccgtggttaccgtggcaacggacggcaacagctcgggcggcgcatggagagtgcgggcggcttcaagctgggyatggagcccctcagcggcggcggggtctgtgagttggwcgcggggtcttggcggggaatggaggtagaataaacgtgggacccggagtgcaccaaggtcagaggtcctcgcagagattgtggggtcaaagtgtgagggacatgggggctaaccggggcgtcscctcttttcgtcctcgtcctcgccctgcgtcccaggcgttctccagactttccagacccctcccctcctcagccttccctagccacttctcactcccatgaaagttacgggacctcggatttttgttcttgggattcccctgccagacaggtagcctgaagggcagaaggcctgaggtgctgcctcgcttccaacttggaattagccccaggccttggacgaatcatttcccgtcttaccggggaaaatggtaaaattcacctcttttaggtgtacagttccaagagttttgaaaatataaagttctgtactgtattaatctgttatcattctgctaataaagacatatctgaggctaattacaaagaaaagaggtttaattgactcacagttccacttggctggggaggcctcacaatcatggtggaaggcaaaggaggagcaaagtcgtgtcttatatggcggcaggcaagagagcatgtgcaggggaacctcccctttataaaaccatcaaatctcgtcagactcagtcactatcatgagaacaacccaggaaaacccacccccatgattaagttacccaccatggggtccctcccatgacacgtggggattatgggagttataattcaagatgatatttgggtggggacacagccaaaccatatcatgtacttactgcaataagtatgtaraatgattccattagctcagaaagtatctcttgtacctcattgtagtcaatgccccttccccacttccagcccatagcaactaatgaaatgatctgttttctgattctgcattatccagaatgtcacataaatgaaattataacatacatagcactttttgtctggcttgttatacttagcatattgcttttgagatttaaccatgttgttgtatgtaacagtagctcatttcttttcattgctgcgtactattctattgaatggatgtaccatcagctgatggacattaggattgcttccagtatttggtaattattaataagtaaaactgttataaatattcccatacaggtatttgtatggacatatgttattattttgataaatacctgggagtaggattgataggttatatggtaagtattaattttacaagaaactgccaaattgcaaccttgttagcaggtgatcttttttttatatgtatatatttttattctcctttaagttctagggtatatgtgcacaacgtgcaggtttgttacatatgtatacatgtgccatattggtgtgctgcacccattaactagtcatttacattaggtatatctccaaatgctatccctcccccctccccccaccccacaacaggccccggtgtgtgatgttccccttcctgtgtccaagtgttctcattgttcgttgcccacctatgagtgagaacatgcggtgtttggttttttgtccttgtgatagtttgctgagaatgatggtttccagcttcatccatgtccctacaaaggacatgaactcatccttttttatggctgcatagtattccatggtatatatgtgccacattttcttaactcagtctatcgttgatggacatttgggttggttccaagtctttgctattgtgaatagtgccgcaataaacatatgtgtgcatgtgtctttatagcagcatgatttataatcctttgggcatatacccagtaatgggatggctggatcaaatggtatttctaattctagatccttggggaattgccacactgtcttccacaatggttgaactagtttacagtcccaccaacagtgtaaaagtgttcctatttctccacgtcctctccagcacctgttgttttcctgactttttaatcgccattctaactggtgtgagatggtatcttattgtggttttgatttgcatttctctgatggccagtgatgatgagcattttttcatgtgtctgttggctgcataaatgtcttcttttgagaagtgtctgttcatatcctttgcccactttttgatgggtttgtttttttcttgtaaatttgattgagttctttgtagattctggatattagccctttgtgagatgagtagattgcaaaaattttctcccattctgtaggttgcctgttcactctgatggtagtttcttttgctgtgcagaagctctttagtttaattagatcccatttgtcaattctggcttttgttgccattgcttttggtgttttagacatgaagtccttgcccatgcctatgtcctgaatggtattgcctaggttttcttctagggtttttatggytttaggtctaacatgtaagtctttaatccatcttgaattaatttttgtataaggtgtaaggaagggatccagtttyagctttctacatatggctagccagttttcctagcaccatttattaaatagggaatcctttccccatttcttgtttttgtcaggtttgtcaaagatgagatggttgtagatgtgtggtattatttctgagggctccgttctgttccattggtctatatctctgttttggtaccagtgccatgctgttttggttactgtagccttgtagtatagtttgaagtcaggtagcgtgatgcctctggctttgttcttttggcttaggattgtcttggcaatgcaggctcttttttggttccatatgaactttaaagtagttttttccaattctgtgaataaagtcattggtagcttgatggggatggcactgaatctataaattaccttgggcagtatggccattttcacgatattgattattcctatccatgagcatggaatgttcttccatttgtgtcctcttttatttcgttgagcagtggtttgtacttctccttgaagagttccttcacatcccttgtaaggtggattcctaggtattttattctctttgaagcaattgtgaatgggagttcactcatgatttggctctctgtttgtctgttattggtgtataagaatgcttgtgatttttgcacattgattttgtatcctgagattttgctgaagttgcttatcagcttaaggagattttggcctgagaagatggggtttcctagatatacaatcatgtcatctgcaaacagggacaatttgacttcctctttttctagttgaatacactttattcttatagctgtgtagtggtatctcattctgcttttaatttgcatttcctggtgattaatgatgttgaataacatgcttacttgttattatatctttggtgaagaagtttggtgaacttggtgaagtttctgtttgtatcttttgcccatatcattcatatatatatatatacacacacacacacacatacacatatatatatacatatatatatgacaaaagtcagatatttaatttgcgaataatttctcccagtatgtgacacatctttcctttttaaaacattttgttactgaaatgccaggggtttgatctagatctcattgtttacagcacagaaagccaatcactggaacaaagagtactgccagggaagaaggctttatttgggtgctgcagctgtggagatgggagatagtctcaaattgtctcactaactgactaaaattggagatttaaataccagggaaagaatgtagaaaacaggaattagggaggagtaaggaagaggaatctggtctctcactgtctggatgcggtgatctggtgagtttcagttcctttatactctctgggaggcccgagcrtcagttttctaagaaaggaactcagataagataaatataagtttcaggcttaagaccaagagggccaatttctgtttatttaaaaagaccataaacatcagttctgtgaggaaattgggctggtttcaattttcttcataatgtctttgaagtcaaaagttttgatgaagtctaatcttactaattttttcttttatgttttgtgtgatatctaaaaacctttggcctaacacaaggtaacaagattttcctcaatgtttctttctcagactttcatagctttgggtttcacatgtaggtctttgatgagttttgagttaatttttatgtatgacgtcaggcaagagttgaggtgtttttttttcataaggctgaatgttccaaccccatttgttaaagagactctcctccctccacttaccttggcacctttgtcaaaaatcagttgaccatgtatgtgtgaatacatgtttctgatttatcaatgtaacagaatattccagaaaaatatgaataatttttgtttctcaaatgaactaccagtcattttaacagcataaaatcgatttcttgataactttacagtgaattttgaaatctggtagtttgagtccttctactttgttcttatttttcaaaattgaattggcaacattggttcctttacctttccatacaaactttagaattaaaggttaacatctccaaaaatatctgctggcattttgattagatttcattggagtatagattaatttggggagaattggcatcttagcaatactgaatcttccaatttatgaacatggtatacctcctttgatttagtcctctttaatttctctcaatgatgttttataatttttaacatgcaacttttgcacatgttttgttagctctgtttttattttctgttttttgatgctattgtatatgatactgttttaaaattttcagtttccagttgttcattccttgtttcatacccaatcaaatgttaaacctcattcaaatgtcttggtggggagaactgtgttgtgtttgttgcaagcccctcctccttctttctgaacctcaagttctaagcaccaagagactttagcagatttcactctgtgtttcatcccacaatacctatggccagaatcacccccaaaatgatggcaggagattccccacaagggagtgccccaaactgtccagagatagggccggttgggattccaaaaaaagaaggaaagactaaatgccagagtggtcaatccaaagcatttattggggaaacttacagagtgctgcagcagtcctcaaaatgaacagtaagagaaaacaggtgttctacctaggtatgactgcagtgagggggtcagggtatgagagtttaaggaatttggctcagggccagggctagtttctttttcagtgttgtgggcagcaacctagatacctttatcagtgcctaggaatgttccaggcccaggtttgggttcaagtctgctacgaaaaacctgcaactggatagatcacagagcagtcaggacacagaaagaaagtagtggggaacggagaaccctacactctttctcattcaacttcagagctctcatgctgttccacttctcagaaaatcacccataggggaatctggccctcgctttttaggttcctgttcgtcttgccagattttacaaccatcacctattctgttggtgcytcctcttaccttaagaatcctctgcctgagccaagctggattgtctccctgtgcctagaattagcaaatgtccccagagaaaaacatgaccagtaacttcaactcattgatgagaggccatttcccttctgaaattttagttcttctagtccattgttaaaagaaaaaccttaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaagaaaaaccttagccaaattaaatttaacagagtttaatttaattaaagaatgattcatcaatcatttcagagcaaagaacaatttgcaaattgagcagcctctttttaaataattttatatttcaatcatttttgaggtacaagtggtttttcgttacatggatgagttctttagtggtgarttctgagatttcagtgtacctgtcacctgagcagtgtacactatgcccaatatgtagtcttttatcccttaccctacttctgacttccccaaatgagttcccaaatttcatcactctgtatgtctttgcatctcatagcttagctcccacttataagggagaacgtatggtatttggtttttcactcctgggttacttcacttagaataatggcctccagctgcatccaagttgctgcaaaagacattattttgtcactccttatggttgagtagtattccatggtatacacattttacattttctttatccacttgttgatcaatgggcacttaggttggttccatatctttgcaattgcaaattgtgttgctgtaaacatgcatgtgaatgtgtctttttcatataatgacttcttttcctttgggtagatacccagtagtgggattgctggatgaaatggtagatctacttttagtggttgtactaatttgcattcccaccaatagtgtagaagtattcccttttcaccacatcccaaccaacatctattgttttttgactttttaattatrgccattcttgcaagagtaaggtggtatctcattgtggttttaatttgcatttccctgacaactactgatgagcattttttcatatttgttggctgtttgtatattttcttttgagaaatgtctcttcatgttttagctcactttttgaagggattatttgttttttttttttcttgctgatttgtttgagctccttgtagattccggatgctagtcctttgttggatgcatagcttgcaaatactttctcccaccctgtgggttgtctgtttactcttcttattatttcttttgctttgcagaagctttttagtttaattaggacccatttatttgtttttgtttttgtcacatttgcgtttagggtcttagtcctgaatttctgcctaagccaatgccagaagaagagtttttccaatgttatcttctaggatttttatggtttcatgtcttagatttaagtctttgatccattgggagttaatgttttttataaggtaagaaatggggacccagtttcattcttctacatgtggcttgccagttttcccagcaccattattgcatagggtgtcctttctccaatttatgtctttatatgctttgtcaaatatcagttggctgyaattatttggctttatttttgggtwctctgttctgttctattggtctatgtgcccatttttataccagtaccatgctgttttggtaactataaccttgtagtataatttgaagtattgtaatgtgatgcctctagatttgttctttttgcttagtattgctttagctttgtgagctcttttttggttccatgtgaattttagaattgtttgttgtagttctgtgaagaatgatgttggtattttgatgggaatcgctttgggtagtatggtcattttcacaatgttgattcttcccattcgtgagcataggatgtgtatccatttgtttgtgtcatctattatttatttcagcagtgctttttagttktccgcgtagaggtctttcccctacttggttaagtatattcatatgtattttattttattttatttttttgcagctgttgtaaaagagattgagctcttgatttgattctcagcatggttgttgttggtgtagagcagtgctactgatttgtgtacattaattttgtaacctcagactttactgaattcgttcatcagatctaggagccttttggatgagtctttagggtttcctaggtatataatcatataactggcaaacagtgacagtttgacttcttttccaatttggatgccctttatttttttctcttgctggttgctctggctaggacttccagtattatgtcaaataaaagtggtgaaagtgggcatccttgtcttgttctagttctcacagggaaggctttcaacttttctgcattcagtatgatgttggctgtgggtttgtcgtatatggcttttattattttgaggtaagtcccttctatgcttattttgttgagggtttttaccataaaggggtgctggattttttcaaatgctttttcttcatctactgagataatctatggtttttgtttttaattttgtttatgtgatatatcacatttattgacttgtgtatattaaaccatccctgcattcctgggatgaaacccacttgatcatgatgtgttatccttttggtgtgctgtgggcagcctcttgagccagagtaggctcagaaagactccagtggagccatgtggtagaagatgatttgtggattgaaaaaagaaagtgatgtacagaaaatrgaaatgaggtacaaaaatagccagattagttacagctcattgcttgccttatttgaacacggtttgaaaagttggccacctttggccaaaactcagtgattggcacaagagtaggctatggtctgtttacagcttcatttaggttatagttcacaatgtacagagaaacctttaggccaaacttaaaatatgtaaggaggcagctttaggctaaacttgatttaacactatatttcttctatacctctctaatgtcttaaagtatatgctttttgtaatttatctattttattttctaattgttgaagtagatgctatcaaatacattcttcttagaattagatattctattcattgagttttaatttttattattttaattttcatttcttgaatttcttttcctacaggatgtttttgctggttcttgttcagggtgcttttcccactctcttagtatgcttgtttattttgaccaagagctgcttattgtccttggaaaattatttatgggaagtgtttgatgactaaaatgaaggaggacctcagagaggtcctcagagaaggaggttcatcagagagggtttgcatttgcctctgttaggtacctcagggaactacctgtccaggcttattttaaagtaaaaatcatactttgaggcttttggagctcacaggtgatatgaatttgggctgtacatctctaagagagttggctgtgattctaacctttcagggtttttttttttttctttatacctttctctctgttaggtgccaaggaatcgtcccctgcattcagctgggaatggtgggataggaaggctttatttttgacccaaacgttgaaagtgtacacctttggagtggagtcaactatcagtctccccacctttgatgggtcctgggtgttgacctttcctggaagccctaccaggcagccacaagcagagctcagggtgtccttgtctrgaggattatctcctaccaaatttgtttcagtgctccacttacctttcttggtccctgttttcagttagatgttggctagataattccttatggtcttgttagctttttgatgcttttgagaagctgaaaaaatattttagccagcatttttagttgttttcagcaggagagttggttcaaacaaaccagcataacctatattagaaaacaatgtattactttgtagtcttaatttttagcacagtcatttacatactccttgtaaaaaattaaataccttagaaatgtaaacatgaaaggcttctcattactccactctctctcctagtctggttccccagaggtaactattcttaataatttttgtattgaatcatttattgagagcatcagagtaaatctttcgtgaaacctggatgtattcgctgtatacatgtgtgacaaagatggaaaaattcaggtttagcaaatgccagctgaagaatatatacatgcagactagtgacttaaatattttctttttatgtgaagtgtgtattttattctatattatatctaaagatgtgacaatgaatgcatgtcagaagctcttagaaaatgatacttgtaagttggtatttcattttatgtcttgtatacaaggccaaattagagttatttgggggaaggaatacttctggcttgtgtgtgagaatgatttatgcaatcacaaagtagaaggaagttattaccccttagtagttatatagtttcacaggctttaagaatagttttgagaatgtttcttcactttagcagcagaaacatttagaacatgaaaacgctcatcaggtttgaaagaaactcatagcctgttagtattgaaaccatgttttaattggtacacattcgggatctgtgtaayagatttttgaccctggatgtgtcagccctcagattttatgtttatgttaatcttctgggggatagtgttcatagccatcatcagatttccagtaggacctggaccacaaaggttaaagakcactggtttgggatgagtacatttcagaacgcaatggaccgaaatacgctgaaccacagttaccatcattaaaagtgaaacgacaactcattcctgagggcaaactttttctttcaaataatttcttccaagatctgtttcctcattaacactgcagaagcacttagcatttggctgctcttcatacaaaatgtcgtttgagagggatgggggcttggaataaggcaaaaataattgtaggattattgctggaagggtttcaggtgaggaaaattgacatatcataaaatgcctctaatgcaatttaatttgaaaaactgtgcaatcttttaatttatttggattcaaagtgttttagttatctgatttttttaaagggtcatatttatcccttgaggtggtatggaggaaaagtggacttttaaaaattgttctgtgcttgatagaaaggcttgttagaaagtattggttcaaataaaccagcatatcctatgttagatcctatattcttaaaggggtgatattcatcttaatatgaataccaaatcctatactaaatcctatattcttaaagtggtggtcttcctcttaataccaaaaagtcaacttggttgactttaaagaaaaattagtgtgaaatgactagaaaaagcaatctcttgtaatttcactggcaatgcataaatctgccccttattttttttttaaaatggcatcttcttgctttaataagctatctaaaatgtcctgaatgtaaagttgctctaataacattatgatctgactgtatctgtgtctgtttttatttctttaaactgctattatgagcctaagttaaacaactttgcctaattctatgttctgtacaactatgttgttgatgctcatttttattataaacaatccacccaaatttgcagcagtggctttgaaaaaatccctaattaaaataaatttcaaggttaagctatttttattgatgtctgaaaacaattaccagtactcatggcttttaaaataatgacagtgtgggaagcatatttcaaaaccaggaaagcagaaatttgtgtttatgaagccaaaagtagtcttgcaatgctttggaatatgcctggtaattaattatagatgatatcatatgaaacctcaaagattttggtgggagatggaaacaaaggggccttatgcatttcatttctgatataatccttttgctgctagagggaattacgatttaataaaaagcaataacaggaggatgtactctaagaatactaattaatacctttagctctaccagaatgagattctgtaaaaaatggtgggttgtcagttgccaaatcatraaatattgcagggagggaaaaggcaacatactctttcacaatatggcttgttatgttaaaactgttagtggtagggaattttgtacttgttaatcatttgcgtttttacatcgctgtttgtaattacaattaaacagatggttctgaaaaagatagtgtgttcttagcaattaaaaccatggcaaatagcttttcctcctccccagtatacaattaaactgaatagaatcacgtaacccagtgggttcttcagaagaaaggttctgtgtggattccagtagattagtattctgctccccagccctgtcatcttgacctcttgcccagctgaaagctttgcagctggctgaggacttccaaacatgggttttatggagtagttatcccttctctgttttctccccatatcttatycttaccacattgggattaatagaatatgttttagagtggatctttggaacagtcgctaacaaccactgggtgtgttgaatctaatacagcttgctaaattctaggagcttggctagtgcatgaaattcctcaagggcacaggaaaattggtctttttttttcttattcagaaaactaatgatgagatgtttgtttatgaaaaaatcatttcagagtttgtaatcaaaagaatacagaatttactttgcgttctagggaaaccaaagtctcaccttattgactgatcccctcatccctattacaacaaattcaggagatttttcaacaacgattcagcaccccaagaaatatttcaccagttratatgtggctttgtggccagtggtccctctcttggaccagacctcagcagcgtgaatggctctcccgcaaagcagggatttggagctggctgtgatctgttcgcagatgaaaccttggaaatgtgttttgtttgccatgagcataaatagtcccaagtatactttcaatgattttaggtacaggcttttgtgcccacaagtaagcagttatttgctggtgcaattaaccatctgcaccttattatgagggtgcagctggctaattatgctcggctccataggtcaggttcaacttctcatctgcataggaactgtatttgcagcaaaaggacattgacctttaaaaatgagtccttaaatttaaccagttcattttgaggtcaccactcgtggatttttattttgttttgttcagaagtgaaattcttatatgggtagtgtatttctacttgggcaaagtaattaatgcaggactgtagcacagacattatcatgagtcagggacaaatgagatctctacttaattcagatgattttggctcctcattctggagaaaggtccatcaatgtagaggtacctgtattcatgaacttgtctgaacgacaacttggggcatcatcgagacttaaaatgggggtaaatgtgtgcataagtcagttcaaaatcatttttgccaatagttgtacattattcttatgatctattggatggactatttgagagaagaacagcagaatactggaaaggagaaccttaaattttatgtaggttaaattaacagtcaatgcaagtttgctggatagaaagcatcatttaactggagacttacaggaacctgtccaaaaggtacctactgctatcagttcctgtgccaaacctgtgagcctgctggctgtaaaactcttttgtaggacaagagttgagcccaaaggcaagggatgtctagtcctcactgatacagtggagagagccttgtggtggggttgggaagcacarggcaaatgccttaaccacccatggagtctggacttggctaagcacttcccaaacttaggcgacctatttgaaaataccgatgtccaggaccgactatagattgactgaatcagaatctctagggtaggactaggtgatcctcagttgatgctaccctgggaaaaactgggttgcagaatttcaaagatgctttccaaattttaagaaatatttaattttcaaaatgaactctccttagaattttagttgtggaatagaacatacacgtaaatgtatgaaacacattgttaccatttaacaaataaagggaacagatgtgtaaccaccacctgggcaaggattaggatgtgggtatcctggaatccttctccatcatagccctcctcttccccacctcagaggtaactgctatcctgacctttacagtcattcttgggttctaatatagttttgccattttgtatacattcctagaaacgtagttcagtttttcctttgtctgtactttatataaattgaatcacactgtatrtattcatgtttcatgttgcttttctgccctcaacttgatgtaaaattcatccatattgttggtctctgtttagatcatctttattgatttgtgatattatattataggaatatggcawttttttctatatgctatcaataaaaacttgggttgtttccaatattccactattatgaataacactgctatgaacagtcttactcatatctctgtagcatgtgcatacatttctctggactgtctaccagggtaaaactgctgggtcatagaacatacgtatctttaagtttactagatgatggaatatgttttctgaagttgttttacgtagttacagcccgaccagcaagtgcttggcatttcccattacaacacagaggagccaatattcagaattatcagactcagattttgcctatctagtacatgtgtaggggcatcttgtggttttaattacatttccctgtttttttattagtttgggcatgtttcatatatttattagccatttagatattctctagtgtaaacagcctgttcttttgcttttttcccctattggattgtctgtttttttttttaatattgttttgtaggagttctttaaatattctggtacagtagttttgttggttatgtgtcacaagtaccttttcccattttgagacttgtccttttattttttatatggtgtttcaaactcctgggctcaagtgatcctcttgccttggcctcccaaagtgctgggatcacaggcatgagccaccacacctggctagtattttttttttttaatggcattaagattgattacaggatttacgtgttatcagccagattgattgattataatgttccccatcaagatttcaccccaaagttttagcataagagcttacatcctttcagtaggagtggcartgtgatgattttcaaatagtgctatcatatttcttgtacattcattcatcagctagaatttttctttaaagaactttttctcatttactattttgctaccatgaaatacattttatacaagaaaggcatgaattctcctcccttcctctttccctccctccttccttccccctccttcctccctttcttcctcctttctccatttctccctttctcccttcctcccttctttccttgcttcttcagaatagtgaattggtactctagtgacctctaaaggtgactaattagttttatcctgtctttggccaatgggagaaccctgyaagttggcctctatgttatttgattgatgaattgattgtacagtctgtgatagtttccttgctttcaggcatgaccaggtgtttcaggctcatcttgtctatttcctgccccagacttggctttataataagtgttgatgtctgatagagcagatctctcsattatcttatcctggatctctgccaaggagacagagcctgagtctaggacttgagtgttggtagtttatttttgctaagtgattgcgggggaggagtgagggactgaaagaatgaggcagggaaggaaataaaagcagtttaaggctgtgttcttaagttggctatcaacatggacaactgaggttttgtcccactgggaccctctgaagagccttataggatgtacctcaaaattgtctgcccaaagaatagaagaatgtagcttttacgcactaatttctgtctgtctcccactggtcaaggaatatgtccttcacacttccaggctgcatatgtgtgagcactaggaggttcctgtcagataaaccaaggacagaaaaagtgaaataatgcagtgcagctgagagggtgcttccaacttacactgtgggaagctattggtgggcctaaaggatgtgaggttgggtacaaaaatcctccaataatttaatttgttcttcttcaatataatctttgttattcttggcccttttcattctcataaaaatcttagactcagcatgtcaagtctcatctaaaattctgtttttttgaggactaaattttttcaagttttgatttatttgaagttccatttccastttgatctggaaaaatatcttttacaatactgaattttctaaccaatgagtgtggtatatctctttattacttaggtcatcttgaatcttaataatgtattatcatttcatctgtggtatagccctaggaatttgaactttttatggtattgtaattaactgttaggttgattttttaaaaacttttttgagtatatagaaatgcaattttaggatatatttattttatatttagcaatattgctaaacctattgattctaataatttatgtcagctttttggattttctaaaaatgttatatattcatattatctgctaacaatttgagttttgttttgtcctttccttgagtcttttttgtcttccagcattagataggaccttaaatttctgttgattggaatggtgataatgggtattaatagataaggatcttgttcttgatatcaagtaaaatttttcaatgtttattgattaagcattatgcctgctgtagatttttatacattgtagatatgcattattagtttggggaagttacttctatttttaatttgctaataacttttaaaaatcataaatggctttgaattttatcatattctttttctgcatctgttgaggctatatataatttttgttgaatgttgaactacattgttttgctaatgttaatataactttacattcttggttaaaattcaacatatttcaatatgttwttgctggattagtattctttttactattcrgtttttccctcttctagtttgggcattgtcactctcattctattaatttagtacttccttaagaatccaacatgtatgtatacttaactaagttaataaaaactgtcctatttctcctggacattagagagatctcagaactctttaactccgtgtacccacctcctgacttaaatgttgatattgtttacgttaaaatctatttaaagcctatttttactgttaatattataaacgctattattattttttaaattcatgacagcactcatgttcattttaaatcacttcactgttgaccatgtttcccccgccatttcttcttgcctcttagatttttccatttgggatcactttcgttttgcctgaattgcatcctttagatttttctttattgagagtctgccaaggtgaattccccaggtttgtttgtcttaaattgtcttttatttgcccttattcttgggacatatttttcctggttttagaattaaaagatgacagtttttcctttcactacatttgaatgcatcatcctactgtcttctggcttccaatctattgagaagttagctcccaatctaaccatgtctcatttggagattatttttttactggctcctttagtaattttctccttatttttggttttcttcaccctcactaggatgagtctagatacgactttttcccccatttatctagtttgagactttttgagcttcttgaatcttcattttggttgttctcaacacttcggtaaattatcagttgttatttgttagatgttgcctctgactcattatctctcttctcttacttcactcaagccttcagtgatatcagatctttgttctccatgtttcttaacttgtttactttttttgtctttttgtccctccatgtactgtcctgcataatccttctgatctattttctactttagtaatttttctcttcagccatttaaaatatactatttacttacatggaatatctaaattccattattttatcttttattgctggatgttatatttgaatccttttcaaatcttctatacaacttacccctataacattttgtttaaacgatttcatacctaaagaaaacttgaaataatagtacaatgaaaacccatataccctttaattagagtcawtccttgttaacattctgccacatttgctcgtggttctctttctctttcttgaatcatttgaaagtaagtttatgacttaggtaagggagatatcatgacacttatcccttatatacattagctggtatctcctaagaccaagaacattctcttgcataaccacaatactgttatcacagcctacaaatttaaaatggaaacagtattatctaatttacaatccatattcatatttttctgatttttcaataatgtccactatagtgtttttaacaatttttcaaggatccagtcaaagatcatatgctgcattaagttgttgaatttttacagtcttttttggtgtagaacagttgcccttcgactttttttgattgttgttgatttttgtttttcagcacattgacgtttttgaagactccagttgttttacagaattgctgtatcattttttcttagattcccgtgccttgmagatatcatcaagcttgtatgttagtacttcaaacatattaatcatggtttttttgtaatctgtatctaataattcccctatgtgaagcctttcatggtatttctgctatctttagtttctgcaaatttttgctcatggtgtcttactttcttgtgtttttgtttatttcttactatgtgttcctcactgtccttgaaatattatctgtaggtattcttattctttgtggtcttgaatgatggtgccttcctccaggggagatttttttttttttttttttgagatggagtctcactctgtcgcccaggctggagtgcagtggcgcaatcttggctcactgcaaactccgcctcccgggttcaagccattctcctgcctcagcctccccagtagctgggactacaggtgcccctcaccacgcccggctaattttttttgtatttttagtagagacggggtttcaccttgttagccaggatggtctcgatctcctgacctcgtgatccgcccgccttggcctcccaaagtgctgggattacaggtgtgagtcactgtacccggtccctccaggggagatttatatttaccaggtacctcagcatcttttagtctgggaataccccaagcctagctcatggcttgaagttctctggacagtttaagtgatgtggacctgggctgcaaatttgagtcagaatttacctcaactttttgggtatttttcctctttctttttattctctttttctgctcagcaccaggacaggttttatgacttgctagagatggtaatggagtggccagctttaattttgggtcccagtctaaggtagagaaggttcctcatacttcccatcttttgcaggctctgatcattgacttctatctctctgtgtgtgtgtgtaatatttcttatgtcatgttatrtgatttttattaaattgttttattttatatttatctcttttacagattataccttggtgctaactgacaacatattatttgctttatcatataatatacataaatttgtaaaaaattataataatatgactactaacaataaactaagaaattttttttgaaatcaatacagttgcatttattattctgtagggccaagtaacaaaggttttactaataaagatttttcatttcatctaaatgagtgaaattttagtctaattatagatagaaattaatgacatgctgacatacctggcattcatagacaatttgtttttttaaatatcttaacttttattttaggttcaggggtacatgtgtggcttgttatataagaaactcgtgatttgggggttgaatgtacagattatttcatcaccctggttctaagcatagtacctgaaagcttttttttttctgaacctctcactcctcccaccctcctccctcaagtaggcacaatgtctgttgttcccctctttctgtccatgtgttcttgttatttagctcttataagtgagaacagacggtatctggttttctgttcctgtgttagtttgctgagcataatggtctaacgytccatccatgttcctgcaaaggacatgatctcattcttttttatggctgcatggtattccatggtctatatataccacattttctttattgagtctaccattgatgagcatttaggttgatccatgtctttgctattgtgattagtgctgcagtgaacatacgtgtgcatgtgtctttatggtagaatgatttgtattcctttgggaccatactcagtagtgggattgctaggttgaatggtagttctcttttcagttctttgaggaattgccacactgatttctagaatggttgagctaatttactctcccaccagaagtatataagcattagttttttctagttccatgaagaatgtattaattaccgctagtatgataggaatagcactgaatctataaattgctttgggcagtatggcccctttaatgatatttcttctttctacccatgagcatgtaatatccttccatttgtttgtgttgtctctgatttctttgaacagtgttttgtcattttcattgtagagattttcacctccctggttagctgtgctcctaggtatttttttgtttttgtggtaattgttaatgggattgcattcctgatttggatcttggcttggatgccgttagtgtatatgaatgctactgatttttgtaaattgatttagtatcccaaaactttgctgaagttgcttatcagctcaaggagctttggggcagagaccgtggggttttctagatacagaattatgtcatctgcaaacagggatagtttgacttcctctcttcctattttgatgccttttatttctttctcttgcctgattgctctggccaggacttccagtactggaagtggtgagagtggacatcctttgwsttgttccaggtttcaagggaatgcttccagcttttgcccattcagtatgatgttggctctgagtttgtcatgcacagctctcattattttgaggtatgttccttcaatgcctagtttagtgatggttttcaacatgaagggatgttgaattttactgaaagccttttcttcatctattgagataatcatgtggtttttgtcttcagttctgtttatgtgatgaatcacatttattgatttgcatatgttgaaccaaccttgcatcatggggataaagcctactagatggtggtggattagttttttgatgtgctactggattcagtttgctagtattttgctgaggatttttcatctatgcttatcaagaatattggcctgacattttctttttttgttgtatctctgccatgttttggtatcaggatgatgctggcctcatagaatgagttggagatgactccctccccttcarttgtttggaatagtttcagtaggaatggtacccattcttctttgtacatctggcagaatttggctgtgaatctgtctggtcctgggctttctttggttcgtaggctattttttactgattcaatttcagagcttgttaytagtctgtttagggattcaatttctccctgattcagtcttgggaggatgtatgtatccagaaatttatccatttcttctagattttctaatttgtatgcataaaggagtctctgatggttatttgtatttctgtggggtcagtggtaatatcccctttgtcatttctcattgtgtttatttggatcttctctcttttcttcttcattcttctagctggtggtctatctatcttattaattgtttcaaaaaataaacctctggatttgttgatattttgtatttttttaatatctctatctccttcagttcagctctgattttggttacttcttgtctcctgctagctttggggttggtttgctcttgcttctttagttctaattgtgatgttaggttgttaatttgagatctttctaactttttgatgtgggcatttagtgctataaatttccctcttaacactgccttagctgtttcccagagattctggcatgttgtgtctttgttctcattagtttcaaataacttcttgatttcattatttacccaagactcatttggcagcaggttgtttaactttcatacagttgtatggttttgagtgactttcttggctttgatttctatttatattgtgctgttgtctgagaatgtggtcwgtatgatttcgtttttttgtgtgtttgctgaggattgttttatgtcagattgmatggtcaattttagaatatgtaccatgtggtgatgaaaagaatgtatattctgttgtctttgggcagagagttctgtagctgtgtactaggtccatttgatctagtgttgagtttaggtcctgactttctttgttaattttctgccttatctgtctaatgctgtcagtagggtattgaaatctccaactattattgtttgtgaaactaagcctattcatagatctctaaaaacttgctttatgaatctgggtgcacctgtkttggctgcatatagatttagggtagttaggtcttcttgttaaattaaacctttcatcattatgtaatgccctactttttcctttttgatctttgttggtttaaagtctgttttgtctgaaattagtattgcagcctctgctttttttttgtttctatttgcttagtagatttttctccatccctttacttcaagcctatgggtgtcattgcatgtgagatgggtctcttgaagacagcataccattgggtcttgcttcttcattcagcttgccactctgtgccttttaactggggcatcaagcccagttacattcaaggttagtattgatatgtgtggatttgattctgttatcatatagttagctggttattatgaagacttgtttgtgtggttgctttatagtctcactggtttgtgtagctaagagtgttattgtaatggctggtaatggtctttctatattgactgcttctttcaggagctcttgtaaggcagttgtgatagtaacaaattctgtcagcatttgcttgtctgaaaagggtcttatttctcctttgcttatgaagtttagtttgagcagatatgaaatttttggtttgaatttcttttctttaagaatgttgaatatagacccccaatctcttctggcttatagggtttctgctgagaaatatgctgttagtctgatgggtttcccctttgtaggtgacctgtcctttatctctagctgcctttaacattttttccttcatttcaaccttggagggctcatgattatgtgtcttggggatgatcttcttgtgaagtgtcttttggaggttctctgcattttctgaatttgaatgttggcctctctagctaggttggggaagttttcatggatggtatcctgaaacacattttccaggttgcttcctttctcccagtctctttcatggacaccagtgagtcatagatttggtctcttttcataatcccatatttcttggargttttgttcattcatttttattctgttttctttattcttatctgactgttatatttcagaaagtcggtcttcaagctctgagagtctttcctcagcctagtctgtgttgctgttaatacttgtgattgctttatgaaattgttgtaatgtgtttttcagctctatcggtcagttacattcttttctatactggctattttgtgtgtcagctctgtattgttttattatgattcttagcttccttggattgggtttcaacattctcctgaatcttgatgatcttagtttctatccatattctgaattctatttctgtcatttcagccatctcagyctggttaagaacccttgctggagaactagtgtggttgggaggaaagaagacactctgactttttgagttgctggagttcttgcgttggttctctctcagctgtgygggccaatgttccttcagtctttgtccttttggatggattgttttgatttttattttctttgatgcctttgaatgtttgattatggtataaggcaagtttgattgactggcttcgattctagtcttctgggtcttagaggagcctcctcctattactgtctctgtgtctgctttcttttgttggatattctggtctacagrgctccctcaggctggggctgcagttggccaacaagacatgtccttgccaggtcagccctaatctgctgttcatgtgcttcctggggaaacacagggttgtgtccacccacagagttcaggtggaaatgggactgctgagttggaaactctagtgggtgtggcccatctggctatgggcctttggggtgggtaggattgcyagccctactgtctgggtgtttccaaagcaataggaggctgcacctctcagcaaattcagggagacatagggctgyagggctagaagctctagcaggtgttgtctgcctggttatcagtggttgaggtcagtagggtcacatgctctgctctccaggacaacaggaggctgtgctctttagctgagttcacacagaagcaaggctgctgggctagaagctctacttagttgtccacttggctaccagtggcaggggtgggtagggtcttcctgtgacaacaggaggctgtgccctccagctgagttcacgcaaaaatgaaaccactgagctggaggctccagcaagtgttgcatagctggctatcaatggcagggtaggagaggtggccagccaatttcaggctggaggtgggccagaagctgacactgagccctggctggcaagcagtggcagaacaatgttggtgctcctcggaactacaactgtggcctctgttggagctgtggcactggtgctggtctgctctggggcccaaggcttgtgggggtccccttggactcggaattacccctgcaaaatgctggggtggctctctgcctcattctataagtgttggggatgggtttcagggggacaggatgattctctcattcccagtcttgcacaggcgtctgtagagagcatgaatcccccaggggttctcactcacttcccctttcccgtgttggagagcctctcctggctccacgctgagcccagacaggctggtgcgcagctttgctcctctctattctctgttttcccctgttgccctgatgcatcccaatgtggtttctcagatgatcactatgtagggtctgtattcattggcctttttgttccctctctgagagtggcacacatgagctccttctagtctgccattgtagcgtccgacttctatctcattggctggtaaggccaccaaaaccaaggcccagatttttctggatcagcaaatgccctaagggcaaaagtgactatggtgttctagggctttgcttacttctgtggtgcttgatttcttttattgtttggtctggtaatcatttactatcttgacagctctttaaggagattaatttttttttcacctatagcttttcattgtgtttacatggatggttggttcaactgttagttgccattactagaagtggaagtcctcttcacttttagaagaatatcttattgttttccttgttagagatatagagtggaaacagatatttttcatgctgttaatgggaattgatctggccaaaccctgtgaaagcagcacactaagaatttcctctcaatatttaccaacgtgataactaaaagaagaaaaatggccctgttatatgccagacagctcaagtacagtgttacattatgtaaccaatctctgtcattggttttcattactgaattctgttatgacacccatccaatatgaattaaaagaattacatttgacattttaataaaaggtagacatgcagcatttaacaagtatctgctagtaaggatgtataagagccagtgatcaatgttgaaagcactcaatcgagaasggtcaaactagcttgctgttcacttgcttctggaaattgccacatccctaatggctggtggagattgatgaaagcactggtccctttctctattgatttcagttggagccatggaagtgtcaatgagtaaayccaagtttgctcttctgtgtatagctggctttattaaaagaattctaagcatttttctgtgaagggaaatctgattcccaggtgttacttttttgtcagaatttggttaacaaacaagatcaatttttaataatgtttgcaaactattaatatgtttaataatgtttgcaaaaataactcacattgttagcacttggagaaaatgcatgtaaaatgtgtcagttttccaatctttagaacctgataatgaaatattttctttacttttttgagacagagtctgactctgtcacccaggctggagtgcattggcaagatcccagctcactgcaacctctgcttctcaggctcaagccatcctcccacttcagtctcccaagtagccgggactaaaggtgtgcaccaccatgcacagctaatcttggtattttttgtagagatggggtttcaccatatttcacaggctggtcttaaactcctgagctcaagtgatctgcccacctcggcctcccaatgtgctggggaactattttctrttatctgttctggactcacacattctggatgactggaattctttggacccatatgagcctctgcaaagacattggtatgtgctggtcatattcaaatgtgagattcataagaayrgaataatttgtgtatggaattacctgtcctgggttacctaatccagagatccagcaatttttcttaattcctgaatttccaggcattgtaaagcatacttmactgtgcttggcacagattaattagtctatatattatatataggtacaaaaagtataagcttattctctcctattctaatagaaatgaggcatttttaacttgcttggaaatagcaattcataccattgcatagtggttatttgcaaatcttcctaataaactccaggaataaattttaggtaaatgtatgatgcctacaaatatagtaattgtcatagagaatgctagatttcaagtgacagaaacttttacttcaatacagcttaatcaaaataataaatttattagtccgtttagttaggacactaggatggttcacaggatcaaaagatgaaccacagacatcagggtctcaaagtttggaactgctctcaatgtctgctatgattcacttgtattcatctttcttacctccttccatccatctatgcatctatccaccctgctcacatctctgcttttatatacttggctttgctctacagaaggacttctccatgtgatgaggctaccaatacctttaaattcatttttggcccagcaagcccaaagaaataacttctctttcccaaaatctggccatcattcaagggaaggattatgacaggcattgttagggtcacatgtacacccccaagaccaatcagagcagaagagtataggatactatgatkggctatgtctgcctacctctctggagagggcagtgggttcttaccagaaggagaataggggagggacaagggagagggaattacactggatagccaaaagaaatattttaatagattgtttaaaagggttaggagcagttaaagagtatttttaattgaaaacacaaacttgaatccaagcaagatgaataggtttgagaaaatgatctactaaattcattatatatgcatatgagaagacattttctcatgttagaaaattctatagattagaaaaactggtacaacaactggatgaaaggatggattgttgcaggtgttaggaaaagaaattaatatgctcaggatttctgttgcttagatttctttcataaagaagtcactaagaaatggtagactgcagcttatttatttattgttaaacaagcaaaagarggccattacatctcttgtttacattaaaatatgaataagccttcattgatttgatggttgcatccaaagtaaggaattttagttatcaataaatggtaatttcaatacctgttcttcattgtagcaaatgtgtaaacaaatgtgtatttgtttaagaatttgctgcaatgaaaataatatgaattgcatagcattcataagaatcttataaaatagattagcttaagtggtgtgtatacacatgcacataccatgcatgtgtctgtaatagttgaagcaaattctccaaatgaacatwcgtcatgtgtgatggctgtagtaacaaaaggtgttctcactttgtgctcctgaaatcctaccagtctttcagactctggtgttgacagaatcaaaggcatataagatagaagttattatattttagtaaggcaaacatggctttaaaatagcttgtctgccatgtttaaattagcatatttgacaaattgagaaagaccatcaaaaactgcttttgcaagttacagtctagatggttattcaagttattcatgcaatgatacattacaaataatagatggactgcaattatttataaggaattcactttgtcaagatactatggtcacagcatacagctcagatgayacttgtgtcaaaaaacattgactggctcagatgactcagaagttygtggctggatctaagaattcaaatgatggcctaagaagtcagtctgttggcactgctgtcatttgtgtggctttgttctcagacagcctctcccctcctaggggcaaaatggctgccagcagcttcaggctcaaatcccgatttcagcacctcaatacaaagaaagcattgcctctcttgcagcagttyaccccaaaatcagaattaagcctcattggctttggtgggcttggcttgggtcatgtgctgtgttctgaaccatatagctagggaggtgcaatactgggataggccactcctggattggagtgaggggtttccttagggaaacccatgacattgtttccagcaagaggttggggggatggatgcaggatagtaaaaaccaataaatatctgcgaaattattctttttttaaatgaagatatctttgagaaggaaaatgtaatgaacagatcagtgattcagctgtcaatccagtcattcaacaaatatttattgactctatgccaatcactatgcaaggcatgtataacagcaatgaacaagctggttgagatctctgacctcctgaagcttgctctctggtagggaaggaagacataaaaatttagttacatatttatatcttatgtgaaaagtgcattgctgtgaggacatataagaaggggatgtcagwgaggtcaagggtctagraagccttcagagaaaggatttctagattaagtgctgtttcagctgagatctgtgggatgagtctaagcatggacaagggaacaggrtggaagaagaaagttccaggcattttacccttaaacagtttgatcaaaggaaacagggagagcccagacagaggagggagagagtgtaccaattgggttaatggacttagaatgagaggctggatgtttcagagataagtactttgcctttccccagggtgtctgagggtgttcatgatagtgagtttcccagtctagatccatgcatggatcaagactctttctgaaagaagatcagtagcccaggcttgaatttgataaagttcagagaacctcaattttaatgtattttcaaaaacatgtattgttcttttgtgttcttcaagtgagaagggtctggaaaatgtgccctttcttgcttggtagataaataaaaaattcacttttggccactgtaattcagccattcagtgttgatatactaawtgtccatctcaggtaacaggaattgtatctcagcctgatacctaaaatgaagcaatcaagatgrcaagacttcagctgtacaagtcttggattaggtggcatgaatggatgatccaggttaatttcagaaacctaagccatgctctcagtagacttttactagtcctgggcacttcctgtgttactggaaaggggtcccgatccagaccccaagagagggttctgggatcttgtgcaagaaggaattcagggcaagtccatagagtaaactgaaagcaagtttattaggaaagtaaaggaataaaagaatggctactccatagacagagcagccccgagggctgctggttgcccatttttatgggttatttctttgatgatttgctaaacaaggggcagattattcatgcctcccctttttagaccatatacggtaacttcctgatgttgtcatggcatttttaaactgtcatggcgctgttgggagtgtagcagtgaagacgaccagaggtcattctcgtggccatcttggttttggtgggctttagccggcttctttactgcaaactgttttattagcaaggtctttatgacctgtatcttgtgctgacctcctgtctcatcctgtgacttagactgccttaactgtctgagaatgcagcccagtaggtctcagcctcattttacccagctcctactcaagatggagttgctctggttcacacgcctctgacacttgtattgtgcttcatacaatttgccattttgtcttcaaattttttwaaaaaaattccttttctgaattggaaagttctttaggcatagattaatatctgtccctgtataccatcttcacgttatgaatgagagatttctgcttctgataatggtaggctaggtaattcaggcccacccctctcctgaaggtgactagaaaggctggacagattataaaccaaagcttgcttcaaggctttagaaggcttacaagatggtgaaggattaccaggccaagtctaggggagggtagaggcccagggaggtgaaccccaaaattggagccccttctttccctgagagcacatgaaaatttcaaggaagagctgtgagacttaagtggatgggcagccttttggggataatgcaacagggattgatgaccagagcctgccaaggatagagggagcctagtgaacccccatctctttgggtttctatttcaaagggctgcttcaaaggagtagggataaactggaagtaggcccatgaagccatttgaaatgcaaaaacaagctgtagagtgggaaaagatatttgtaaaaacatttaactgacaaagggcttctatttaaaatatttaaaggacttctgcacatcagtaagaaaaagataacctaatagaaaaaagccaagagacttgaacacttcacaaggcttttcacaaaagaggagatccaaatgaccaacaaatgtatgaaaagatacgccgtctcattagtaatcagggaaatgcaaattaaaaccacaatgagctatcatgacacatccaccagatagctaaaattaagattgtcaataacaagtgcttgcaagtttggatggcaaccagatctctcatatactgctgatgggagtataaataggtacaaccactttggaaaactattcagtctcaactactatagcttaagatatgcatactatgaaggagattcactgtgcaccgattaccaacttgtctgagtttgttaagacagaacactcacatacaacagatcacatgaagtgagtttattacaagggacagcagaaacccaggaacccagaaacccaggattcattgcaatccagtcccccaagtttcaggaaatatcatctccatcccaaggcagatggagtctcactttgcaccacagctgagggaccctggaaagtagccctccctggtttttataccctggaataatatgactcactgggctaaagcattgaaagacatcctgttctggcggggggctagtagaacagagcccagacagttccagccattccctttccatctcaggatgttgcattcctagcatattctacagttattcttcacaactacaagcaagagatgggggaggacagagtcagtccaagaccacacagagagcctatcctgcacatactctatgatctagcagtttctttcctagatatagactctgattacctttgtgcatggaaagacatttgcaaaaatgttcatagcatcatagaataataggaaacaacctcaagttggaaacaacccaaatgttaattggtggtagaatggataaataaattgcagtaaattcaaatggtggattattatayacaaaatggactacagctgtatataataaaatagatacattagagttaaataatctagacacaaaacgtacataatatgtgattccattcatctagatattaaaagccaggcaaaastataatgttwagggatgcatgcttaagtcataaaagagaattaaggggccgggctctgtggctcacgcctgtaatcccagcactttgggagactgaggcgggcagatcacttgaggtcaggagtttgagaccagctggccaacatggtgaaaccccatctccactaaaaatacaaaaattagctaggtatggtggcagatgcctgtaatcccagctagtcgggaggctgaggcatgagaattgcgtgaacctgggaggtggaggttgcagtgagccaagatggcaccactgcactccagccggggtgggtaagactctgtctcaaacaaacaaacaaacaaacaaagagaatcaaatcaaggaaagtgatttctacaaaaagtgaggatagtggttacctttaatggggagagagcgtctacgggtgagaggggtcttctggggtgttggcagtgctctgtttcttaacctcggtgattattatacaggtgttcactttgtaataattctttatgtgaggcacttttctgtatgcacattatatttcacaataaaatcttttaaaaggtgatatcactttatctcttatctacctcattgaaactgaaattaaaatttatcacctgctcaatcaaactgtaacaatgcttttcacttagagatgtgaaccaagcctgaatgttggcagatatgcagagtcaaggtcaaaattctgttggatttctaggtgcttattaccatatgctagtaaccgtatcactgagtttcatctttactcctcaaaaacaatatgtttttatttagaattaattaacatagttctttgcatatagtagatactgtactattttaagtcagggttttctagggaaacagaacaaatagcatatccatatctgtgtttatatctatatctaggaagacatttacgataaggtattgatttgtgggattatggaggctgagaagtcccacaatatgtttttggaaaggggtcccaatccagaccccaagagagggttcttggatttcacacaagaaagaattcasgtcaagtccacagaataaagtgaaagcaagcttattaggaaagtaaagggataaagaatggctaccccataggcagagcacccctgagggctgctggttacccatttttatgtttatttattgattatatgctaaacaaggggtggattattcatgcctcccctttttagaccatatagggtaacttcctgacattgacatggcatttgtaaactttcatggcactggtggaartgtagcagtgaggacaaccagaggtcactctcatcaccatcttggttttggtgggttttagctggctttatttactgcagcctgttttatcagcaaggtctttatgacctgtatcttgtgctgaccttctatctcgtcctgtgacttagaatgcctaactggctgggaatgaagcctaggaggtctcagcctcattttacctagcccctattcagcatggagttaccctggttcaaactcccctaacaaatatactatctgcaaggtgaagatccaggaaagctgatggtgtggtttgaaggcctgagagctggagagccaatggtgtagattccagtttgcatctgtaggcctgagaaccatgagcactgagggcaagagattgatatctcagctcaagcagtcaggcagggagggtaaatcctcccttcctccaactttttgttctattgaggcactcagttaattggatgctgctcactcatattggggatggcaatgaactttacacagcccattgattcaaatgctaatctcttccagaaacatctagatagacatgcccagaaataatgtttagctggatatctgggcatctcgtgtcccagtcaagttgacacataaaattgcctwtcacatctactacttattaaattgaaaaataagataattgaatttccttgtgacaaaagtagtctgttttgaaactataatacttgtagattcttggtatgagtcatgaaaatgatgtaaattggggctcacaaataataagcactttttgcaaccatacctttctctgtttctgttttttccttcttcctacatggtccttagttggctatttgatttttttctttgcctgtgtctgacctggaaacttctacagtttgaacaagtttccagtacctgatactttcccatggagaagcagttcattttgtaatttgaggctttggaaaaactccttttcattatacatctgcattttccttttctttaacatgggtcaaataagtgaattcttaatggaatctgtctttcttttatctacctaagatataagaaggcacatatcctgcagagacagattgtttttaagaagcttttcaaggggaagagagcagaggccaatgtgaaacctataaaacctgaaataatccagttttaaaaagatcaaataaatagaaaaccatagcacacaacagctttagagacagtagaaagctagaagatgaagcaggattaaaaagtgaaaattaatccttatactcagtgaatgcctagaaaaccccccactgacaaccaaagtcatacggtatttgagtattttccttgtttttaatttgatattttcttgtgaaaatggtgtttgggggtaaaaataatatttatcaacattccagagtatagtagcccttgccctcactgtagcagaagccaaagttgaagacatgtgaacagttttatgcattcacatttacttccagaaagcaaagttaattgcatagaattcytttcgctttagttttttcttttcttttttttttttttaaaccaaactttctgctaacaataacaccagtaacaattacgtgccaggcactgtgcaaagtgaagtcytttacaaacattatctcatttaatcttcttaataaatgcatgagatggatgtgatagatggattccaagatggctccaagttattatcactttctggtatttacattcatgtaaatgtgtggcctatttcacattgaatagggctgatctgtgtgactaatagatgttgtgcaagtgacagtgtgtgacttctgggtcaaaaagaacactgtagcttctcccatcgtctcttggcttgcttaccctggaggtagccagtcatcatgctttgaggacactcaagcagccatgttaaaggacttgtgagaggaggaactgagtccttccaccaacagtcagaaccaatttgctggtcataagccatcttggaagtggattctccaaccttagtcaacccttcagatgactgtagacctggctgtatctttgactacaatctcatgagagactccaagccagaatcacgtagccaaacttcttttgaattcktgaatcatggaaactatgataaataagtagtgtttattattgttgtttttaacattaagttttggggcaatttgttagatgccaataggtaattgttagagtaggctcactctttttattgttatctccattatttagtgaggaaactgaggctaaaaaagatttaaacctaggtctgatgaccccaagcctttggtcttaatggaaataagtttctcagagttttggtttattactgctaacagctctttctgagaggaaaacaaaaattattttattttatttttgggacggagtctcactctgttgctgggctggagtgcagtggtgcgatcttggctcactgcaacctccgcctccctggttcaagcgattctcctgcctcagccccctgagtagctgggattacaggcccgtgccaccacgcccagctaatttttgtatttttagtagagatggggtttaaccacatttgccacaatggtctcgatctcctgaccttgtgatctacctgcctcagcctcccaaagtgctgggattacaggcgcgagccacygcacccggcccaaaaattatttttttaaaactgggggaaaacatttttatcaagcaatgtttatatttatttaagtgtgttaaaggatctgggctactgtaacgcatgtgtaaatagaagaggcagtgtttgacattaaagttctttgagatttgtttacattttacatgttgtgtattgggtagaaaggattttaacttgttcaaagatttaactgggagcaaaaaaatttttgctggcttttctgcaaagaagggaggggcttgggartagaagatggcagaaaaaaagtataggaaatgagttttttgagacatttaagataaagaaaaagcaaagagagatgatagagatgggggtgagggtatgattatggtgatcatgatagttattaatgtgacacgtacacgtccctgcagcatctggaagcattcactaatttaataatatacattatgagattctgctttacaaggctgcagtctactctaaatttgaactcttttagactcagctccttatgagttcctagaggtgaacagaactcaattccctacagaaaaggaattttgtgcctaaggatgtctactctaaaacgtttctttttttttctgtcttttagaattcaatggtgcaaatctataaagacagagctttaatggcaaaccctattctgtctggttctccttcctaagagttagctgagaatatatttktctaacttttctttttaatattctctgaaagaagacattacatcacacatactgaactcttacttaacctggactcygttaagtagaaacattggaaggagccaaagactgacattttaaattaagaaaaacaaaccaaatgagcgaaatagttcctctgagaagtgttttggcctagtgaaaattctcttttaataaatgcaatttaatattccttcaacaattatttactgagctccttgtatgtgccaattacacatgatccctataggcaagaagcttacattctggagttagaaacaggcttgtaagcaaataattacaatgcactgtatttgatgcatttaattagaggggcatatgcaaaggacagagttatggcactcctcgagtgcactagagaaagccttccttctgcagattcttgagatgggttttgtaggatgaacagaagtttgctaggcagatggggatcaggatgtgagaggaaaggatgagcctgttagaggtatgaaataggctggcatatttggagatttgggaaaagtcattatgatggatggattaattaattaattaaccacatttattagattagtatatgtatgaggccctgtacagggtgctgggaatacagtgattaaaaagacaaagttcctgtcctcaaaaaacttaagagtccggtgagggagagagatagatcaataaccatgataggagtgagcacgaggacctgtgagatcataaggaaggggcagccttgggagtcattcacagctttctgaaagaggtgacagctgaatctggaaagacaaatgggaattagctgccatggggtgggagagcaagaaaggcattcctggtgttacatgtgagtctgtggtgtgtgagcacaggacacattctgaactgctggtagagcatcaagtgtaagataggcaaattccagggatgaacagcatgctaaggagtgtggagagtgttccggacgaaacgattttaggcagagaaatggcatgaccaaattttccctttggaaaggtcactgtggctgcagcgtggagaatggctggggtatgggaaaggcatgattctggagttggataggtcagttaagtgttgcagttacccaggcaagatgtggtagtgacattaacgaaggaggggcagcagggatggaaaagagtggtgaatttgtgagatactaaggaggtagagtcacaagcaaggtgagggcagaatcatgtcatgatcaaaagtgtggactctgggaccataatgactggttctattccgggctctatgctttgctactgtgtgaactggggcaggttacttacctcctctgtgcctcagtttccttatctgtgatatgggaagggtaataataccttcatctagggttgctgtggggattaaagtaactaaaacatataatgcttggaacattgtcaggcacatagtaagtagtccacaagtatgtgttatatggttaatttgaggaaagagaagtcataggtgatgcctacacttgggatatgggcaattgtgtgaatgataattcattcacagagggaatataggagaaagcagagctgggggaacatgctgagcttgaggtgcctgtggacaccctaagtggaagcatcttgtaggcagctgggtcggtggagctggaaatcagaagagatctgagtgggataaaccctctagaatggcaggaagagaaatagctgccgggaagagagctaataaaggaaacrgatgaggtggtctaaggggcccagcagaggctgcagacactgaatttgcaaggttgtgagtctaggctgctgtgtggttttctctggcagtcctaacagcctgggtgtagtagaggactggaacagctggattgaccagtgttagggttttgctggttataacagccttttcttaaatttttcaattttttttttaagttctggggtacatgtccaggatacacaggtttgttacctaggtaaacgcaaacrcgcrcattttttcctgtagtattttaaagtatatctcagacaatatttatttttacctgtaaataattcactaaatatcagataataacttttacaaaaaatcagacccataatgctgttatccttctcaacaaaacaaacgatgattttaaaaactattttatgtttattgacatacttagcaaataacaacaacaatagcaacactaattttttggaatgggtatagtttgataggagtattagttaatgaatttaaaataaaaatgtttaatctgatgagcagtaattattttatatcatccattattcagtttttaaaatcataatccaaacaaggtctactcttgtatttggttggtgtaagactcttttaattcgtaacttctctctctccttcccttcttttctccttctcacccttctctcctgctcctctctctttcatgctatgtttattgtgaataaactgagtcattttcctataacatttttcacatcctggatttagattaattgtattcttacagaacatacatgttcctctttccctctatctcctgcaattgggctggtaggtcggaggcttagatttctgtcaataacactacataagtggtgctgtgtactgygtcacatcaggaggcacataatgcctgtgttttactcttttagtgttaagattaatttagaggactccggtgttgtcagcctgattgagccattgtcaggttcttcagcaacatcttacctaattattttagcactgaagatccttcatttcattaggggctgcaaaatggtaattatttttctgtgatttttctgcatttattagttggaattcttttataaagagtaattttctttcatcaactatttggttaaccaacaatgcaatttatactaaaatagtgcaaaataaatggttctttccttttattatttccaaaataattagtttggtgctttagcaacttccaaaggtgaccaattatttttttaaagtatcatttaaatttagatttaaaagaacgratctattgccgacttttttttttttatgctcaaattgtctcatctttggttaatgggaatgctttcaagttgctctggatccctgacaaccctggtagctcttgataacrttcttgttttatggtatgagacaatgtgccaagttcactgtatacattttgtacccttgtcctcaaattacccatttctccaaggagttgtgatttctgttagtggtaaatggtgtttgaatactacaatccaggtctctgcgctgtcattgccaccggactttcattgcttatgggctttttcagtgggcagattatttaaaaagagaaaatcatcgcaagcttgtatttattttcaatttaaatgttaagattatagggtttcttaatataaaaacttttcttcgtttatacttttaaaaatactgaaatgcttggttcctaactatattgatgtagctacttatttgttttaaaaatattattactaatatcatgaccaacagcaagactactggataaatgataagatttctcggctcttctctgtgttttgacagcatatctcattgagaatacagtcaaaatattgttgtttgttttttttttttttttgaggcagagtcttgctgtgttgcccaggctagagtgtagtggcgccatcacggctcactgcaacctccactcctcaggttcaagtgattctcctgcctcagcctcctgagtaattgggactacaggcacgtgccactatgcctagctaattttttgtatttttagtagaggcagggtttcactgtgttagccaggatggtctcaatctcctgaccgcgtgatccgcctgcctcggcctcccaaagtgctgagattacgggtgtgagccactacgcccagccaaaaatattatgttttaaggttggttggaataattgttttctctctgtggttatgayaccagctggatgtacagcaaggttcatttgtttcagtttcttttttatttttaagaattgattttcccgtttcttttttcatttttgatatgtaaaacacttacatggttcaaaatcaacactrtatagtgaggtacattcagagaaatctctctttcattcctatctcctctaccctgttsctttactccttctgtaggtaaccactgttactggtttatgtatcgtttcatattttagctagtgtatcatttggatagattcctagaatagggattgctgagtcagatgtacatgcatatgtaactttgctagatattttataacaccatatttttagctctttgtaactgtaatcatataatcaaaaaggataatgtagtttcttcctttcatgaatttttactttgttgtcctttaatagaagactttaaaatttccaggagaatggaccttcctgtttctttgttttgtttttaagtttctagctttgttgtattatgatcagactgttgyttctaatatttctagattatagaaccactggtattttctttggtattatacttttaatatataaccaaatttttgtcaccrttctatttgctattgaggaggcatattttctattactaggatgtagtgtttgatacatattcctaaacctatttaatgtgttatgtcattcaaatcttttatggtcttacttattttttgtccacctaacaggtcttactaagagtagtttattaaaatctcctgttatttgtgtatttgtttttccttgcatctcccataatttctrctttatatggatggtttttgtgctattttggtgcatagataataataactrttacatcatcaktttgaattatggtgtttcacactctaaaatattcttctttgtgttgttaatgattttttaaaaatctgtcttaaaatcaagaccacaatctttgcttttttattgcttctgttgttgtcactacccagctgtgatagaatgggctccccaaccaaaatttggtttggatgtcaagattggtgatgccactcatgcgcctagaagatatgaaaaggttatggttcacataatgaggctttctgtgagagcagggcaggctcccaaacaggttcaaaaatagcttgaatccagtagtgccagctgcttgggaggcctaggttggaggattgcttgagcctaggtgttcaagaccagcctggtcaacatagcaaaaacctagggcggggggaaaaagatagaaatcctcttcttgggaagaagtatttaaaaaaaataaataacttgagaatagggaaaagatactggtttggcttttattgtggttaagggtggggctataataatagttcttacgcagtctgggccttgtgttgtttgaactttccactggaaccaaaggaaggaacacctgagctttcttatcagcttgtccaaaggtagggcaatattagtttcattccattactttattctcttcttaaggagctccaattatagcatggtggatcttccttgactgtcttctgtttcattgattgccatcttagaggctttctgccataatgacccctttttccttttttaaaatttcatattcatttccttgggtgttttactgctttatttcagtgtgccttattacattttccttcaaatctactttcctttatatagctcttcttcctatgtcttggtctggtacttccttactgtcttgtgaggtttttgtttgtttrtttgtttgtttgtttttaatggttttagggtttttaatttgatattttatcaataatttttagttctcttttttagcacaatgattggataacctagcctgctatcaataaaaatagaaatccctacctagtcatagatggttttctgaagttgcaagtgttctaccagaagtctgagcaagaatatgcaaaagggagatgccatatttctttgattcagagatattgggtggctattcactggcttatttatgactataagctttaaaacttttcccagaactttcctttgcctgtcttatctcatgctatttcgaatctctgtccagctgtgaagccctgtaaccttgtatttattctgtttgaagggtcgattctcctaagagagcgctttcaaatatgtagataaattatcaaactatttagtatgtttattgggcagtgtttgtttttctcattgggaagataaaaggggcaaaatgtagaagtaacttgtacttccatgtcttcctgagcttagtctagaatcccttattttgtctaaaatagattctagatcttgggagaaggataaatctagttatatggaatagaatcctttgttgagatatttgttccaagcatttggatttcggaagatcagtattttctaaaccttcctgtatttgaaaaagcttaaaaaaaattgtgacctgtattcaggaattaactgtatttgttctaagacatttttgtttcactcttaggtgagaaaaaaaaattactaaaaatgacaagtagaagacttgaggagtccatgggggctgttcagatgggattggtcaatatgttcaaaggatttcaaagcaaggttttgccacccctgagtccaaaggtggttacagaagaagaagtaaaccgaatggtaatgtatccgggaattaatatgtaaaatacttaatgcaatctccttaggagaatgacagttgctacttggcattctcagaatgccaaacagaattactgactgattaatatcaatttagttataatggtagctttctgcagagtgtagataccttttaaagcctgagaagttttgaaattgcatacatacttcaaagtagaggcttgatttgcttaaactaatcagttgaagtgagactttacaaatgaactattaagattttctaaatattaggtagcaccatgacaaactgtcatttgtttagttcaaaaacagtcaaatatcagaatttcataggattcaacctaattatttactacctaccgattggcaagagtaatttttgtttgtatatttatagaacacagagcattaaaataatgactaagtggtatttaagaaaaataggtatttttcctgttctttaaaataaaacatatttatagctttaattatttataatgattggtgataatttatgaaccacatgctgtagaaaatattagtaaaaatgtatagtgccagggatagtattcactacattttaaaaactaatcttaagttacattccaattagagaaataaaatcaatcattattctcttttgtgatggttgttggtacatatttaaagaaactcctggcattttgcttttaagacctaattattttaatttaaatcacaatatagctgacacctcttaacattttattgtccttatctgggttccaatcaaaaagatcttaaccaagttgaaagctgtattagaaatataccttcatttaaatggattaaatcacagaaataaaatttgtagaaaaataagcatttttaaagtacattgtgtttaacccaaggcaacataaagcagctaagttatataccctcaaatgttttgtaaaaatcttggcatatacttgagcattrtgtagctgccaatgatcataatctccctgcacatatagtaggaacattctagaaccacaataacattggttctgggtaactaatcccttgttgggttagttttatttaaatgctaggttactttttttttctcataacattggaaagggtaaaagcattttgtgttcttactggggtgtgtgaatgtgactggctgtgggatctgctgattagctcagagctctttcaaagcgaggtctaaatgcacccttgtgatgtctctaaagttcaaactcattcctaagtgatgtagtcacacttcctagatctttgcaattttataagatttctctctaacatcatatcatagttaaacacccaaaagctttgtttgcatattgtaatgttagttgagaaatagaggtatttcaaactcctggtttttgaagcccttgagtgactttacaaactgagagttttatgcacagatgcctcttctgagcataaatgttaagctctttggacatgttcctgtgcaatttcttgacttttttctctcaggttcttttgtgtgattccttcaaaatcataaggaaacagcaaacacatgtcattttcaattaccgtgcaaagacctcaaaagtgcgtgggtacttctcttatataatttacttattttaaatattttataaggraacttagtggcattccagaattatcctgaaagctgcaaacacaaattattcattactggtacttatgaaaacactttttcagtacatccacttawgaatctttggttcttattgttttacattctagcttacaccctcagagttcctgaaggaaatgtccctgaccaccgagcagagactggcaaaaacacgtttgatgtgccgaccacagatcatcgaactcttagatatgggggaaacaacacatcagaaggtagctgctctctgtcgtacttacatataaagtgggccctggcacaacaccaaaattccagaacaataagtaaaatttgtttcttggctacctaatcctttattgggtttgttttcaatcctccttttctgcctctgaatgtcttcatatctgtgatttggtatggtgaagactgcaagtgcaaacctcttttaaaataacttttgactagttatacttctttcttagctacttctgaatactatttgacgctatagtttacacaggttaggagtaattctaagaattatattagtcaagcccaattaagttattgtcttagtgtaacaagtaatctctccttatctgagctgcccactagaaaagaaggagttggaattgttaattaaagtaggcattcgttgtctattctggctcatttccagtaacagacatatccttttgtctctaaagaatagtgattttatcatgtttctatattcgaatgtaaaccataccttccaggctttaggagcatgtgattatagaaggtctggtttcctattttttaattaatttcttaaattatatcctttacttttaatgcacaaattatggtatgaacctccaatagttgggctgctggggagattaacctcttctcaaagagttcctcagaattttcctctgaaaattcctgagagtttttcaatgttatgttcctcatgaagaatgagtctttgaggcttgtctgctgttactgctacaccattgcttcctttgtctaggatatgcataagcttcactgttctgagcattgctagctttttattgttttgtctgtttcccacaaccaccctccaaatttgagtggagggaacatggtcttttccaagacatttcttctaattaaggaccatttcctcttttctgaaagcataacacataacaggctatgaggagtttttcatgtgtactactagtgtattttaatgtgttttgactctgctataaaggatgaggaaatcagatactttacactttctctcctctcctctttaattcagttggttatttttaatttatatgctgagatttaatcatttatctcttagatgggtggcagtcatctactaatttcttcaataagagcttatgaagactgtatttctttgttttatgtgtttgataatatttgtgtcttgcctttatactgaactgcagatttgttacttatgaaattcttgggccacaaattttcataacagctttgcaggcattttccctatgaccttctgactttaaatgatggtatgtagaagtcggaagccagcctgatttctccctcataagttaatcttttagcccatgtgcccaaagattgtttgttattatttaaagttcagtattaggatacactacatttttcctgaggtactgtgcgcctttattttatttttagaaagtttttcttgaattatcaagtatttttttcatatcatttttcaatgatgaatatgttggaccttctttgtctgcccttctacagyttgcatttcctctctcattcatttttaactttctgttcatttccattgcattgtcattacattcattaggctatcctctgtgtcccttactttgagttatgtatatatttcttttatgcttcattttttaccagaccagacctggttcaacagacctctttaatcatcccgcttctcaccacttcctccaccaccattccagtttaagccaccattatctagaatactgacatagccttcctatttccatctcattctccctctgcccccattatcacaaagcagtaaaagtaatctttaaaatgtaaatcagaacatattgcttccatgttgtctcatagcatttgatacagtgagcatctcttttttgtacccttttattcacttgtatctgacatggcatactcatttgattttctttctacttttcactggttgatttttgcttattttatttgttggattattcactcatttctgatcactaaatattagagctcccagtacttggtacttgaacttctttctcttgtgaactcacaacttaggtgacttcttctaggaaaaaaggctttaaattctactttttgttgtttacttttatatttatatctcctgccactgtctatcccctgaactctggatcatatagtcagcttaatgtatggttggcagctcaaacttaatatatttaagatctaattgtagctttacattccatctctaaaagcctgatctttcctctttgtctctttcttcctgcttttcatacccccacttatatgttttcctagaccaaacactttggagttgtattcctgatgcctctctattttacatcttatgatccaatgataagtgctatgaattctgccttcacaaatgtgtctttaatcatactgcttctcaccatgttctccaccaccattccagtttaagccaccattatctagaatatcaaaattgcctccctgcttccatctcgttctccccctgcccccattatcacaaagcagtaagaatgtttttttaaaatgtaaatcagaacatgttacttccatgtttaaaaccatccagtgacttcccattactcatataataaaatctaaactcagtgccaaaacctccaaggtcctgtaccatctagtcctgccttcctcacggacctctttgccttctactcttctccctctcagtctcttctcagtgaattttccctatgctgctcttcagacactcaaaggtaatttccacctgaaggactttgcacttgctttcccttctaactggagtgctattctaaaatcttagtgtgacttgcttcagacctctacttagaagtcatctcagagaggccttctcttgactgcctatctaaaagagcagccacctcccagtctgccatctccttgtcctgctttagctttttttcacagccttttcactacctgactttatgttctgtatttctatattttttgtatgatcgcttgagcttcaagaatgtcaacttcatgaggttagggctttttttggctttgttcactatgttcagcatacaaaaaagaacgtggcacatgttggaaactcaatatttattgaatgaagacatgaatttttaatctctcctaactgctcacttctttacattcttaaatatttgctttgtgctctttgacttttttttccattatgctctttgagcttatggtgaaatgatgtagttaagactgattgcttaatggcagaaattcaattagccagaaattaaagagtatatactgtattattccacttatataatcaagaaaactaacctaagatgtgagaagtagattagctgtgttacctttgtcataaatcaagtgaccatatatttaataattggtttgggggctttctaatctggtacatttatttttctgataaatcttgtgctaatatctcattatcattactgtggtaagtaacagtatatgatatgtaataatataattatcatgttgtgctacctgatatagcaaatcctcctatcttgttcttcgaatgtatcttgtctattcttggtcctttgcatttccgtataaattcagtcagcttttttgtttcaaaaaaaaaactgctgggatttttttttttaatgtattgcattgaattttcagataaatttggggagtatttgacatcctgaaaaaatttcttttaatttatgaaaatagtgtattcctgcattcagttaggtcttccttaatttcagttaaggtcttccttaattccttaaaacaataatgtttttagtttctggataaaggtcttatacatctttcattggatttgtttctatgtgttttacattttaggatactattttaagtaatattgtttataaatttcatttcctaaatgttcattgctagtacctaaaaatagaattggttttgatatgttgaccttgtactcaatgaccttgataaatcacttattaattctaataaaagaattattagaatgatttatttgtaggttattttgaatttttgaaataagcaattactttgcctggggaaaatgacagttttgtttcttcttgtttgatttctagtattaaaacaaccttgaatttctgagatgaacccaacttggtcatgatgtgttatcgtttttatatagtgccagtttcagtttcagtttgcaaattttttttctctttctttcatctatctgtctatctgtctatggtttatgaatgagactggcctatagttttcttttcccttagtgtctttctcagatatataaaggaggttatgctaacgttatagactgagttgggaaacatttcatttttttgtttttcttttctttgggacagtttctataatacttgagttgtttcttttatgtttggtagaatttgcttgtaaagctatctgggtttggaattttctctgtaaaagggtttgtttacagatataatttctgtaacagttttagaactattcagatgttstgtttcttcttgtgccagttttgatacatttttattgtatttttctaggaatttgtatttttatctatattttcacatttattgacataatatttattatttttttactgaatttgggttctattgtaatattcccatttccattctttctatttgttctttgtgccttctgtcatattttcttgatcaaactcatgaggtattttgtcaattttattaatctttttaaagacctgaatttcactttgttgtttttatagtatagttacttttatttcattaatttcctctcctgtttttgtcatgtcaatttttttctttatttggatttattttgctatttattctaacttattaagatggatacttacagctgcagttttcaaactgtgtgccaaggtgccccagggcgcaaccgtgaactcacagggcatcattggatagtctgaattttcaagggaaacctggcactacccaaaatctactggatgctaaacaggctactagcttggggtaattcgtagtttcagcattggatgatgctatattcactttgatgatgtcatactttacaaacctggcttctcagtggttggttaaataaaaagcaagtactttgttaaaatcaaaatagaacaggaaatgaggggtccaagtccaatttggttctgttgtgcagtgcccaaccagggcacacatcccattagtaagctagttatttgtattattgttttgtatgatgagaattcatttagagtaaccacatatttacccctttattattctcctttccttcctgcatctctgaacttctaagagaaattctcttctccataaagaataccctttggtatttcctttagaagttggtgacaacatttttcaatttttatttctctgaaaatgtgtttattcaaacttcgtttttgaagggactttccccaggtaaaaaatactatgcctgcagaggtttgttttttttttttcaggatttaaaaaattttattcctctgccttctgacttgtgatgttgaaaagtaggcatgtgtttttgctccttgaaagttaaatattctatttttccctccagtttcttttacacattcttttgtcctgtgttttagtgcttttacaatgatgtacttgggtatggatttctttttgaatatttcccatgtttagttttaatatccacaggtctacgtagtattttcttatcttccccagtcatttttgtcaatgtgtgactrtaacaataatttactctttcaactgaagttttcaggaattgacctggatcaggcattattccagccctttccatcagaaattatatttcagaactacactccctgtgaagtctatgaagttccactgattttgaggaacaatgacaaagtgagtatgttcactggggtgggtgaactgttccaggatatatgagaatgggttaaagtaaaatgagatcttgagggatctttgataagttctttaatttgatagacttaggaaaatagtatgaaaacatcttctttgattgtaaacttaatgacgacaaggctgtgtctgtttgttgctatatgttgagtcctaaccagtgcctaacacgtagtgaactcccaacgtgtgcactaacttttgttgattaaaggattgaccagatgaatgtcacggggttcttatgtatgacaaattgggctaggtttttatttaagatagggaaattactattaatgtttatgtagtcttccttagagacatcatttccccaattcaagatataaaccctactcatgagaattgcaattgttgagcatatatatatgtatgtctgtatatatatatatgtatgtgtgtgtgtatatatatatacatatatatatatatatattttttttttttttttgagacagagtttcactcttgtttcccaggctggagtgcaatggtacgatctcggctcactgcaacctccgcctcctgggttcaagcgattctcctgcctcagcctccccagtagctgggactacaggcatgcgccaccacacgcaactaattttgtatttttagtagaaacagggtttctccatgttggtcaggctgctctcaagctcctgaactcaggtgatccacccacttcggtctcccaaagtgctgggattataggcgtgagccaccgtgcctggccgagcatttatatttgtattttacaatgcatttatagtctgcaaattgtacctttttaaaagccttcttttcacttctaaaaaatgtaggtccctttcctttttttctgtcttcttctttctgtagaagatagccttcaaagtttgtctacagtcagttttgaaggcttctctcactgtctatgtcttgtctctttgcaattgtaatggaagatttctttttcagccttatgactttttctttagagataaattagggtttatttcaagaaaagatattaaatgcctgaagagtttcttgacacttaacaataatgaaagaaagtaatgcagaagttcagcatgaagcatacttgagtgtgaaaagtaatcagatggggaggaaggcattggagagatgggaaatctgggtataaagacaaggaggaatactttcaggggtctaagaatgtggagacaaaaaattctagctataagacaaaatagaaattaagtaaagactatgcaagaatccaaagcaaatggacttgcagttatatttggtacagcagctcattaagggaatcagcgatgccttgcagagatcagtggggtgatttagtgacagcaaagccagactctggagaaaatggtctgtttcattcttttctgcagtagcattagtaagagaagctcatgggtcagaaatgaaagggaaggaaaagaactggaggtacacaagattgtgttcctagacctcaagaagaggtgcattgcacagacattagggctctatcttttcatgcagttcagttctcacttctgactctcttttccctttctatattactttttgactcttgctgaggtatttttagcctactaaagtggtacagtccaaagcatcctctctgaccttaaacaagaaatggtcatcagtggttgtttaatagcaagtcggggtaaagggcacgtgtgagttttgtctgccagacactcagttctcatggataaccaacatctcttgataagatgcagccagagtgctggccacatggaaagagggtcccatcctaggaacryccagctaccaagaggcagacagttctctccaggcgaggcaggcttgtcctctggtgactccaggaccctcatgccaggtggctgatgtgaccctgctcctctgcttctttagttcacagtttcataaagaaccatggggagagatttggggccccgagaaatgctttcaccttttatttgcttcctcactgtcgtggggtacaaaagatagagcctgtcaggttattacttttgtgtctccgtccctcacacacagaggatgagaataagccagaacacttgtgattttaattgggttaaaatgataaggacccacactccagagtcagactaatctgggttcagattccagcagaagaataagactttaaaagaatggagctgttgggagctgctctgagactgctctgggggatctcctgctgctctttgctcttgctttgtggtgtttactcaggaccatcccatggagaggtggggtggagtttggctgggacttgactcccagcacctttgcttggtggagctgtactactgtagacaagtgtctgtagcatgggagtcaaaatgaagctcaaagattatggtgaggatgaggtggcatataatgtgctatagatgggccattgaaggggtgcaggaagtgtgacttctctcagagcagttctcaaatgctcaaatgttgggaaatccagcttaactccattatgtgggtgaggttttagctgattaaagagcccttgaagatagtcacttttttttttttttttttgagacagagtcttgctctttgctcccaggctggagtgcagtggcccgatctcggctcactggaacctctgcctcctgggttcaagtgattctcctgcctcagcctccccagtagctgggactacaggcacatgctaccacacccggctaattttttgtatttttagtagagatgaggtttcactgtattagtcaggatggtcttgatctcctgacctcgtgatcctcctgcctcggcctcccaaaatgctgggataacgggtgagccactgcgcctggctgatagtcacttttaaatgatttaattttaaaatgaacaaagacttgtaataataataaaaataactaagaataataatgttaataaaaatgaaagctagaaggtattgggtgcttactttgtatgggataaagataagtactatcatctccttttatagttgagaagactgaagttcagacctgaccaaggtcacacrtctagtaagtagttgatggatttcagtctgtgtttaactctgctttttcacatgcacgatgttcatcatcatgtgtttccctgcagattccaaggttggtgaaagttgtggaagaaagttcgccttactttaaagtaatcagccccaaagatattggccacaaagtggctcctggagtgccttccatattccgaatcctctttactccagaggagaacaaggtaataccaggaatggcaagaaattggacacttgtactggcagattgcagttcaattctgaatatttacagaggcggtagtgctggtggtggtggtggtggtggtggtggtattgatggtggtcttggtattgacatttgtgttgttgttgttggtggtattggtggtagtgctggagggtggtgggtagtggtggtagtgttggtgttggtagtatagatggtggtgatattgttgtcattgatggtggtgatggtatagatggtagtggtagtgttattgatgttggtactggtgttgttactattagtagtgttggtgggtagtggtgggtgatggtgctggtgtgtgtagatggtattggtattagtagtatggtagtgtagttggtggtaatattgttgtcattgatagtggtagtggtggtggtggtgtagatggtggtggtattgttgtcactgatggtggtggtagtggtgatgttagtatttgtagagttggtgggtggtggtggtgtagatggtggtggtgatggtggtgtagatggtggtggtgctgtcattgatggtggtataggcggtggtagtcacgagaggaatgctgagacaaaggataaagattttggcttctaggaagtttggggccttaattggttatgactttcttccccagattctaactagtttgcaaaagagatccaagactcaaacatagagataatatcatagtttcagcctcagtaatggtaaagctagagctgagagcagaggcctgcctggcctgctcacccccatcagctcacaggcagtctaagaagagcctgcagtcaaaaaggaggccattttctctcagtaccactgcagtggtggggaggggaatggagcccaatctcactctcctcagtcatggaaattccagttccttctaggagagaaggagcaggtatgggggcctgagggtggaggcttcctccccaccccttctccagggagtagaattgttggtcaggttttgttctctgtgggcctaaatggggacttaggaggaggagaagagttttaccagcatgattgaaggagtgaggacagagaacaagtcttaaatatgcagaacaaaatgcaggctgtgtatcatgttaatagcaggcatgcttatctgtgttgcactcttatggttggagtcagtagagcacagtggagtcagacagaactagcttggagtccttgcttctccaccgctagtacctatcggctgctgtcaatatcattaccagtattccctctactattgctgttgttactacttttctggagagcaaggatagagaatttaatgtggtttgttaagtatgtactccttgtggtgagtggttaaaaattccgttataataataccattgctataattttgccactttgtagtattaccatttatatgttaggttgtgtttaggaaactacaattttgtttgaggttctactgaaataaataaaaagataaataactgcagatgtagggctttttgttgcatattgttgaagtcctcattttttctggaggctctatatctgaatattgtctgtggggagaacagggtctggatttactgtgggtgtgagattcctacaccctcatttttgtaggaagctgattataatcctttgtgcagcttgaaatacaaagcatgctggatttgaggaggtggctttccttagtttttttctgtgctggagaaaataggtcttctgttggataagtatcgttgtatctgtacctcatctgactgaaaaagggatacacaagactttctggagatggaatgttctatattggcatgaggattatgtggctgaattcatttgtcaaaacatttatatttgtgcttttcagtatatacataaattttagctaaaaaaacctgtataacaatagaagggggagggagtggatagaggtatagagggaaccagaatgatagaatgttaagagtttttgaatttgagtgatgggtacattgggggtttgtcatgctagtctgtcttctttgtgcatgttttaaattttccataatcaaaagctagaagaagagagagattttattactgtttatcctgcaaagaaatagttgaaatgtatttaaaatatgttgctatgtagtttataaatatgaaatgctaacatttctggtgaggattattgcttcactgtgttttgtagctgcttatcttactctcagctcttttattccttcttaccgttccacttatccagcattgcatgtttattgggaaacccctaatttaaaaaattaactgagttaaatgttgttatactgttacttctaaatgtttgaaagttatcaaaagctgaatgcatgtttgaggagacatagtgaggataatgtttacctatgagaaattcagctgtccaattttggagacattaagatcttgtgttggacttggctctaaactatataatttatttcaaaagacagagttgttttctcattttgctggctagctagcactgatgatggcgtagtcagttatctacattcgctttcactgttggaaagtcttccttagagacatcatttccccagggcagtgcgcagaatgacctgctagggttaggcatgctgtctttcgggctgctccagaatgcagccaaygagtgactagagccagatttattttaggaaaaataaaagtcattcatttcaccaagtgtcactgtttcttcacttggccaaattgatagccaaagtacatgcttttttctttcttatcccctgctgatctgaacactctccattctcatttactctcctcacatctggatggtaagatatgtaaattgcagcatgccacagttaagccagccctctttcaattggattttcagtacccatgtatattagcatgtcgaagatgataatgcaatttacatttccctcccgcccatcatctattaatctggctgcctagggatggaacttgttaagaatgccaaatgcccagataacaggtgcagcaaatttactttggctttccttctctctcctcactcagactttttaaaaaaaatgattggatatgttattaatctaataatcctagtgtacctatcatatactgtagaaatgtgatagccagtgtcatcataaaataacactataaaattctagagcctgacatttttcttgacctcttaaatttgtatctttaccattaaaatgagaaagaaaaatattaggcttttgtgggaaagcaaaacaaagtacttccttggacttaagaaagcatctgtttgcaatgtgttgtcatacggaaaaggcagcaagctttgaagaaagcatgcagtggtgcaactgggtggctcagttatggtttaagaaaatgtctaatttgttgtcaaaatggtttttccagtttgtcactatgaaatttaaaaaccatagcccaaaaagagtagaaaatgttaacatgttctatgttatctatgtatacaataataataaaactatattgccagcaatttgaatttaaatgtcagtatcataaaattgtccacaatcaatgacttttgttggcaaaaataatgatcaggattttgttttcctcctgcctgaaattcgccctccccagttctatctggatcacccctgtagccccagtacctggcacagggcctgatacatagaaagggtgcagtaaatatttgtggagtgagataagtaagtaaaagttaatctaagaaaatataaagaagtttctttgacttgaggttagcctacagatgagaagagcatgtaaaaagggctcaattatctttttgtgtcatgaatatattagatattaactttcttctttgtcacttcaattaacagtaagatgtctaggaagtcttctctaaaaagagtttctctttattttgtttcatatttccagatagtcacatccatgctttttagctttatggacctcataaatgtaatttgataataaggctaacaaggattttaggaaatttctttataaaaactcctgatagtgtagtacccagaaaagattacaaatgaataatattatttcatttactcagtgccaggcccagttttctgagccagatccaatggagaatagaacaagctttagccttcatggagcttacatttcacaatgaataaacaaacaaacaaatatatacaatttaatgtcagaaattgacatagtagggggtagggaatgataagggctctgctttctttcaaaagtaaggtcaaggaagacttctctgataggaaagtcaagggaaggctctcctgttgaggtgacatttgggctaacttaagataactaatttaagccgtgcaaatatctgagggaagggctgtctaggagcgggaacagcaagtgcaaaggccttgtggcagaaacacgcttggcagccagctcgggaaagtacgagaaggccagtggggctggagcagaggaagctgttggaaacatggtaggaaatgagattccagcaggtgagctcatgaaggatcttagaagccatgcaaagtgggataggaagccaccataaagtacttcaaatatttttattatggaaggctttcttttcctcatatgcaaaagtagaaagaacagcagagtgtctttctactttctgctgtcatcacccaccttttcaaatctcagcgcatgaccagtctggcttcatctgtcctgccccttcccccagtagattttgaagcaagtcccatacagcatgtaatttcatctgtaaatattttgtgatttttctcttaaagataagggcctttttaaaagttagcataaccacagtaccatgattgtgcctaaaaaaccacagtcactccttaatatcattacatatccagtcagtagtttggatcttgatttaagaaaaccaactttaagaagttggtttttaaaaaaaccattgcataccaagtgcaacaatggttcacaattaagaaaaagtttgtttttttttaaagttggttttcttaaatcaagatccagacaaggtttgctgattgcattcctatcacgttgtttagaatggccccttgctgcctgttgcctgtaactgatagttagatctatagccttgattagattcaattttttctttttgatcaagaatccttcacaggtgatgtggtacttcctagtgcattatatcaagaggcacaaaatgtctgttatgttttattttgtttttgtaatgatccaataaagatcattccctacatcactgagggttaagtttctaattccataatttattttgcacttactggttggaattattctaaaaacaataacaacaacaaaaccaaaactttccctcaccagcttttcagctcccctgaggtatagtccattcaggaaagataggagaaatgcttgatcctctccttttatccagcctgatgggttgtgattagggatgacacaatctgacttacattttaggaccactctggctaccaagtagagaataggctgaagcagggccacgtgaggcatcaccgctagtagcctccccttgacattcattttctctttcctcattggtaagagaaccacaatttaaaaaaataattatttgtaattgacaaaaattgtatatatttgtggtgttcaacatgaggttttaatatatatacacattggaatggctaaataaagctaattaatatatacattatctaattaatatatacattacctcacatacttataattttttttgtagtgagaacatttaaaatctgctttcttagcaattttcaattttacaatacatggttattaaccatgttgtataataggtctcctgaacttctccttgtctaactgaaattttgtaccctctgaccagcatcccccaattctccaaccccagtccctgggaatcactgttctactctctgcttctatgcatttgactgttttagattccacata

SEQ ID NO: 12209 - DNA, 49307 bp, Homo sapiens
gacctttaagaaaatacatttgtattgttttaagtcactatgtttggggtgatttgttatagcagccgtgggaagctaatacacacccttcgggctatattcacgcttctgcatctttcctgaagctgtgccactggctggaatgtccttctgatctatgttgtgcagttcaacaatcaagagccatctgtggctattcaaattcgaatcaattggccaggcctggtggctcctgcctataatctcagcactttgggaggccgaggtgggaggattgcatgagcccaggagtttgagaccagcctgggcgacatagcaagaccccatctctacaaaaaatacaaaaattagccagacgtggtggggcgtgcctgtagttccagctactgaggagggagttgcttgaatccttctgcttcaatcctccttaaagcaggtagattgcttgagcccgggaagtggagtttgcagtgagcttagatcacaccgctgcactccagcctggatgtcagaatgagactccatctcaaaaaaaaaaagaaagaaagaataaattttcatttcaaatttagttcctcgggcacactggccatagttcaagtgctcagtagccacatatggctggtgactgccatattcgacagcacagctatagaacattgccatcataacagagatttctgttacaaaatgctgttctagaatttacttttgaactctacctgctcagatcttttaaattacatggtaggccaggcatggtggctcacgcctgtgatcccagcactttcggaggcccagtcgggaggatcccttgagcccagaagctggagacctgcctgggcaacagagcaagaccccatctctacaaaaataaaaaaaagaaaattagcctggtttggtggcacatgcctgtagtgccagctactagggagactgaagtgggaggattgcttcagcctgggaggttgaggctgcagtgagccgtgatctcatcactgcactctagcctaggtgacggagcgrgaccctgccgctaaataaataaataaataaataacatagtagtgatacctgtgtctgcggtcattactccagaacagcacttcacatatagtttctcctttaaggtcattctcacaacagcccagggagatagggtggcatgcttcattttataagctgaggtcctgggaggggaggtcatttacccaagatcacacagcaagaacaccagacagctggaatttgatcccagttttgactccaatgctcttgctcttcatcatcaataatttccttcaaggcgtccctcaaatgtcacttcctccaggaagccctccctgatttatgctccttccagaaagaatgggctcttcctttctctgagtctctggaacacaaggtcccagctaaactgtaaattccccaagggtaacaactggactaattttttttaatttaatttaattttatttttttgagatgaagtcttgctctgtcacccaggctggattgtagtggcacgatctcggctgaccgcaacctccacctcccgggttcaagcgattcttatgcctcagcctcccgagtagctgggattacaggcgctgccaccacacttggctaatttttgtatttttagtagagacagggtttcaccatgttggccaggctggtctcgaactcctgacctcaggtgatccacccaccttggcctcccaaagtgctgggaatacaggcatgagccaccgttcccggccttatccttgacttagaatacctaacctcctgggaatgcagcccataggtctcagccttatttcacccagctcctgttcaagatggagtcactctggttcacatgcctctgacatttccccrctcccttttataagagaacctttaatcctaagggttgtagagggaggaagatacaacttctgtgacttcttcaggctggacaggggtgacgatatacctgcctaactcttaggatctattggattcagggtagacaggagctcagtcagaaagcactggtatcactttttttttttttttttttttttgagacggagtttcactcttgttgcccaggctggagtgcaatggcacgatctcagctcaccacagcctccgcctcccaggttcaagcgattctcctgcctcagcctccccagtagctgggactacaggcgtgtgccaccaaacccagctaatgtttttttttttttatttttagtagagacggggtttctccatgttggccaggctggtctcgaactcccgacctcaggtgatccacccgcctcggcctcccaaagtgctgggattacagacatgagccaccacgcccggcctgatattttattacttagtattttactctgaattatcatgcgtgaattaagaccaaggctgtcttgtaaaataaaatttgttgtggaacaatttatacagctcctttgaggtaggaggcaggactcaactctggagatggggctcggctcgaatattggaccaaattgaggaccagctaaaacagggaggaggctgaagcaacttattatttttatttatttttattttttggagaaggagtcttgctctgttacccaggctggagtgcagtgacacgatctcggctcactgcaacctccaccttccggattcaagtgattctcctgccgcagcctcccgagtagctgggactacaggcgcatgccaccatgcccagctaatatttttgtattttttagtagagatggggtttcgccatattagccaggctggtcttgaactcctgactcaggtgatctgcccacctcggcctcccaaagtgctgggattacaggtgtgggccaccacgcctggcccgaagcaactttctatgacacgcctaccagtgtgccatgtcagtttgccattgccatggcaacacacccaggagttactgccccttcccatggcaatgaccccatgacccagaagttactgccccttccctagatatttctgcataaactgccccttaatctacatgtaattaaaaataggtataggctatttttatacctatataaataggtataggctaaaaataggtataggctgggcgtggtggctcatgtctgtaatcccagtactttgggaggccaatgcaggtggatcacctgaggtcaggagatcaagaccatcctggctaacatagtgaaaccctgtctctactaaaaatacaaaaaattagccaggcgtgttggcgggagcctgtagactcagctactcgggaggttgaggcaggagaatggcgtgaacccaggaggcggagcttgcagtgagccgagatcacaccactgcactccagcctgggtgacagagcaagactccgtctaaaaaaaaaaaatagtaagaaagaaggaaagacacaaagacagaaagaaggaaggaaagaaagcaagctgttttcccctgccttgcccctgctcacctttgaattcttttctgggcaaagccaagaaccctcgtgggctaaaaccccgctttggggcttaaagtttgcaaaatcctcccattaatctattgggaccagttgccacttaggagcattctttgataacttttacaaaacatcttttgtggtttttgaaatgttttcattttgtagatcattagcccttcttttttgaactggaatacatttcacgggaattttcaaatttaagtctgtgcaatgttacataaaatacctttgattattaaaagccatctgttttgctataacttcccttttttgttctaaagtttgtctatttctgctatttgtttttttaccatagaaatattgatttccttaagttttcaaagaaccaagttattaataatttctctaagaactagtctcaagcttgctatacaatcctatggttgatagactgtggctttcttgttgatttccatttgttgttcatttcctccaattttccttttttaaaaattataattattgtttggattatttatttatttatttatttatttgtttgtttgtttatttgagacagagtttctccttgtcgcccaggctagagtgcaatgatgcgatgttggctcactgcaacctccacctcctgggttcaagcgattctcttgcctcagcctcccgagaagctgggattacaggtgtccgtcatcatgcctggctaattttttatatttttagtagagacgggatttcatcatgttggcttagctggtctcgaactcctgacctcaggtaatccacctgcctcggcctcccaaagtgctgggattacaggcgtgagccaccgcacctggccttgtttggaaattttaagcagaatgcttagtccatttattcttcttcttttgataataatgtatgaattggcttctctatctctaagttgttttccagaggcttgataattatatccaacgttccacttgacatccccagttgatgtccaatgcataactcaaacaatatgctgaaaacagatcttcggattttctctctagcctctytcccacgtcttcctgatggtagtagatggtgactccatatttccaaatgctcaggccaaaaactttagagtccttcttttttttagacatagaacttttttctggccaggcacggtggctcatgcctgtaatcccagcactttgggaggccgaggtgggcggatcacgaggtcaggagatcgagaccatcctggctaacacagtgaaaccccgtctctactaaaaatacaaaaaattagccgggcgtggtggcgggcgcctgtagtcccagctatgcgggaggctcaggcaggagaatggcgggaacctgggaggcggagcctgcagtgggccgagatcgcgccaccgcactccaacctgggcgacagcgagactccgtctcagaaaaaaaaaacaacaacacttttttctttttttgagacagtctggctctgtcacccaggctggagtgcggtggtaccatcatggctcactgcagcctcagtctctcagcctcctaggttcaatcgatcctcccacctcagcctcttgagtagctgggactacaggcacacactaccatatccgactaacttttgtatttttttgtagaaacaggggttggccatattgcccaggctggtgtggaacgcctgacctcaggtgatccacctaccccggcctctcaaactgttgggattacaggcgtgagccgccgtgcccagctgtttcttctttcagttaataaaagagagggtgcattgctggctaatgagattgtttctatacttgggggccttcctgaatgtgtgtgattgagtttattgcagagaaaggtaacagaaaatggggttgtagaaagaaaagaggtagaggctgagtgagatgccccacatctgtaatctcagtgctttgggaggccaaggcgggcggatcacttgagatcaggagctggagaccagcctggcccaaatcgtgaaacctcgtctctactaaaaatacaaaaatcagccaggtgtagtggtgtgcgcctgtaatcccagctactcgagaggctgaggcaggagaatggtttgaacttgggaggcggagattgcaatgaggtgagataacgccactgcactctagcctgggagacagtgagactatgtctcaaaagaaaaaaaaaagttcctgggccccagaccagctctctctttgggttaaaaccccggcgtcccggagctgaggcgcacgtggctatgcttggggaggagagggcggggccggggaggaggcgcttgcaagtctgtaccgcaatgcctctactggcctctagagggcgcaatcactcgaggctccgccccaagcgaggcggggcggaagcgtgctgtgcacaggcgcaagatgggtcttgggcagcccagagcttccgattggctcttctgtggtggcggggcggggtcagaacgagatggctgtgtgcgcaggcgcaagactagcgctcttgggaccggaagttaaggcgttcgcggcgtgtggtaagtgaggggggcgggacgggtgtaccgggttgtggcggcgatggctgtcggagttgggccgcttgggggtagtttggggtgcgagtccaggggcgagggmastctcgagatgaggagaaatgtaggaggcagccgaagggccggcaaacgcggacagagatggcacctgagcgtccctgggagaacctgggcgacaggccagagaccgaaagaaatggaggcacgaaaagaagcttcgagaaactgagggactgaaagacgagggtgttgggagaggagggaagctgaaaactagagagcgtgggcgagagtgccgatgggttccagcgagagtcttagagcccacgaggccgagaggcgtggtcgcccatgaacttggggagtggagggaaaagtcggaaactgatcgtggacactagaaacagaaaaaatggaatttagatggagaaacgagacactgaatcacgggggagaccgagagatacggaaggatggagacagttgaaataggragaaccccacaaaagctggagataatggagaaygatgctgagaaatggaaaagcgagggagtggagcccgaacccctggatttgagtggctcatstaacactcggctactcacttagcctctctattgctcagtaaaatagggggtgatcatagtgcctgacagtcgtgagaaaagtgtgtgtgtgtatgtacataggtgtgggataggaatagatcatgcagataggataggtctgtgtgttaatgtgagtaagtaagcatgagctattactaaagcttctgatattgggagataaagtattagatggggaaatggagagaggtggtgatggagagtgaatactggaaggacaaaagggaggaaaaaaagattcaaacagaaaatgagaaagggcgtggtgactcactcctgtcatccacagcactttgggaggctgcggtgggaggatcacttgagcttgggaggtcgaggctgctgtacgccgtgattgtgccactgcacttcaggctgggtgacagagtgagaccctgtttcaaaaaaacaaaaatgaattttttttttttttttttgagatggagtttcgctcttgttgcccaggctggagtgcagtggtgcgatcttggctcactgcaacctctgcctcctgggttcaagcgagtctcctgcctcagcctccagagtagctgggattacaggcaggtgccaccaccctggctaattttgtatttttagtagagacgggatttttccatgttcgtcaggctggtctcgcactcccgacctcaggtgatctgcctgcctcagcctcccaaagtgctgggattataggcgtgagccaccatgcccggcctgaaaaagcattttttttttaatgagaaagatggagaaagtcaaatggagaactgaagagagatggagaaaggaagagttggattacagagaaaaatcagactacagaatgactcataagtgaagagagatgcgagctgactaggacagggaagagagatgagggtgatgatgaacaagacggactgaaaaagagacagaggcctgaagatggagtggagagagatggaggggacagagggggaaacaaacccactgaaggccatgagcccagggcaaataggccaagagaccaaaagatggtcagagacacagttatacagaaactagaagatgcagacaatctagaagccaaaaaagatagataccttgagaggagcgggatgctgtcagtggggcccagcatgcataagcagtttctagcctcagaagaatgctctcattttctttttctttttttttttttttttttttttttgagacagagtctcgctctgttgcccaggctggagtgcagtggctcagtcttggcttcctgcaagctctgcctccagggttcgagtgattctcctgcctcagcctcccgagtcgctgggactacccgagtagccaggtgcccgccaccacacctggctaattttttttctccagcctgggtgacagagcaagactccatctcaaaacaaaaaagactccaactgtaagcaaaaaggcattttctggtgtagctgagaagtggggggttgaagggaactaagcttcaagacctaaatgatgttgccaagcttctcttcctctccctctttcacctctccctgtggtgcagtgaccattcttgtgcctgtatctagttatttctctaggatagattttaggaaagactctgtcatgttccagagctaccacaaasagctccaggcttatatcaaacttgcctgattatgatggataaaatgagagcttttctgtcctagcaaccgagtgtaaattccacaaaagggccctgattggcccttcttggatcatgtgtccgcttctcaggccaatccttggttagagggggagtagactactaagactggccaggtctttgttacttgcctacccaataggggttctttgtcttaaaggccctcagaaccatgtagaatcgaggaagggctgttgtccaaaggaaggtggatactgtcctcagaaaagaagtaaagggttgtgccaggcaggcaaaaattacatataacacttgcaaaattttgccttttatctcaatgttctgaatctcactggaccccgggtgaagaacccttgccttattcttttcattatatcacacctctctcctattactgcctgtggagacaaggttctgctgttggttggccatgtgacctacatctctcctttaggtctcaggtgaaacatcccctcctcccaggatccttccctgattcccaagcatgggaaggaggaggaacctcctttggtgtcccacagctccctaggattctgttatcacagtccccatcactggattgtcacagtctgatgacgtgtgtgtcacatgagagatcatgtgatcatggccgtctgtgaggactctggtagtcatattcattacctcctttttctagttcagtgcttaagaaacaggctgttagaaatgtttctaaaaatgggctgggcatggtggctcacactggtaatcccaacactttgggaggctaaggtgggggaattgcttgagcccagaagtttgatatcaacctgggcaacatagtgagatctcatctctacaaacagtaaaaaattagctgggtgtggtggcatgtgcctgtagtcccagctgctcgggaggctgaggcgggaggatcgcttgagtccaggaggtcgaggctgtggtgasccatgattacggcactgcactccagcctgggaaacagagtgagaccctgcctcaaaaagaaaaaaacaaaacaaaaccaaaaaaagcaatgttcccaaaagagaattaatgtcttctgttctctctcttaagaatccagggcctgaaaacccagaatgaacttgtgtccatcccagagatcactgcagatgtcatgaggtaccctttgtgtcaccagctcaagcaggcctctggccactttatcatctgtggtggtcctgtsccgtgaccaggaggaaaaattagctctttgaagagaaagtagttctctattgcaggcactggcctcttaaattgttgcaggtggggaatggatgagaatatttgttttgggtgatcagaactgagactcctattgtggattagtaacatgcctcctcctagaacaagggagggcagggatcgccgagaccaccacygggctcccagcgaggaagaggccttggagaaatgggactggaattgtccagagacgcgtcgcctcttggaagatgccttcttccgtgaagaggattacatccgtcagggttctgaggaatgtcagaagttttggaccttctttgaacgcctgcagagattccagaatctcaagacctccaggaaggaggagaaagaccctggacagcccaagcacagcatcccagcgctggccgacctacctcgcacttacgacccacgttaccgcatcaacctctctgttcttggccctgccacgcgggrctctcagggactgggcaggcacttgcccgcggagagagtggctgagttccgccgagccctgttgcactacctggactttggccagaagcaggcatttgggcgtctggccaagctgcagcgtgagcgggcagccctccccatcgcccagtatgggaaccgcatcctgcagacgctgaaggagcaccaggtggtggtagtggccggtgacaccggctgtggcaagtccactcaggtgccccagtacctgctggctgctggcttcagtcatgtggcgtgcacccagccccggcggatcgcctgcatctcactggccaagcgtgtgggctttgagagcctcagtcagtatggctcacaggtgagtgggacgcaccaggtttccgatttttccagcgtgaccttgggggaataggttgcttgtccatatggcagtatcaataaaaatgaagcacttacccttggacccagcgatgattcttctagaactttatccacagagtggcttgtctgtggtctacatgacaaaggagctagcattaaccagtgtagcactttaacagcaaaacaaygggaaatgtcctaaaggctcatcactttttttttgagacggagtctcactctgtggcccaggctggagtgcattggtgcgatcttggctgactgcaacctctgcctcccgggttcaagcaattctcctgcctcagcctcctgagtagctgggattacaggcacccgccaccatgcccagctaatttttgtaattttagtagagacggggtttcaccatgttggtcaggctgggctcaaactcctgacctcaggtgatccacccacttcggcctcccaaagttttggrattacaggtgtgagccaccacgttgggctgcgagggtaattcttgacgatcactgcaatgcaaactgccatcttggaaggccaataatagtccttctgtctcatggtggtcatgaggatgaaatgggttgatatacataaagcacttagagtggcatataatgtcctggcacatagcagggactcaagaaaaggttattgctatatagttaatattatatatacatgaggcacagtgctagatactttctgtgcattgtcacatggaattctcacagcatctaggaggagaactataagggatggcattgcctgcccaaggtcagttggcactaagtggcagaggtgagattcaaacccaagstgttggactccagagtctgatgggtaggcatggtatttgcttagattttctttttgctttttcttttttttgagatggagtttcactcttgttgcccaggctggagtgcaatggtgcgatcttggctcactgcaacctccgcctcccgggtttaggtgattctcctgcctcagcctcccaagtagctgggattacaggcatgcgccaccacgcccggctaattttgtttgtatttttagtagagatggggtttctctatgttagtcaggcggatctcgaactccctacctcaggtgatccgcccgcctctgcctcccaaagtgctgggattacaggcgtgagccaccgcacccggcctgcttagattttcaatttgggcagggccaggggctggtacycaggctcagggtcctctcctgatcctttctttctcccaccccaggtcggctaccagatccgctttgagagcacacgttcggcggccaccaagattgtattcctgacagtggggctgctcctgcgacaaatccagcgggaacccagcctgccccagtatgaggtcctgattgtrgatgaagtccatgagcggcatctccacaacgatttcctcctgggcgtcctccagcgcctgttgcscacgcggcctgacctcaaggtcatcctcatgtcggccaccatcaacatctcgctcttctccagctatttcagcaatgcccctgtggtacaggtgcctgggaggctgttccccatcacggtgagtacttccccctcctcccacatccccagacctccaacctggtctctgtccaaacctggacatgcctcttctctctgctgctgtatctcccatctctttcatttaaagatgttctctttttttaaagctaccattttctgagcattcataatcagctggttagagtgctaagtgcttgttagagtaaaagctgttacaagaagacccaaaaatggctgggcgccgtggctcatgcctgtaatcccagcactttgggaggccgaggtgggtggatcacgaggtcaggagattgagaccatcctggctaacatggtgaaaccccatctctactaaaaacacaaaaacaaaattacccaggcatggtggtgggtgcctgtagtcccagctactcgggaggctgaggcaggagagtggcgtgaacctgggaggcggagcttgcagtgagccgagatcgcgccactgcactccagcctaggtgacagagtgagactttgtctcaaaaaaaaaaaagacccaaaaatgtaaagtctcaaataagagaagtttatttctctcatataacagtgtggctggtccaggctgttgggcaactctgttccatgtggtcattcagggatccgggctcctcctttgtcattactctgccatctcactgggcaggatttctcaaagtcagcaagattgacatttcagtctggataattccttgtcgtgggggctgtcctgtgcattgtaggatatctagcagcatccctggccctacccactagatgctagtagtcttctcctctggttgtgactattaaaaatgtctccagacattgccatatgttccctctggggcaaaaccacccctaattgagaaacactgtcctagtgagttatccttgtctgtatagtcaagacttacaggaagaacttcattgtctcttgtgatttctggttccggatgcccatcaatttgccttctaagcagccataaaaaaagaaagaatgggtcgggcacggtggctggtgcctgtaatcccagcactttgggaggctaaggcagaaagatcacgaggtcaggagcccaagaccatcctggccaacatggtgaaatcccatctccactaaaaatacaaaaattagctgggcatggtgacgcacgcctgtaatcccagctacttggaaggctgaggcaggagaattgcttgaacccggaggtcgaggttgcagtgagccaagatsgctccactgcactccaccctgggaacagagcaagatcccatctcaaaaaaaaaaaaaagaaagaaaagaaagagagagagagagtgcgagccgagtgtggtggctcatgcctataatcccagcactttaggaggccgaggcgggtggatcacctaaggtcaggagttcgagaccagcctggccaacaaggtaaaaccccgtctctactaaaaatgcaaaaattagctcgagtggtggtgcgcccctgttatcccagttactcaggaggctgaggtgggagaattgcttgaacctgggaggtggaggctgcagtgagccgagatcatgccactgggtgacagagcgagaccctgtctcaaaaagaatgaggctgcttcctgagaaatgttttctagggtttttgttttttgttttttgttttttttagtagagacgacgtgttgctatgttgtctgcctggtcacgcatacctgagctcaagcaatcctcccgccttggcctccsaaagagctaggattacaggtgtgagccaactatgctgggaaatcagccaaccaacctggctcaggctcagggtcctctcctggtcagccaaccaacctgatttctargtttttaatcctggtttcatcacctagaatatttttyttgttgaagctactctaaacataagataatgcatgcattgtaagtatatagcttaattagttttcaccagttacatacatctgtgtagctagcacccaggtttagaaaagtcaaacattgccagcaccccacaagccttgcagttgctttgttactttgtctttttattacatccttcagaaattatctagctggagtgtgctgtctgtcacctgactgtttctcaattaggggtggttttgccccagagggaacatatggcaatgtctggagacatttttaatagtcacaagcagtggagaagactactagcatctagtgggtagggccagggatgctgctagatatcctacgatgcacaggacagcccccacgacaaggaattatccagactgaaatgtcaatcttgctgactttgagaaatcctgcccaatgagatggtggcataatgagaaaggagaagcctggatccctgaatgaccacatggaacagagttgcccaccagcctggacccgttgcactgtgtcttctccgttagcctgtggtctcccccgtcagcctgcagcctccccagcccattgctctgagctggagggacagggtgtgcttctacctggggctgtctcctctcaggttgtgtaccagccgcaggaggcggagccgaccacgtccaagtcagagaagctggacccgcggcctttcctgagggtgctggagtccattgaccacaagtacccgcctgaggagcggggtgacctcctcgtcttcctcagcggcatggcggagatcagcgccgtgctggaggctgcccagacctatgccagccacacccagcgctgggtggtactgccactgcacagcgccctgtctgtggccgaccaggacaaggtatcacaggaagcccgagtggggcaggcggggggtctgcatgagtcaggggtggctgcgcacaggacttgtgtaactccacaaacacagggctcgggggctgtacttgtgcaaagtcgtagccacctagtggcagagccaggctgcgaacccaggtagtytggccccggagcccatgctctaaaccagaggtcggcaaactttctataaagggtcggagtagatgatgtcagtcctatcgaccatgggctctctgtctgtcacagctactcagccccactgttgcagcatgaaagcagccataaactgagtgggtgaggctgtgttccaaaacagtttttttttttttttgaaacagggtcttgctctgttgtccaggctggagtgcagtggcacgatcagggctcactgcagccttgacttcttgggctcaagtgatcctctctccttagtctcccaagtagcaactataggtgtgtgtcactaaactccattaatttttttttctttttgggacagagtctcactctgtcgtccaggctggagtgcagtggcatgatcgtggcttactgcaatctccacctcccgggttcaagcgattctcctgcctcagcctcctgagtagctgggactacaggcacccgccaccacgtccggctaatcttttgtatattgagtagagacggggtttcgccatgttggccaggctggtctcgaactcctgacctcaagtgatctgcctgcctcagcctcccaaagtgctggggttacaggtgtgagccactgtgtccggcctccgttaatttttttttgaattttagtagcaaagaggtctcactgtgttgcgcaggctggtttcaaactcctgagctcaagcgatcctcccctagtgggggcagtgccagtttatgcttcagcagatccctctggctgccatgtgagtctacaggccagagatctgaggggaagctggagtaggatcagagtgggcgaggagaggcctggaccagggcaggggctgggctgtcggaggagggaaggatttcaagaaaagttccagatggcctggtacattggctcatgcctataatcccagcacaggaagctgagacaggaggatcactcgagctcaggagttagagaccatcctaggcaacacagtgagaccttgtctctacaaaacggaagaaaactagctgggcatggtggcatgtgcctataatcccagctacttgggaggctgatgcaggaggatcgcatgagctcaggaggtcagggctgcagtgagctgtgatcacgccactgcactccattgtaggccacagagtgggatcctgtctcaaaaaaaaaaaaaaaagttcaagatgttcaggtcgggggagcagktgtggtggctcatgcctgtaatcccagcacattgggaggccaaggcaggcggatcacctgaggtcaagagttcaagaccagcctggccgacatggtgagaccccgtctctacttaaaatacaaaaattagccgggcatggtggcgggcacctgtaatcccagctgctcgggaggctgaggcaagataattgcttgaacccgggaggcagaggttgcagtgagccgagatcacgccactgcactccagcctgggcgacagagcaagactccgtctgagggtgggggagggcccaggatggcccaggtgatggggtggacggtgagccatctccaaaagggaggtctctgaaggaggaaagggttccagggaagctgctgacacgggggtgggcaagaaattggacacataggttagtcggggctgagttagttcctgacaccaccccctcccttcctcccaggtatttgatgtggcaccccctggagtccggaaatgcatcctctccaccaacattgctgagacctcagtcaccattgacgggatccgcttcgtagtagattccggtaaggaccaccatgagcccctacccaccacccccaaggacttaggagcatggggtccggaggtgtgcgtgtgtggcaggggcgcaccagcttggattgggaagtacagttgactttcccatatccaaaatgcttgcttgcaaccagaagtgtttggaatttcgggtttttttgaatttggaatatttgtatcaattttattatttgagtatgtcaaatccagaaatctgaaatcctccagtgagcatttcattggagggtcacgttagtgctgaaaacatttcagattttcgagcatttcagactttggatttccagaattgggatgctggaagacgatgtgtggggccatggaccaatggcaacatcttagtttttctcacaccttccaagcctgcttctgccctggggcctttgtactgttctctctgccgagagctgtctttctccaggtatccacacaggtgacgccctcacctcatttcagggcccgcataaatgtccacccgtcagagaggcccatactgtccactctgtctaagagatatcccctcctccatccgctgttgcttgtcatatgagggggattgacattctgtttgttgttgttgttgttgttgttgttgttgttgttttgagacggagtcttgctctgttgccagactggagtgcaatggtgcaagctccgcctcccgggttcaagtgattctcctgcttcagcctcccaagtagctgggattacagacatgcatcaccacgcccggctaatttttgtatgtttaggagagatggggtttcaccatgttggccaggctggtctcgaactcctgacctcaagtgctgcctgcctcagcctcccaaagtgctgggattacgggcatgagccaccacgcccagcccgacattctattttatgtgctgctctgtttgctcactttctgtcttcctgactggaatgttctctgggaagtcagcatagcatagtgtttggagacactggagcctgcctggccaggtttagtgctggctgtgtggctggggtcatgtgactgacacttcatgtatcggttggctcatctgaaaaatgacaatggcaggccgtcccggctgggcgcggtggctcacacatgtaataccagcactttgggaggccaaggcaggcaggtcacttgaagttaggagtttgagaccagcctggacaacatggtgaaactccgcccctactaaaaatacaaaaattagccaggcatggtagtgcgtgcttgtagtcccagctgctcaggaggctgaagtgggagaatcacctgagcccaggaaatcgaggctgcagtgacctgtgattgtgccactgcactcaagcctgggcaacagagcgagaccctgtttaaaaaaaaaagagagagagagaaattaaaaaaataatgtctgccaggtgctgtggctcatgcctgtaatcccagcactttgggaggctgaggcaggtggatcacctgaagtcaggagttcaagaccagcctggccaacatggtgaaaccccatctctactaaaaatacaaaaatgacccgggcatggtggcgggttcctgtaatcccagctactcaggaggctgaggcaggagaatcgcttgaactcaggaggcagagtgagccgagattgtgccattgcactccagcctgggcaataagagtgaaactccatctcaaaaaaagaaaagaaagaaaatgtaaaaaaaggttgttctgacactggaggaaatatggtgctctgttcagtcctgtgagactaggacctttgtttagctcactgctgttcccctagtgcctagtgcagtgcctggtatatagtaggtgcttaataagtatttattggataagtgaacctctgaagaaacaaagacttgggaaaataaatgaaaagatgtgtgagtgaaaggctgggtgcagtggcccacgcttgtaaccccatcactttgggagcctgaggcaggcagattgcttgagcccaggagtttgagatcagcctgtgaaaccccgtcactgcaaaaaattagccgggtgtgttggtgtgcacctttagtcccagctactcgggaggctgagctagtaggatcatcgcttgagcctgggaggttgagactgcagtgagctctgactgagccactgcactccagcctgggagacagtgagaccctgtctcaaaaaaaaaaaaaaaaaaaaaaagatgtgtgaggaaatgaaagaataaatgaacaaaatgtcagagttgggcccagaataagccctcagttagcattaacagaataaaggagtaagtgagggtgttggcgagtgacaagagccaggcgcgtggccagctgcacgtggctgccacacacagactccctttcctcattgctyccatccaggaaaggtgaaggagatgagctacgatccgcaggccaagctgcaacggctgcaggagttctggattagtcaggccagcgcagagcagcggaagggccgggcgggccgcacgggccccggagtctgcttccgcctctatgccgaatcggactatgatgccttcgccccctaccccgtcccrgaaattcggagggtggccctggactcgttggtgctgcaggtgaggcaygggcagaaaggggactatatcctaactgctggcacagggaggaacctgggaggccttttttattttattttattttattttattttgagatagcgtcttgctctgtcactcaggctagagtgcagtgctgtgatcatggctcactgcagcctccatattacaggctcaaatgatcctcctacctccacctsccaagtagctgggaccacaggcacacaccaccacrcttggctaacttttaaatttttatttatttatttatttttgagacggagtctccctctgtcgcccatgctggagtgcagtggtgcgatctcggctcactgaaacctccgcctcccaggtttaagtgattctcctgcctcagccttcctagtagctgggactacaggtgtgcaccaccaagcccagttaattttttgtatttttttttagtagagatggggttacaccatgttagccaggatggtcttgatttcctgaccttgtaatccaccctcctcggcctcccaaagtgctgggattacaggcatgagccaccgcgcccggcctaactttttttatttttagtagagatcaggtcttgctatgttgcccaggctggtctcaaactcctgagctcaagtgatcttcccaccttggccttccaaagtactgggattacagccatgagccattgtgcccagccagccaggaagcatttacataggacccaaccccagagtgtcagggtcaggaaggatagggctagccaagccactgaggggaacccatcccttccaaatgtcaaaacccttgttgaggggagaattgttccttaaatccatagggtcagctgggcatggtggctcacacctgtaatcccagcactttgggaggccaaggcaggtggatcacttgataccaggagtttgagaccagcatgaccaacatggtgaaaccagtctctattaaaaatacaaaaaattagccgggtgtggtggtgtgcacctgtaagcccggctatttgggaggctgaggcaggagaattgcttgaacccaggaggtggaggttgcggtgagccgagatcacaccactgcactccagcctgggcgatagaacaagactccatctcaaaaaaaaaaaaaaaaaaaatgtccatagggtcaaaggaagaaccagtgactcaatcagaatgctttcagctgtaacaggaaacctagcaggaaagggcttttaaaaccagggtttctcaatacattttatgtcatgatttgtatctcatttgttaatttagcataggttagactgccatgacaaatacacatggtcacgaatggccaacagcggaatggtggtttacaggttggcaggcaattttctttattcagggacccagggtccttcactcttgtggctctataatctccccaggggcttttcctgcatatgtgtccagccagccaaagggtcaagggcatgggaagtgagtacaggagggtttgcgggtcgagcctgcaaatggtgcacttgccttgcactcaccactcctggtcagtcctcagtctcgtggccacgcccaaccgtgaaggaggctgggaagtgtagtccttgtgctcaggaacaaaaggaaaaggaaagttgggagcagctgatggtgtctgccacaggctcacgtgcgggtgtagcacaaaccagtggccttcctgcaggaggtgcacactattttctattctgtttgatttcatcttttaaaaaaaaaaatactagtgctgccgggcacaatgagtgactcatgcctgttatcccagcactttgggaggstgaggcaggaggattgcttgaggccaggaagtcgagaccagcctaggcaacwcggtgaggccctgactctagaaaaaatttaaaaattagcccagtgtgatggcacacacctgtggtcccacgcaggaggctgaggcaggaggatcgctagagcccaggagttcgaggctgcagtgagccttgattgcatcactgcactccagcctgagtgatagagcaagaccctgtctcataaaaaaacaaagtccatggggtaggtagtcttaccctaatttttggaccagaagaaggatgcagagagagagaaaatattgccccaggtcacacagctggcaagtagtagagtcagggctccatccgaggccaccaggcgtcagagcctgcttcgtgagtggccgctggctccaggcacagtgggcgtcacctcctcctcctttaccatccggaggcagaagcaaggaactgcccttctctgtgggtctaatttttaaggccacaggaacattttctagactcctctggccagtctctcatcctctcttgtcagcagaaccgggtcatatgtgttcaccctatgccccgcaattgtctagggttgtggcattgcctgagttgatcagagcagtgtctcagccccagctgcatactagaaacacctggagaatttaaaaaaaccccaggccctgccccctgcctctttaaattgagcttctaatgtaaaggttatttatttatttatttatttatttatttatttatttttgggacagagtctcactctgtcgcccaggctggagtgcagtggtgttatctcggctcactgcaacctccacctcccaggctcaagtggttctcctgccttggcctcccgagtagctgggaccacagatgggtgccaccaggcccagctaatttttgtaattttagtagagagggagtttcaccatgttgatcaggctggtcttgaacttctgacctcaggtgatctgcctgccttagcctcccaaagtgttgggattacaggcatgagccaccgcgcccggcctataaaggtttttaaatgagtattgggtgaactcatagacggcatcaaggcttggtcagcagggaggaaggagcagcagctgcttgcaggtggacgccagaacttctagtgccctcggatcaaagccaggcaaacagacttctctgagcttccttctcgctctctggctgtcacatgagctgccttgccagcctctccttcttccagtcaccagagaggtgctgtttgcttacgtatgccacgccagaccccggggtggacatatgctgtcacttaattctcccaccatctactgcctgcctggactgctgcattaattgggattcttttggttgtaagtgagagaaatacaactgaaactattgtaggcagaaagggggatcttaccattttgtgcattcatgaggcggcatgtctaacttaggaacaatccaagaatttctccatctgctgtaggtgggcccatttccaaaaaatggacaaagtcaaaggtcacagcagttctgggttaataagatagccttccatcctggccacaaccagagaggatgctgggaatgctcttcctggctccagtctcatggaaggattctgattggtccagctcaggtcacgtgcctctsctccatggtctggggcaagatgtgctaggcagacagatacagagacagcagccctccttgcctgcctctgcacagtggatcttgacattgggaattttattttattttattttattttatttttgagatagaatctcactctgtggcccaggctggagtgcagtggtgcaatctcggctcactgcaacctccgccttccaggttcaagcaattctcctgcctcagcctcccaagtagttgagattacaggcactcgccaccacacctggctaatttttgtatttttagtagagatggggtttcaccatgttggccagtctggtctcaaactcctgacctcaagtgatccacctgctgtggcctcccaaagtgctaggattacaggcatgagccactgtgcctggctgacactgggaatttgagatggagtctcggtgtattgccaggctggagtgcagtgcagaggcgcgatctcggcttactgcgatctccacctcctgggttcaagcgattctcctgcctcagcctcccgagtagctgggattacagtcatgcaccaccactaatttttgtatttttagtagagacggggtttcaccatgttggccaggatggtcttgaactcctgacctcaagtgatccgcttgccttggcctttcaaagtgctgggattacaggcatgagccacaacgcccggccaacactaggaattttaaaacgtcatgaatttgtgatctctgagccccgctgtgctgcacagtggctcttgtgttccccaatcttgggggttttgcttctcattctagatgaagagcatgagtgtgggggacccccgaaccttccccttcatcgagcccccaccaccagccagcctggaaaccgccatcctctacctccgggaccagggggccctggacagctcagaggccctcacacccattgggtccctgctagcccagctgcctgtggacgttgtgattggtgagtacccacccccctcstgatcactcagggccccaggagcgggtatgggcacagctcactctctgagtggcctgggggcaagtctgtttcttccctgggtccagttcatttattcactcttcactgggccaggcactgttctaggtgctgggcatatagcagtggacagaacagacacaaatctctggcctcagggagctgacattttggtgaagaagaccagcaatacattaggacaataaggaaaaggcatagtagatcagatggtgcctagtgttctggagagaagaaacaacggggttggggaatggggagttgcagtttgtaatacaggcctcatgtataaggcagacctcatggggaaggtaacatctgtgcagagaaatggagatgagggctaggagccatgcaaatactagaacatgcttgccagcagaagtcgagaaacatggccggcacagtggcccacacctgtaatcccagcactttgggaggctgaggcaggtagatcacgaggtcagcagttcgagaccagcctggccaacatggtgaaaccctgtctctactaaaaatacaaaaattagctgggtgtggtggcacacgcctgtaatcccagccacttgggagggtgaggtaggagaatcgcttgaacctgggaggtagaggttgcagtgatgcagtgagccgagaccatgccattgtactctagcctgggcgacagagcgagactccatctcaamamaaaaaaaaaaaaaaagcaaaaacaaacaggygasattcattttgataaaatagctgattcaacctaatatacctaaaacatcacaattttaacataatcaatagaaacatttttgcaagattttatgttattttttaccatacgacgtcttggaaatcttggtttggaccagccatgttcaactgctcagtagccatgtgtggccagaggcggccgtattggacagtgcagatggtgcatgagggtgttcgggcagtgggaacagccagtacagaggccctgtgggggcacatgcctgctgctacaggaacagtgaggagccccgtgtggctgcagtggagtgagagggagaaggtgggagatgtaaccaacagtctcatcattcattcattaaatcctttttttttttttttttttttttgagactgagtttcgctcttgttgcccaggctggagtgcaatggtgccatctcggctcaccacaacctccacctcttgagttcaagcgattctcctgcctcagcctcccgagtagctgggattacaggcatgcgccaccatgcccggctaattttgtatttttagtagagctggggtttctctatgttggtcaggctggtcttgaactcccgacctcaggtgatctgcccgccttgacctcccaaagtgctgtgattacaggcttgagccactgctcccggtccattgaatgtgtgtgtgtgtgtgtgtatatatatacacacacacacacacacacacatacacacacatatatatacatacacacatatatatacacacacatatatatatgtttttttttctttttgagatggagtctcgctctgttgcccaggctgaagtgcagtggtgcaatcccagctcattggaacttctgcctcctggattcaagcaattctcctgcctcagcctcctgagtagctgagactgtaggtgcccgccatcatacctggctaatttttgttttgttttgttttgagacagtgtttttgctctgttgcctaggctggagtgcagtggtgtgatctcagctaactgccacctcctgtgttcaagcaattctcctgcctcagcttcatgagtagctaaaattacaggctcacgccaccacgcctggctaatttttgtatttttagtagagacggggtttcatcatgttggccaggctggtctcgaagtcctgacctcaagtgatctgcccacctcagcctcccaaagtgctgggattgcagacttgagccaccgtgcccggccagtatttgttttttcagtagagaaggagtttcaccatgttggtcaggctgatctcaaactactgacctcaagtgttctgcctgcctcccaaagtgctgggattacaggcatgagccactgcgcccggccaatatttgtttttttagtagtgtcaaggtttcaccatgtcggccgtgctggtcttgaactcctgactttaagtgatctgcccacttcggcctttcaaactgctgggattacaggtgtgagccacagctcctggcccattcattaaataatttttgagcacctgctctgtgccaggtcctagtctagatgccagagatacaacagtgaataaaacaaaactcctgccctcacggagctcacatgtaacaggggagatggacaggggcagataaatgagtgaaaacacggaatgtcagccgctgattgctgctcaggtggatgcagggcacggtgggcacagtgggggctgggagcagtgttaattggctgtcctgggaggccaattaacagtgacatctgggcagaggcctgaaggaggggaggggacagctgtccctctggccctgggtcaggtgaggagctttgaattaaatgggaagtgtttaagtggaactgggtcctaagtggctgaaggtggccagaaaattgatcagttgacctggcggttctgtgaggatctggaaagggcgggtccacagaggtcgacggagaccattttcagttcccagccctcctgatctcaggtcttcagtagccagtcacaagcagatgtggtgctcctcgtccccacgctgtgtcatcaggaatagggcgttaatcttgagggatttggggccagcagaccctctgaccctgtckttcttgtgtgcaccgtcagtgtctcaggcactcacctgacgctgcagatgccaccaccagaggctgggtgtggcctgtggtgtctggcttgcaaggctgtttcagagaatgtgacgcaaagtgccctggttgtgcgtgagtgacaggaaagacaggctctctcgcttggattccccagcacttggggtcatgacagggcctcccttgggaggcacaggcaggtggagtacccaagatcccccaaacgcagaaagaagtcttggcttttccacagctcagacccctcccacctctctcctctgcacagcgtgtccccagctctgccccgcacccctctcttgcgggctcaaggatgtcaaaactcttcctctccctcattcctgagtcatgctcacccctcccggggagctcactgactgaggcttgttcatcttgcctgattctcctgactcaagactttctatttccagcagcctgaggcccaccatggcaggaccacccatgtatgtgtgttaacaccattaaagcccccatccttgcagcayagcagggcttcagtgtgggcaggaggctggatccgctggacttggagggctgcccaggctaagaagatggttcatttttgttttatttatttatttagagatggagtttcactctgtcctccaggctggagtgcagtggcatgatcttggctcactgcaacctccacctcccgggttcaagtgatcctcccacctcagcctcctgagtagctgggattataggcatgtgccaccacactcagtttttgtattttttagtagaaacagggtttcaccacattggccaggctagtcttgaactcctgacctcaagtgatccgccagcctcggcatccctaagtgctgggattacaggcgtgagcccctgcgcccggcttcatttttgttttggaaggaaacagggctagagcagggagaatctgaactgagaagcagaagaatgttctgtgagctcttgctgtgtgccggcgaaaggctctgtggactttccgttatttcatccttacctgctgagggcagggcctctgatcgcccccagtgtgtagatggggaaactgaggctgggcccaggaggctcctgagggcatggggaagcctggctttgatcggaggtgatggtaaatgcctcactcacattatctccctgagggctgggkgcaggtgcccccacttgccctgtggggaaaacgaggctcagagaactgctgctcagggtcacagtgggaactgagaggcacggatgaccctgtgctgggcgtcctctgtgccaggtggagttctgaacgcttcacagggtgaaacacaaagcatcctcttggcagcctgaggagaggccaatgctgttgttcccccgtttacagatggggaagcagcgtcacggcgaggtggggccacttttccctggtgacagagctggggtgtcctggaataggacaggggcctgcacagtacagccccaagccctgctttactgccacctttgttttatgaggccagctttttttgtttgtttggtttttgagacgaagtcttgctctgttcactcaggctagagtgtaatggcaagatctcagctcactgcagcctccgcctccagggttcaagtgattcttctgcctcagcctcccaagtagctgggattacaggcgcctgccaccacacccagctaatttttgtatttttagtagagatggagtttcaccaggtttgccaggctggtctcgaactcctgacctcaggtgatctgcttgagtccagttttgtgacaggcactatggaaagtcagtgaaggtcaacggtgggggcgggtcagacacatgacacagaccactagttactggacaggtgggcaagggagcccccagaagtccagcgtcagctcgggcgcccagaaccaggggatgtctagatgcccgctgtggagcgctcacagatggagacagggttcacctgtctccaggtgagactcggccaccctgggagacggttcctgccacttttcctctctgtggcctcccctctgtccttcctcccctttccctacctctcccagcccctgccccatctttctccatgtcttcrccttctgtcccctcttcstcttccacttccaccttgacctaaacaaaggctgcaggagaagattcatcctgtgataagcacaggagtcagtgcctgcctgtgccagggcagagctagagggactcacttacaggtgacactctagcgcggaggagagacgtccaccgtgatgggtcaaaatgagctcctagagcaaagaccaagccagggaagcatcagagcgctgggggagtgggttgtaaatagcaaagtggggaacttggtgacaggagtagtcagcgcttagacagtrtctcctgtgtgtccaaggaggcagggactggccatctccaatctacaaatggggaaactgaggcccttgcccatggccacgtgaccagaaagcacagcgcgtgggtttgaatctccatctgggtcacragacccttagtgggcaagatggagggggtgggagcaggagggcaggcgggagggcaggctggggccccgaggggtgagggctgcgcctgtcctggcacccaggagcctcaaccccgtgtccgccgctgcagggaagatgctgatcctgggctccatgttcagcctggtggagcctgtgctcaccatcgcagccgcacttagcgtccagtcgcccttcacccgcagcgcccagagcagcccagagtgcgcggcagcayggcggccgctggagagcgaccagggtgaccccttcacgctcttcaacgtcttcaacgcctgggtgcaggtgaggctggtggtgggggccctctgtctgtcaccctgctcagggccaaggccttctgtggctgtggctcctcctcgtgtcccaccctcagccccaccctgggaggaccactgagccccccacagactgggcctgcctggggagggccatgtctccatcatccatgctttcggctcaggacagcatgtgcccaggcccggggctgagaggagcctggggtttctgaagcactgatgaaaacctgtgccacctggagaaagtccaggctccttgggaggcatctggagatccagtatatgtcccttgagtcctcaccctaaccctggccctgtagtgtagtgctgggggcccatcagtgccaaaactaccctggccctgccctcccggggytcacagcccagtgcagggagacagaccactgatgtgacagtgacaacccagagagggctggaatggggagtccagggggctgggacaacccagcggggcatctaacccagtttgtgggtagtctgggagggcttcccataggagggggcactggggctgagacctggaagcaggagagcaggtgtccctgagggatgcccattttggggctctgggtgctcggtcagcccctccctscccgcactggccaggccctgacaccctggcgtctgctcctccacccaggtgaaatctgaacggagcagaaactctcgcaagtggtgccgccgccggggcatagaggagcatcgactgtacgaaatggccaaccttcggcgccagttcaaggtgaggctcgggaggaggggtaaggccggccccactcaggcagacgtgtgtaagcacactccagaacactgcttccccttcccrgacagtggtcagaccagaatcccaccctgcacccacctcccccaccacccggtgaccaggtgttggggcagctgggcagagcaaagggagcagaaatccaggagggcttcctggaggggtggaccgagtcagtggacatgcagcatcctygggaagagctcgccctccrgactggggatgctgagctggctgcatgggcatggtgttggaggcagcctacggttgtggttggccggcacatctggagccagacacctcagccacaratcccagctctgccatttctgacagcgtggccccgggtgtgttactgcttgtctctgggcctcagcttcccctcgataaaaagagaggataaaaatagcacttgccagccgggcrtggtggctcacgcctataatcctagcactttgggagggcgaggtgggtggatcacgaggtcaggagatcgtgaccatcctggacaacatggtaaaactccgtctcttctaaaaatacaaaaattagccaggcatggtggcacgtgcctgtaatcccagctacttgggaggctgaagcaggagagtcgtttgaacccaggaggtggaggttgtggtgagccgagattgagccattgcactccagcctgggcaacaagagcgaaactccactcaaaaaaaaaaaaaaaaaaagatttgggtttctcctgcgcccacacagttctgcagcttgtttcatagatactgttctccatctgagtgcagacagacctgctgttaggtccttttccatggttgtatccatggattgagaatagaataaaagggttcctggtgtaatccattctgtttggttggagatgggcaagctgaggcccagagggggcagtcacccagccgacacctcckgtaccatttctggggtcccggtgttggggaccacagatgccccgawtgctctgagcatgggtcccgagttctctctggctgctagagcagtgttcaggcttcattggtccccagatgctttgagaatctaatggaaagtgtgagccctttgcacccacatgcacacatacagacacacatgcacgcacaatctcctgtgtcctccatcggtcagggctcagcaggaaacagaaggtccaaccaaattgggtcacttgaggaatgttgacaagatgtgggcacggggagggcaggggtctcagattttatgggtcacaggcagctggagggtctgttgggtccagatggccaaccccgccgagccccctcctctctccacttggtcgttctgggatgaggcccaggacttggcattcccagcatgtgcctagatgccccagggctacactcagaagcactagtgcaggacgcccaccagggctgtgtgggaaagcagggccccccagacccaaggggcaggtggggcagtcagcagagcctggagccagctgtgggaaaaggcactggacgcccgcacctgcctcctcttgcccctggccccggtgttccctccactgaccagcgaggacagctctctctctggagcagcgatccatgcccagcaccatgcgaggggctgttttcagccccctttgggcactagcagccctgccactgggagggtccccatttccatgagtccagagcccactgagtctgccctgaggccctcacccctacccacctgcccctaggagctgttggaggaccacgggctgctggctggggcccaggccgcgcaggtaggggacagctacagtcggttgcagcagcgccgggagcgccgggccctgcaccagctgaaacgccagcacgaggagggcgcggggcgcaggcgcaaggtgctgcrgctgcaggaggagcaggacggcggctccagtgacgaggacagggctggcccagcccccccaggggccagtgatggcgtggacatccaggtgggcgccatgggctgtggggtgtgggggtttaccaaggtgggccttggcctctcctgggggggtcccaggggacatggccctgtcctcatttcaggagccgggtttccatggacggtgcttggtcycaggtatctgcagagcctgggggtctgcggatcatggtaggagcccctcaggtcccctaagactctgcctccccgtgctccccccaggatgtgaagttcaagcttcggcatgacctggcgcagctgcaggccgctgccagctcagcccaggacctgagccgcgagcagctggctctgctgaagctrgtgctgggccggggcctgtacccacagctggccgtccccgacgccttcaacagcagccgaaaggactcagaccaggtggggcctgttctgccccatcctatgttttgtcctccaacacacgaaccctgagtgcctgtcctgtgccgggaatgcagtggtgactgaaacaaccctggttctgtccccatggggctcacaacccagtgggaggacagacccatccccagacaacccagagtgggcagggcttggggagtcmagagcactayaggagcccacagggggcatctgccccagatttggaggagtcagggagggcttcctggaggagggracctgggccagagggtggaggagaggcatcctgggcagaggagagagcagataggagggcttgtgctttctctctgtcctccgcagattttccacacgcaggccaagcagggcgccgtgctgcaccccacctgcgtcttcgctggcagccccgaggtgctgcacgcacaggagctggaggccagcaactgcgacggaagccgaggtacagtgagcccaggcggaaggaacccccayccgggatgtgaggggcagggataccgtgaactcccaggcccctctggctggggctcccacaccggcccaggctggtattgacgggggcccacaggaggggaagttccagggccaggcctccctgggtagccttgggtgactcacccctgctgggcctcaccttccgcatggtggtgatagtcaacctaagccagtgtggctgtgcccagagmgtgagcaccggtcagggggcctgtcctatggactctgtgagctcccaggtgggtcctgcagagggaggcccccctggcacccgtgtgcatggaagggtgtctcgctgcaggcatggctgcgtgctgggagtcacattcagatttggctgaccttcttgtctgagccaggccaccaaagccatgccgtaagcatactctttctatcgatgtgtactttgaccgggtgggacaggcgggcttctgatgggcctgggtgggccagggtgggcctgagcggtcctcctcaacctttcagacgacaaggacaagatgagcagcaaacaccagctcctcagcttcgtgtccctgctggagaccaacaagccgtacctggtgaactgcgtccgcatccctgccctccaggtgggcctctgccccaccccgcccccatgcccagatatgagagctgcgttgcccagggtggtgggtgggggcaccgcgtgggcttggaggggccacctggcacctgggctggccgcaggcgtcagccttgggccgttgctgtggctgctttttctctcattcatggacttgctcaacagttaacctgccaagtgcctgctgggtgccaggcgctgtgccaggtgccaagggcgcagcagggaaccaggcatgaagcccagcccctgccctctcgggctctagtggcaggggacagtgacagcagtagcacagtgatgccctgagcgacgtgtgggagggtggacacagggtgtggtacaagataaggccacctggtgtccccaggcagagacccaaagaggagagcgtgtggatctcggggcagagtgttccaggcagtggggtggcctgcacagaggctccgaggcagacatgtgcctggcgtgcagtcagcaagggagagcgtgtggagatgaggccagagaggcgagggagacaggaccctggggacttctcagagctgggacagggtcccagccaggagggctggcagctgccaggagggagaggagggtgctgccccggtggaggctgaggccgaactcagatcatggatgcccttgcatgggcaccggcagcagagccatgggccccatggcagccactgccctgcccctagtgctcctcgagcgtctttgtgatcctaggcctggcctcggagtcctcacgcagccctgtgggtctccctttatagaggggactgaagctcaggcaggggcggggatacgtcacctaagtcacacaccgagcaggtggccaagccagagctcctgggtcacactgccccctcctgcctcctggctcactaccagcactccccggcttgggtcccagggaacgtggaggggagagaggaacctgcaggctcctagagcctcagggttttgttgacactgcgattgccaccaacaccacaaaagccagctcagctcagtcacttctgtgygtgtccacacctccctcgagcccgtctggtgggccaggcactgttagtgttcagtgttctggggccgggggtgcagctgtggtcaatgtcaaccaaactccccaccctcatggggctcagataggatggtagaggcagacggcaaaccaaaagggtgatgccaggtgctcatgtgagcatgggaaagcaggcagcacgcaggccgagggacagaggattggcgaccagccgggccgcaggaagcggaacagacctgctacctgaggcgctctctccctgcactggactgcttgttgagagaayctggccagctcacacctggaatcccagcaccttgggaggctgaggtgggaggattgtttgagcccaggagttcaaaggcagcctgggcaacatagggagacwctatctrtctctacaaaaaattttaaaaagttagctgggcgtggtgttgtgtgcctgtaatcccagctactcgggaggctgaggcaggaggatygcttgagcctgggagattgaggctgcagtgagctgtgattgttgacactgcactccagcctgggtgacagagtgagacactgtctcaaaaaataataagccgggcatggtggctcacgcctataatcccggcactttgggaggccgaggtgtgtggatcagttgaggccaggagtttgggaccagcctagccaatgtggtgaaaccccatctctactaaaaatacaaaaattagccgggtgggtggcgcgtgcctgtaatcccagctactagggaggctgaggcaggaaaatcgcttgaacctgggaggtggaggttgcagtgagccaagattgcgccattgcattccagcctgggcaacagagtgagactcatctcaaataaataaataaattaataataakaakaakaagaagaagaagatggagaaacttcacattcacataagcaggcagaacagtatatggagccctcctgtaccatccccggtccccaaaccatccacgcatggccagtcctgccctttcctctgccctggccccagccctgaggattttccccaacatcttatgagccacagcactgstaattacagcgctgacttccgtcctcacagaggagcgtgtgctcagggtctgggctctccctgcacgtcgtgtgtgtctgagtgcctgctgtccctctgccaccctgcctgagaatgcagctgtctctctcccagcacgctcccatctgccgccccgccaccccagcccccttccctgactcagcggctgccttgttcatgccgtatccccagcacccgaaggggtgcctggtacagcgggtagatggcgggtaggtggatgcctcacatagacagggctggtgggtgggcaggagcccagccgggcagrgcctgtctccaatagcgccctgcccctcccacctactccctgtcttctgcccccyctctttcagtccctcctgctttttagccggtctttggacaccaatggtgactgctcccgcctggtggccgatggctggctggagctgcagctagcagacagtgaaagtgccatccgactcctggcggcktccctgcggctccgtgcccgctgggaaagtgccctggaccggcagctggcgcaccaggcccagcagcagctggaggaggaggaggaggatacgccagtcagccccaaggaggtggccaccctgagcaaggaactcctgcaattcacggcatccaaggtaccctccaccagggtgcccgtgcctccctatggccagaaggggcatccgtcactgggcttgagcctcgggaaggcctggcttcccattcactccacatgggcacatttgggggttttcaggccacagaggttcagtcacttacacaaggtcactccactggtctgggtggagctaggatttgatcccaggagcctggttccagaggccacactacccactgctgccttgtttactaagcaccttctgcaagcgtggctgatcccctcttgctaacagtaaaggacaggcagggtgtgagagggaagccgtagacgtctgcttgtggatgggaagaactgaactgagcagacttgaaaccagcccctgactcttaggtggggagtggaaattgctcgtggttctacttcatgtgggtggggtggggagaagggtacaatccaggctgacttcctggagtagaagggcttgaggacaaaggagcaggaacccagtgagccatggagaggggaccaaggctgacatgctaggaggaggaggggggaggtggccagacttgaaggttagactcaaggtctgaatggggtcccaccagtgacaggggcagaagaggggcctggggagggcaatttagatgggggtgggttatcaggtatattctagacagacccctggtcatgtgtgtctgcagccaaattgtgattggtgtaagcacttggctcccgtaactgcaaagcccgagggagggcttcaggcacagctggatccaggtgctttggcggcatctccctgagtctgtctctctccattkcctgtctctccttccttagattccttacagcctccggcggctcacagggctagaagtccagaacatgtatgtgggaccccagaccatcccagccaccccccatcttcctggcctctttggcagctccaccctgtccccccaccccacaaaggggggctacgcagtcactgacttcctcacctacaactgcctcacggtaagcatgaaccctccttccctgaaggtgggatttcaggaagaccccaccaccccgtttcaccttagtccagggacatagttcccaagtggggcccrtggccctgagggcttctgggaagggtcccgggggggcacttgggtggtgggtggcacttggcgggggcccagccctgacagctggcctgccacagaatgacacagacctgtacagcgactgtctccgaaccttctggacctgcccccactgtggcctgcatgcgcccctcacgcccctggagcgcatcgcccatgagaacacctgcccccaggccccacaggatgggcccccaggtaagcacaggactgtggggacccggccacctctgcccagccgtctgyccatcccatgatggtctcctgtgcgtgtgagcacttgctagagcttcgaggactgacgacctccacccgctggccctggctggtgccacacacaggccttgtcctgaagatcaggagcccaaggcagggagagcctggagcgccacctctttctgtctgcctgtcccctgtggtgtctctgtgttgctgtctttgtctctgtttctgtctctctgtggctatgtctcttgttatttttctctgtcctgcagctatctctgccttggtcacctccaccctgttgtcacccagggatgccacacactggggttcagtgggggagatagcactggggccacatgcctccatccccggctggctgtgtctgcctstcagtctccatgtctctccttgtgtctttctctctgtctctctcactggcagggatgcrgagtaaagacagacctgtgtatttttattaatctgggagggcttcctggaggaggcaaaactgggttctccaaaggccaggagagaacctgagccccacaggtgcctggcatttgggtgcrggtagacctgtgcactggaacacgcccctcacagcctcctccttttcctcccttaggggctgaggaagctgccctcgaaaccctccagaagacatctgtcctgcagaggccctaccactgcgaggcctgcgggaaggacttcctctttacacccacagaggtgctgcgccaccggaagcagcacgtgtgagctgggccaggagccctgcccacctccgtgcagctgacctgcyctccagcccaggactaggggcaggactcttgcctgaacccccagcctgggcttagccctgtggtccygtcccagtgcagagggcctggagcacggattgtgaataaagcckcacatgctgatacacactgttaggcctgcacctgcccatccagaaagcagcagctgccttgttagtcctccccagggtctagctttccttcttcctgctgcagggtgctgcctgaggggtcctgggtaggaggggckttagagccagcagggacctcccatgtctccagattccaggtgcaggttcttagcacctccgcagccgctctctcttgagtccatcctcagtctctcctwccccttgaagtagggggaccctgaatttgcccatccacctgggtcactttgagagttgtgcaggggggctgggagcactggtgttcacgtgggaccacaggctgcaccataagacccactcacaataaaaaaataaaaggccgagccgggcatggttgctcactcccgtaataaaaaaataaaagaacaggctgagccgggcatrgttgctcactcccgtaatcccagcactttgggaggctgaggcgggtggatcgcctgaggtcaggagttcgagaccagcctggccaacatagtgaaaccctgtctctactagaaatacaaaaacttagctgggtgtggtggtgggcatctttaatcccagctactggggaggctgaggcaggggaatcacttgaacctgggaggcagaggttgcaatgagctgagatcatgccattgcactccagcctgggcgacaagagtgaaactccatctcaaaaaaaaaaaaaaaaaaatcaggctgaggcaggtggtttgcctgagctcaggagtttgagaccagcctgggcaacacggtgaaaccccatctctattaaaatacaaaaaattagctgggcgtggcagcgtgtgcctgtaatcccagctattcaggaggctgagacaggagaattgctagaacccaggaggcggaggttgcttgtgagccgagatcgtgccactgcactccagcctgggtgacagagcgagactccatctctaaaagaaaaaaagaaaatgaaaagaacaataaaatcactcaggagaaaaagaaggcacggcataggaatggaaggaggacaacctgtaggtcctacagatgcgaaaaggagaagagaatacgataaacaacgtgccacacagaaattcactcatttgaaatggaaaaaattattgaaagacactarctacccaaagctcattcaggaagaaatagataaccggaacaactctattaaggaaatgtaattcatagttaacaaagagaacaggctcagatgggctccctggtgacgtctaccaaacatggaaatgatactcgcccacacccacttggccacagcataggggaggacgcctcctgactgatgttatgaggtcagcattatcctgctgctaaaagcaggctatgacaatgcaagaaaagaaaactctaagccttatgaacatagacaaaaaccctaaataggagttcagcacatcatatttagcaatatataaatacagtacatcatggccaactggggcttattctaggaatggaaggttgatttaacatttgaaaatcaatctgattcaccatattagaaacagaaaaaaaaaaaaaggttgggcatggtggttcatgcctgtaattccagcactttgggaggccsataagggtggatcagttgagtccaggagttccagactgggatggggaacatagcaagaccctgtctctattaaaaaacacaaaaattagccaggtgtggtggtgcacgcctatagtcccagctgctcgggaggctgaggtgggaagatcacttggtgtcagaaggcagacattgcagtgagctgagattgtgccactgcactccagcctgggcaacagagcaagaccccatctcaaagaaaaaaagtatataaacccctagtcttagtcagggagatggatttgagagtcatttcccatctccttggctgcacatctcattaaagccctcttccttggcaatactcgctttagtgattggctttctgtgcgaccagcagcaggacctggactgaacccctgatttttggtaacagattccattcaacagtttttttttttttttttttttttttttttttttgaggcagggtctcgttctgttgcccgggctggagtgcagtggtgcaatctcagcttactgcagcctccacctcctgggctcaagtgatcctcccaaatcagtctcccaagtacctgggattacaggcrtgtgccaccatgcccagctaatttttgggtgtgaataggtttttttgtttgttttttgtagagagtttcaccatgatgcccaggttggtctggaaccatgggcttcctttctttccaaggaagaaggctttaatcagatgcgtggctgaggagatgggaaatcagtctcaaatccgtctccctaactaaaactaggggtttatatactttttttctttgagatggggtcttgctctgttgcccaggctggagtgcagtggcacaatctcagctcactgcaatgtctgccttctgacaccaagtgatcttcccacctcagcctcccgagtagctgggactataagcgtgcaccaccacacctggctaaattttgtgtttggtgatctgcccacctcagcttcccaaaatgctgagattacaggtgtgagccactgcacccggctcattcaacagtatttatttaatttatttatttttgaggcggagtttcgctcttgttgctgaggctggagtgcaatggctcaatctcggctcactgcaacctccgcctcccgggttcaagtggttctcctgcctcagcctcccaagtacctgggattacaggcgagtgtcaccacacccagctaattttgtatttttagtagagacgggggtttctctatgttggtcaggctggtctygaactcccgacctcaggtgatctgcccgcctcagcctcctaaaaatgttgagattacaggcatgagccaccacgctcagcctcaacagtcttttaaaatgttcctcttgaaggctaacatgcacaaattataagtaaacagcttggtgaattttcccagatgaaacatacctgtgccagcagcacccagataaaaaaataaaacaccagcagccctccacccgctgcagcccagctcctccgtctcccaggagtgwccaatattytttttttttgagatggagttttgctcttgtcgcccaggctggagtgcaacggtgcaatctcggctccctgcaacctctgcttctgggattcaagcaattctcctgcctcagccttccgagtatgtgggattacaggcacccgccaccatgcccagctaattttgcatttttagtagagacgggttttcaccatgttggccaarttggtcttgaactactgacctcaggtgatcctcccgcctcagcctcccaaagtgctgggattacaggcgtgagccactgcacccggccgtgaccaacattcttaatctgtcctctagtgctggccactctaaaacttcacaagaatgtgctgtctgtgtctagcttcttttacccaacatgagsttgcatgggcttggttcattcattctgttccatgaattcatcacaatatatccattcttttgtccagggacatttggcttccagaaacctacccctaacaccagcccttccctccctctgcagaacaaaggccccatcagaggggacgtgctgggtgtcagcgtcagcttctgggaggaggaaggtcagagctaaggcctgaaggatgatgaggtatcargtgggtggaggggagacgctcaggaggtgggaaaggcggaggtgcacaggcttggttccaggtacaaataacgttactaggagcacacagtacctggattttgatgaatacattgtacatttctgtcctgtatgtatccagggttataggacgtgattataggacacgcatatatgtttggttttagtggactcttaaaaattgttttccaggggccgggcacagtggcttacgcctgtaatcccagcactttgggaggcctaggcgggcagatcacctgaggtcaggagttcaagatcagcctgaccaacatggagaaaccccgtctctattgggaggccgaggcgggaggatcacaaagtcaggagatcgagaccatcctggctaacacggtgaaaccccgtctctactaaaaatacaaaaaaattagctgggcgtggtggcgggcgcctgtagtcccagctactcgggaggctgaggcaggagaatggagtgaacccgggaggcagagcttgcagtgagccaagatcgtgccactgcactccagcctggttgacagagcaagactccgtctcaaaaaagaaaaaaaaaaaaaaaaagaaaacccgtctctactaaaaatacaaaatttagccaggcatggtggcgcatgcctgtaatcccagctactccagaggctgaggcaggagaattgcttgaacccgggaggcggaggttgtggtgagctgaggttgcggtgagctgagattgcgccattgcactccagcctgggcaacaagagcaaaactccgcctcaaaaaaaaaaagaaattgttttccaggccaggtgcagtagctcacacctgtaatcccagcactttaggaggctgaggcgggcggatcacgaggtcaggagtttgagatcagcctggccaacacggtgaaaccttgtctctatgaaaaattcaaaaattagccaggtgtggtggcgggcacctgtaatcccagctacttgggaggctgaggcaggagaatcgcttgaacccaggaggtggaggttgcagtgagccaagattgcactactgcactccagcattgatgacagatctagactccatctcaaaaaaaaaaaagaaaaaaaaaaagagttgtttacatattcctgaaacaagtcgtttgttagatatgcatattgtaaatattttctccaagtctatacttgccttttcatttcattatttctattttttgtagagacaggcagggtcttgctgtgttacccaggctggtctcaaactcctggcctcaagtgatccttccgcctcagcctcccaaaatgctgggattacaggtgtgaaacagtgcgcctgacccatctttatcattttcttaacagtatcttttgcagagcagaatttgtttttttgagacagggtctcactgtgttgcccaggctggaatgcagtggtgtgatcatggctcactgcagcctcgacctgcccgggctcaggtgatcctctcacctcagcctcctgagtagctgggactagacgcacatgctaccacacctggctaatttttgtttttttttgtagagatgaggttttgccatattgcccagcctggtcttgacttcctggggctcaagtgatcctctcaccttggcatcccaaagtgctgggattacaggcatgaactactgcacctgacccacgtttatcattttcttaacagtgtcttttgcggagcagaagttgttgttgttgttgttgttttgagatagggtctcactgtgttgcccaggctggagtgcagtggcataatcacagctcactgcagcctcagcctccttgggctcaggtgattctcccagttcagcctcctgagtagctgggactacaggcaggtgccaccacacccaactaatttttgtattttttgtagagatggcatctggccatgttgcccaggctggtctcgaactgggcttaagcaatcctcccacgttggccttccaaagtgctgggattacaggtgtgagttgctgctcctggacaagagaagttttgtattttgatggaatttcaaattatcattttcttttgtcatttctactttttctgttctacctaacaaatctttgcctaccctcaagatcatgaagttttttcttatgttttcttctagtttaatagttttagatttttaatataaaccgttaggtctrtggtccatttccagttaggcattgtgtatgatgtgagttaacgctcatggctcatttttctgcatatggatgtctaatggttccagaaccattttttgaaaaaagtattcatttccccattgaattaatttaatacctttactgaaaatcagtagactaggctgggcgcagtggctcacgccagtaatcccagcactttgggaggctgaagcgggcagatcacttgaggtcaggagttcaagaccagcctggccaacatggtgaaaccctgtctgtatgaaaaatccaaaaattagctgggtgtggtggcatgcgcctgtagtcccagctacttgggaggctgaggcgggaggatcgcttgaacctgggagcagaggttacagtgagctgagatcgcaccattgcactccagcctgggcgacagagcgaaactccgtctcagagtaaataaataagcaaaaattagcctggcatggtggtgggcacctgtaatcccagctactcaggaggctgaggcaggagaatcacttgaacttgggaggcagaggttgcagtgagctgagccgagatcacgccactgccctccagcctgggcaacacagtgagactctgtctcaaaaaaaaaaagagacagattctcgctttcgctttgtcatctggggtggagtgcaatagagcaatggctcaatctcagctcactgcaacctccacttcctggattcaagtgattctcatgctgcagcctccaaagtagctggaattacaggcaagcaccaccacgcccagctaattttttatttttattattttttatttttttattttttgtagggacaggttttcactctgttggccaggctggtctcaaactcctggcttcaagtgatctgcctgcctcagcctcccaaagtgttgggattacaggcgtgagctaccgcgcctggtcggttcttctttaatttagcaatatttcataattttcagaatacagatcttgcacaaacatagtgcaggcgcccaggccacagtttcccctcaccaggggccaaccattgctgaatcacagagagccctgtgggccgggagtaggcaaggagaatgttgtcatcctcattttgtatggctgctttatcatttgtaaaaggaagttaaggatcgttcccacctcacaagttgttgttgagagttgatgcattagtccacgtgcttagagcagggattggcacataaacggttctcagcaaacatcagctacagtgatcactaaggcaacaggaaaagtaaccaacatttgactgtcactcttcttctgtgacatcagagacaaatagggctacttcccaagtcagcaatatgggtataggttttctctcttacctgctgcacccaatgagtccgtaggccctgtccttcctccctccatcttctgctgtgtgtgtgtgcgcacgtgtgtttgagacagagtcttttactgtcacccaggatggagtgcagtagtgcaatctcggctcactgcaacctccgcctcccagattcaaacaattcttgtgcctcagcctcccaagtagctgagactacaggcatgcaccaccacgcctggctaaactttttgtatttttagtagaggtggggtttcactatgttggccaggctggtcttgaattcctgggctcaagcgatcctcccacctctgcctcccaaagtgctgggattacaggcgtgagccactgcacccagccatgttttgctgtttaccccctgccagttgctgtagcagccacacactgaccatccctggaaggtgacacatgctcattttggtgacaccctcatctccaaaatgcctggctctgtttcccaatatcctttctctttctcttttttttttttagatggagtcttgctctgtcatgcaggctggagtgcagtggcaccatctcagctcactgcaggctctgcctcctgggttcaaatgattgtcctgcctcagcctcctgagtagctgggattataaatgcccgccaccacgcctggctaatttttgtatttttagtagagacagggattcaccatgttggccaggctggtctcgaactcctgacctcaagtgatcctcccacctcggcctcccaaagtactgggattacaggcatgagccaccatgctgggccccaatatcctttatgcaccttcctgcagtccctggatgagcccctccctccctgtgctcctcccctcctcgccaccctctcgcctccactctgcctccctgtgtaccaaaaccccacagactggatgacttgaaacaacagatctctcacattcttgggggccagaaattggaagtcaaggtgttggctgggctgagctccctcgggaacctgccaggagtcttccctgcctctctctagcttctgtcacactgctggcagtccccttttatagaagggcatgtgtcatattggaccagagcccaccctatgacctcatctgaaaagaccctttttccaaataaggtcacatgcacaggcgctgggaagaggaattagcataccctctggcgggacacaattcaacccatcctaccccgtctaatccactggagggataaagcgctagcccgactctgtcccttctctgctcagagttcttccaggacaatgaaatatcattcagcaatgaaaaggaatgacaggctgggcgtggtgactcacgcctttaatcctagctctttgggaggctgaggcttaagcccaggagatcgagaccagcctggacaacatagtgagaccccatctctacaaaagatacaaaaaatagctgggcgtggtggtatatgcctgtagtcctagctatttgagaggctgaggtgggaagatcgcttgagcctgggtgatccaggttgcagtgagccgagatcacaccactgcactcagcctgggcaacggagcgagaccctgtctctaaaaaagaaacaaaacaaaaaatacacacaaaaaaatggaatgactgacagacactacagcagtgctgcagctggaagacatgctactgaaagaagccagtcacaaagggcagtgtagcgtgattccacttacgtgaaatgtccagaataggcaaacccatggagacagaaaggggattagtggttgccgaggactgggggccggcgatcactgttaggaggttcagagtttcttttggggatgttgaaaatattctagaattgattgtggtgacaggtgcacaaccctataaatacactaaaagccattgaactgtacgctttaaatgggtgaattttatgtatgaatcaggtctcaatgaagctgttaacaaaaagaactctatggctctccagcgccccctggagggatgcaggatcattgccttccctcaaggttccaccaggccggcctcccttccgcggctccctctatcctgtcagggcctgtgcacctccgccttccccatctcctgagcttctcccctccacccacatcacgcctcatcatccttcaggtcttagctcccaccttcctcctcccggaagccgaccctgacgcccagcatgtcccctctgatggggcctttgttctgcagagggaggggaggggctggtgttaggggtggattcctggaattctttttaaaaatgtattatctttagagatagagtctcattctgttgcccaggctggagtgcagtggcacaatcacagctcactgcagcctcgacctcctgggctcaagtgatcctcctgcctcagcctcccgagtagctgggaccacaggcctgcaccaccayatctggctaattgtttaaactttttgtagagacaggtctcactatgttgcccaggctagtctcgaactcctggccttaagagattctcccacctgggcctcccaatgtgttgggattactggcatgaaccaccgcccggccaagtcatagcactctggtggctgctctgactctgctgtccaagcggtaaccacccaccttgcctttggtcattaagttctgtcacttggtccctgccaccctgagatccaattatccccattggagtcaggctttccgattcttgctctgtccacccaggctggagtgcagtggcgtaatctcagctcactgcaacctccgcctcccaggttcaagcaattctcctgcctcagcctcctgagtagccagggattacaggcacccgccaccacacccagctaattgttttgtatttttagtagagatggggtttcatcttgttggccaggctggtctcgaacccctgacctcagtgatccgcctgccttggcctcccaaagtgcagagattacaggcgagagccaccgtgcccaccataatttttgtat

SEQ ID NO: 12210 - DNA, 16509 bp, Homo sapiens
agcggaaagacccaccaaggccaaactccgagatctacatttggaattttccccctttgattagttaaagacataaaaggtcaaattatcaatatttaatttgagtgaaatgcatttgttataaaggaaagaagacattttatttaaagaaggtgagactccagggatgaattctttaatcaaaaatgattatatttctcattacagtgaagtgtgaataatacttgataaggattctgtttactaataataatgatgttttgaaaattacatcaataagtgtgtggtgggggagggggatatggtgtatatatttctcagatgttcaaagtaccaaaggagctttctcttctcagttatgtctttactagacttttccagtatatgctggataagttatgactactcattatgyaatattttagatctggcatgatttagctaattgtgtggctcactgaatctgagtgaataatgccatttaacttctgttggcttattttttcatgaatttaccagaaattgtttacagtatgaaataactgaaatgttgataaagtggtggtgaaaaagattttatattttcaataaaacttatactccataaaacacaagcaaaatcaaaaacatttttagagatattttattatttctatggacagtaaacaagaaattcattttggttttgaagctgtgtggcaaataagtgcaaatattggaataatgactatctttttgaaagctattcaatttatgatttctgtctttgtttcagactagccagctcaaattatagtttaagctctttccttgcccctaaatctggctacctagttttataggaaacttactgtgaatatgtgcctaattagatgcagacttacaggtctctttgactaaaagctcagtcatggcgccccatgttttttgtttgtttgtttttgtttttgaaacaaagcaaacagggaagagtggaaaggaggaagggaaagaaaggaggaagaaggggagggaggaaaggaaggaaaggaggaggaaggggagggagggaaggcaggaaggaaaggaggaagggaggaaggaaaggaggaagcaagggaggaagagagatttttgctgaatctagtaggccgaaggtcagggccgttggagtgggaattgtccacggtgctgataggttgaggaagtcattccttccacaattcgcctggggccctaaacctggtttgcccgcgttcctcccgtgcctttaggaacttgtccgggtcctctctcccaacccactgcagcaaccattgttcttgcgacgctccggcgccgtcggtgtgtctcggctctccactcctgaagctacacacagctaccgaggatttttgtttgcttgcttctttctattaaggcaaaggttggcaaatagcgtgtgcttgtcagttccctggccctgcgatcccctttggacagcaagctgttcctcgatccccgggaaacaggtgtgcgccctctgctcacgctcctcacccgaaagcaggtgcgaccgtggacatacacttaacactctcacacccatccacttatgcccactttcacatacacattcacattcattgacacacacctgcacacactcatatgttcacatacacactaacaatcacacactcattatatgcacacacgatttgcacacacattcacataatcttgcacacacacggattcacacacgtacattcaagtgcaatcacacacttttgcacacacagggcatcggacgcacgaggccttgagcaattgtgcccgtgacctacgactgccaagatactcctactgagttgattttacgttgttgattctgagtgttggatggtttaaggaaagcccctggatcctgacagggaatcagagacaagtccttccaaggcctgtgggagccgacaaaggagccaccaaagccccgtcgggaccgggagggcataaataataaataaaaaggcccaggcaggccgagctggggaagcccggcactaaatcactccctaaatcacagtcgcgtcgtgctccatccaatagctctaagcgatttgtggggttgggggttgaaatcaattttttccgttctcgcaggtgcaatatgaatcaattatcttaattaagattatgccgcaagcccaggagatttggggaggatgggttttgcgctcggggcgacggcgaggcattttaatagcgtctctcgttgctcttggctctcccgggtcgcctgcctgtcgagcctgggcagctccagcctcaggccaggacccgggagcccaactgcctcccccggggcggaggcgccgcgtcggcggtctggtcagaaccsgcatcaaccccccttcatcccccgaagctctcaagagcctccgagctacccagcctgtgcaggacctgcagctctcagccctccgttcctgcggcccctgagccccacggtctcgcgggcccctcagccacccggccccctcactccgctctcccgcgcccaggccccgacaccccactcctaggcagggcggggagaggacgcgggaacctctcgaggtcggccgggctgccctggccacacttgatcctttcattgaacgcaaacctccctttgcaagagcgagcatctgtttccctgagaaacaggtcaccgccagggacgccggcccggcccctgctctttatcttggccctgtgaatgcttcgcccccgacctcccgctccccgctttcgcctccagccacacgcttcccaccccctacgtccgggccacacgcctccatcccttccccacccccatcctcccacatgcctcccccttcccctccgcccggcccaggccacactcccctctccccacccctggccacacgcctcctcccgccccccttcccgcgggcgctccggctgccgctgtaacggccgggacgcccggcccgcgccgcgcgctcagagcggggacccgggaggcggcagatttggggcattgctcgagggcagtgagtcatgaaagaggcttttgttgtccgcgcgtgcggttcgcgtgccgctgggtagcctgcagcgcccagtagggacgggagctgggggagtacagctaacgggcagcgaggggagagacaaaaaacttagggaatcaggagggggaaaagtgtgcaaccgtccaaacaagtccaaagagaagaaaataaggaggaggagcggggccgcggagaaggtcctcagtgctaagccccgccgcgccttcagctctgtcctctccgggatccggctgactctcttctctcgccccaatttctcgcgccttcaaccccaaacaaaacgcacctcaatccaggccgtgtccaggctcctctttttagggccttactaccccgcatctcctgggagcctcgcgggcactggctgagcgtcgcgatgccggcgccccgggtcgaaattttccgcgcagaggagggtcacatcggagcgctgcgggatgggaagcccaaggacagctaccgtgagacccaacctcagccctgtctctgaaacatcctggagtggcctttcctttgtacaaatctccaggcctgagcgaacaacgcgcagtgggattagagatgaatttatcaagggtagagggaggaaacagactagtaattcccgcactttacgcatttgagtctccgtctggcaaaacactcgggcgtccctcttgctcaagaacatctgactccaccataattctcctgtattgcacaggatgtcgcgaactggaggtttctgctttctgggggtgaggacaaggatttagcagagggacctctaggctacccctgacctcgaagctagctggagtcctttctcccactccgtccccagttctcctccggaactccccaaagttggaaaaatgagagcctaggcacgagttgcatatgcctgcggcatagtgtgctgccagtcggggcagctgccgggtgaggggcagtacttaacctggccctgccgcaaacgtcgggctgtgtactatcttctaagggctagtactccgacgccctcgagttttagcccaacactgaagatacagacagtacaggggtaaatcctgggcccaggctcctgggtgaattattttatcctcccctatgcgctttgtcagccaagtgaatgtagaaaagcaagcaaaactccagaaccccacaacgattcacgccacgcttcggtggcacaactcttttcttccccttttagattagtactgtgcagggaaggctgcacctgctaccttcagacaccggggatctggctaggaccctcttcctctacccctactctctcctcccgtccccaccctctcccagatgcaccccaatccagcctctcaaccctgtcgctgtttgcaaactcgagggatgtttagtgcaattgcctttaaataagcaattcacgtaagaggtatttattgcagagggtttcaggtctgggagggggtaaggagttagttaatgaaggattagaggcaaagctgggaaagaacgagtagacaggccagtttctttctttctttttaaaatctattattctggaaaacccttgttcgaaaagagtaaagaattgctatttgggcaacaatatggctccttcagaactggtcgagaatttctgtggtctttgcttgaccttcaagttgggagtttcaaatcagaggctttgaagtctggaggagttcgcagccattaatccttccggggttgtgctaaaggcgtttctagaaagagatcggaaagacccgttcagcacaggcccattgcatcttctctttgaaaacgcttgtctgaatcaagtatcttatacagacccgagactgaggggagcaagagcgcaggtccggctgtggcgaggtgtccaccaccgtacttgtggtcaatgcctggactagagagccgaggccgtccagggcgggctggccagggaaccagaagcgtccctggactggctgagtgagggtgccctttccagcaacccagtggccatggttaaaaggcagaatacaaccgtcaaagaagtccccagctcccacataagagagcgcaaaggccaatggaaccaaggcctcctcgcgagaactagctcgctttgaggacaagatcctggggatggaggtggggactgacgtagtgagagggtctggaggaacagtcgtagctgaaggtcaggacatgaagaattgcacgtatggtagggatagaatggcaggtacaacttttctgtactgaaggaactgggagaggacgatccggttagggaggttggggaactaatctcaacgctgcgtttacagatgaagccgcttttatatggcgtatatgtttgcttagaggggccgacggagattaggagaagccatcctttggcgccaatgatcaaagcgtctgccaaggagaagaagccaagggatgggcctttcagagagggcaaggagtcatgctgctctggatgccagtgtcaggacaagaaatcgaaaggagcgaggactcttcactgcgtgcctcagtctccccgcttctgcctctttcacctctgtcctacttccggcgcgaaagcaggccactcgctctgatctagacctagttaacattagcttttcccttccttccctcaaatcccctcccccctctatccccgtcccttctgccgcctgaaagggttaatctctcctgcgggtaaaaacaggtccgcggagtctctaactggcgacagatgggccactttcttctggccacaaaggggccggaatggagcgctccgcggcatacaaatgggcaggtcacgtggttccaggctcttggctggaccgggaagaccatatggcgcatgccggggaggaaggaggaggggcgggggtaggggtggagggtgaggggagcggttgtcggaggagggcgggagacgagcaaggcgtggggagaagtggggaggaggggagaacggggagcgcacagcctggacgcgtgcgcaggcgtcaggcgcatagacctgctagcccctcagctagcggccccgcccgcgcttagcatcactaactgggctatataacctgagcgcccgcgcggccacgacacgaggaattcgcccacgcaggaggcrcggcgtccggaggccccagggttatgagactatcactgctcaggacctactaacaacaaaggtaattacagttctttcatttttttgccccagaatagaagcaataactgaagactgatgaacctacatattctgtatgtgtgcgtttgcgagagtgtgtatgtgtattgagaccagcatccccctccataattgcccataagtactcacacataatgagtcgtgtcactcaagtacccccygcaggctttctaatttaaattttaaaaatttgggtttcttttgtggatagcataggagcttcttggattttttaaaagaatgcacgrtaactatgattatctgctagtgctgattttaaagtcccaaargsaataatgacttcactttctcacttcttacagtaagaaaaaaaaatctatgttatcaatatatattttgtgtgcatgtattttacgcacattgggagtgtcaagctgtgttttcagtgaatgaaagggacatggataccttgagtattcacaccatggaaaataaatcaggttcagagatagtttagttgagaggggggaaagtggagaaagggagagggactcactcctgctacctgttaccgctccagaggcggccaagtccccagcagccactactggagccagaaattcagttgttttactaaaggctttttattttccttactagaarcggcaacttcgcggttgccaatcgctgaccattataattactcaatcttttaaagggaggtttgaggcgaactttgaaaagccccaataaagagcgggcggccctttcaatgggctgtttattagagaggagccttccgcacctgatcccyggcgcgtgggagagcgctctgcgccgcgcccccagccctcgccctgcasstagcgcttttgtacaaggtggaaatttagcggtgggccagagatggaaggcaagaaaagaaaggcgagggaggggtggaagaccctgtccacttttgttgccaaatgttacattgatggtgaaacaatttggtggaaactatttttcctcctttctgcatttgcttttcagtatcccgtcgatgtaatcttcttaaaaatcgctgccagtattagtaaattacgcaatggctgttcaacttaaatcgctaagtatctggaagccaggacagaaatggaagtagaatgtgtgattttacagcttttttttttttttatggagttgtgagtaactttgaacacatttggataaacatgaagtcgctgaaatgtacagycatttccacacacattatcctgtcgggcaaccaccataaacacatttaagttaatcactaggatacaaacacatatgcgtgagtggtgtacacatatacatattcactaccctcccccagtcctgtcctcactcctacgtactagcggggcacacgcacgcgccattataaaacactgcatttaactttttctcagaggcattcattttgtaatgggcaggtacttttcgcaagcatttgtacaggtttagggagtggaagctgaaggcgtatctggcttttgaatatagcgtttttctgcttttctttctgtttgcctctcccttgttgaatgtaggaaatcgaaacatgaccaaatcgtacagcgagagtgggctgatgggcgagcctcagccccaaggtcctccaagctggacagacgagtgtctcagttctcaggacgaggagcacgaggcagacaagaaggaggacgacctcgaarccatgaacgcagaggaggactcactgaggaacgggggagaggaggaggacgaagatgaggacctggaagaggaggaagaagaggaagaggaggatgacgatcaaaagcccaagagacgcggccccaaaaagaagaagatgactaaggctcgcctggagcgttttaaattgagacgcatgaaggctaacgcccggragckgaaccgcatgcacggactgaacgcggcgctagacaacctgcgcaaggtggtgccttgctattctaagacgcagaagctgtccaaaatcgagactctgcgcttggccaagaactacatctgggctctgtcggagatcctgcgctcaggcaaaagcccagacctggtctccttcgttcagacgctttgcaagggcttatcccaacccaccaccaacctggttgcgggctgcctgcaactcaatcctcggacttttctgcmtgagcagaaccaggacatgcccccccacctgccgacggccagcgcttccttccctgtacacccctactcctaccagtcgcctgggctgcccagtccgccttacggtaccatggacagctcccatgtcttccacgttaagcctccgccgcacgcctacagcgcagcgctggagcccttctttgaaagccctctgactgattgcaccagcccttcctttgatggacccctcagcccgccgctcagcatcaatggcaacttctctttcaaacacgaaccgtccgccgagtttgagaaaaattatgcctttaccatgcactatcctgcagcgacactggcaggggcccaaagccacggatcaatcttctcaggcaccgctgcccctcgctgcgagatccccatagacaatattatgtccttcgatagccattcacatcatgagcgagtcatgagtgcccagctcaatgccatatttcatgattagaggcacgccagtttcaccatttccgggaaacgaacccactgtgcttacagtgactgtcgtgtttacaaaaggcagccctttgggtactactgctgcaaagtgcaaatactccaagcttcaagtgatatatgtatttattgtcattactgcctttggaagaaacaggggatcaaagttcctgttcaccttatgtattattttctatagctcttctatttaaaaaataaaaaaatacagtaaagtttaaaaaatacaccacgaatttggtgtggctgtattcagatcgtattaattatctgatcgggataacaaaatcmcaagcaataattaggatytatgcaatttttaaactagtaatgggccaattaaaatatatataaatatatatttttcaaccagcattttactacttgttacctttcccatgctgaattattttgttgtgattttgtacagaatttttaatgactttttataatgtggatttcctattttaaaaccatgcagcttcatcaatttttatacatatcagaaaagtagaattatatytaatttatacaaaataatttaactaatttaaaccagcagaaaagtgcttagaaagttattgtgttgccttagcacttctttcctctccaattgtaaaaaaaaaaaaaaaaaaaaaaaaaaaaaaaaattgcacaatttgagcaattcatttcactttaaagtctttccgtctccctaaaataaaaaccagaatcataattttcaagagaagaaaaaattaagagatacattccctatcaaaacatatcaattcaacacattacttgcacaagcttgtatatacatattataaataaatgccaacatacccttctttaaatcaaaagctgcttgactatcacatacaatttgcactgttactttttagtcttttactcctttgcattccatgattttacagagaatctgaagctattgatgtttccagaaaatataaatgcatgattttatacatagtcacaaaaatggtggtttgtcatatattcatgtaataaatctgagcctaaatctaatcaggttgttaatgttgggatttatatctatagtagtcaattagtacagtagcttaaataaattcaaaccatttaattcataattagaacaatagctattgcatgtaaaatgcagtccagaataagtgctgtttgagatgtgatgctggtaccactggaatcgatctgtactgtaattttgtttgtaatcctgtatattatggtgtaatgcacaatttagaaaacattcatccagttgcaataaaatagtattgaaagtgagagcaattgttgcatttcttcttaaagggattctgtttttatttttggggaaagtagttgcttttttgctgagttaaaaaatactaaacactatatgtagaataaaagaaaagaaaaaagtttaccttggcatatgctcttgtctgtttatcttgcacagggagtcaccagttctatgtagataatgaaaagacctaactgatatttcattatttggaatatgggactggacggcagtacaaacagtgtgtttttttctttgttttaagtggcttagcctttaggttttttatttccatttttaaaaatgattgttacatgttttcttctatttctttttttaaaaggtggattttaataattattaacaagcaagacataaacaagtatcctagcttagtttgtctatacatttaagatgtataaaacattactattttcttggtcttctgttatctgtacatttttctgaactaaacagttttatcttgcaaactagtactgtcccagaaaaatttatacacctttaggaagtaccaaagggaaatgagttaattaatttaaagaatccaagagaagtaacattttataattgttctattaacatcttgtgatgatttccatcatttttccaagaaaaagcataatggattatttgtactgaagaacacactatttgtactgtatttaggaaggtgtaattatttcctccccccaccctttggggcactattctgttgtttcatgaacacaactcactggaaaaacttatggatgattctgtctattgttaagtccacttcaaaaaaaaaaaaacagtttggcatttcttttcctctggatgtattgactgacagtcatgattcctagggaatatcattttggcacttgtgccctggctctactgtggtgctctgattactgtcattagtaactccattgtttctactctgattcgggtgccacattggatgactaccccccttcccaagcttgttcctttaatctccttctcattggtgatttaggggttccagaaagctgacctcatttagcaagctgctccagaaaaatgtgagtaatgtaatggacaggaacaattagccatactaataacattgccaatgaggctgcgtcaagctgtgacagaagcagtaaggaatacttcgacgttaaaaaaatgtttgagagcaatttaaaatatattattttaacatgttttctatcagccttcatcacatgacagaaatacttttaagttagtcccaactttatctaaaatgcagcaatctcattccaagtgaatcagagttgttattttggaatcaagctgttgctttctatatcctggattgttctcactgttcttactttaagagacataatactgatatgatacttgaatactaccagccttccagtgtaggaggtaatgaagtgagcattcagatctgatctaacctattaagtagctcaatttcacctgcaattaaaattagacatcttcatgcaaactaaaatctgttgctgtagtgaagagaagaaataaaagaatgccattttgagaattccagcttccaaaatagcaaacagggaaatctagactgtgttcttttgtaaggtagaaatgaagactaaaagttaggttttttttttttttcttcccattttgccaatacaacttcattctaaaacatagggattctttcagtcagtcaaggagtaactcacatgccaccatcttttattcaaaggcaggcacagatgttccttctgcaggggaggatttaatttatgaaaatgatattgtttatgcatgaatgaactgcatgcactctgcataacacatagcacttccatctgaycagagaaataccacagaaccagtgccaatgtcagaaacatattctacaaatttactcacttaaatgtttaatgaatatttggaaggcattttcaaaccataaraaacattttaaattatcttcttttatgrattcctacccatatttaaaagagactcttacagtttttgtaattggctaatgcttatacccagtttgtaagaaaagaacatattttactaaatgaaaaccaaccaaaaaaaaatgctggcaagtttggcttcactggaaaaaatatttcgtttagttttgctgtttaatgcttgtcatgaataatatttgggattctatctgtttcttcatcttgagccacgactattcctatcaaataagatgcttaggtatacttgtttaatgtgaaaatcctatgaatagttatttctagaaaaagctggtatgtaaaatcagggggaaatttcataaagatgaaattgggctaaatattgtaacatgcataattactattgaataggaacacttcacataacatattttactttatataaccaattgcagctatatagtatgatctatctacttttaatcattaaaacaattatatataaattaaaatgaaagattataatatcaagagtgttctactaattttaggtttataatatgttacagtaaaataccatttgaaataaattttgtgttctaatttatcttaaaatctctctgtttttacatttgaaagtccttacattcttacaaaattaatgcattttctgaaagaagctagcaattactaaaatgatatatggatcattagctaacagtttgaatcaagctgttttagttctataattatacaagaaatttaaagtgaaaatacctattaagcaattaataaaactaggtttcaaaatattggctaattttctcctaatgggaaatgtaaaatagcaaaactgcttcttaaactacacaaaaacctcctcacttctccttttctctctctctaacaccacttatttcctgaaaatcatctaaataaaatatttaattccagggtctgatgaagaataaaagagccaatgcaacatcttgtggaacaccaggactgagaactcttgttgttaccattgcaaagaggcgttctggcgtcagatgcacagtgatttgtatggtggcataatcattggctcctggccaggcattatgtttcagaggacactattgtcaagaaccattcaactagaaatctgcactgtatgcactcaaaagttgagatcatctgccttcctatgacaggaagaattctgtgctggcaattgactcatggactctcttcacatacactaaggcttggtccagtggctctgatggaattaactgtgcagccaaactagtggcattgacaagacagggccacagtctctggggacttcaggagaaattgctaattttaaaatgcagagtattatgttaatgctggattaaatcttcagatacattaaatgtggatttggccatctaagcattattatgttatttgcccagttaatttagaggtagatggatggtgacaataaccatctctacagatccacaattctaagagatggatccaattgtgaaatgatatggagagatagagtaagttcaatctagcatatatgaagtaatttggtaactgacttttcttttaacaagatcaaaagctaacctgctttacactttcatgtctaaggacagccaaccagagagatggcttcacacactagcccactgctaagtgcttttcattcactttcatatttcatcatcaaagcaccctcctgccttatttatagatggggaaacttcaggaagttgagatacctagatatttgcattcctgtcttcctttcttcattcaggtttttctttcattgccacttcctcaaagaagcttttactgattcccatttaaaatagcaactgacttcaactccaccaaaatcactgtattgcccctccctctttccagagcatttgcctatcaaatgttatcttatgtatttacttgtatagcttaattttaaactatctatctctaggtcttctgagcacctgagaaacagagacaaagttgtctcttctgtgtgttgctgttcctctggtgcttagaagacctagaggatcctcaataaatattaactttccaagggaactgaagagcactaatgtgatgctaaagcctgttgccttaaccactatgctataagtcaaatcagttgagaatggagaggaccacaaattattttcagtccagcaagtgttataaacattaattctataaaaagaaaacaattgaaactaatttcttattatattgcatggcaccaaactcyccccacttcctttttgaggatcatgagttgtctgtcattgtttctttttattgatatcaattggttaaatataatctggaattggaataaaagaaaaactattataggctttttccagaccatgtatttcaatgcatattattttttcctttctgttcattattctttcagtaattgcacttgttctatttttagtgttatgtaaaattactgtagctcataatttctattttgaagggttcagtgtataaacttagcacatcaatactatctttttagtgttcgcgctcaatggtgtcagttaagagatcaccatcacttttggtgacgtcaatgaaggggtattgcaatgcttaagagaactgttaatccctttccactggtgtcactaacaattgtagtgcttgtttattcatagcaggtacgtgactaagtaatgttaacatcaaagcagaaagaggataatagagtgttctaaaaagaaaattcggtggttgggtgcagtggctcacacctgtaatcccagcacttttgagaggccaatgggggtggatagtttgagcctaggagttcaagaccagtctgggcaatatggtgaaacctcgtgtctacaaaaaatacaaaaactagtggtgcatgatggcatgcatctatagtcccagctactcgggaggctcaggtgggaggatcacctgagcctggggaggtcaaggctgcagtgagacgtgattgtaccactgtactccagcctgggtgacaaagtgagaccctgtctcaaaaaaaaaatgatttgagataacatcacttgtcattgtttgttaactgaataatctttattctagccagtgcctaaatacataataaatgatagtacaaatggatataaattataactaaacctaagtagtgatatttatcacaatatttctttactagaagaatttctttgttaatagaggcaaggctacttgtttagataccttaaaataacataagatttttggataaataaattaatgattctttgattctgactggcatattaaaaatattaagcgaagagatctttgcttcccaggttttattttttgtctaattaactactggtgcatttatattaaaacatattgtcaagggaaaacatatatatatatatgtgtatatatggtgtgtgtgtgtgtgtgtgtgtgtgtgtgtgcacacatatgctatacttggttgagtagtatccccttcccttgcccacctctctcccaaatttatgtccatccagaacctcaaaatgtggcctcatttgaaatattgtctttccagatttaattaagatataagatgtaaattgatacaagttcatgctggattacggtgggccctaaatccaatcactgatgtcctgataagaagcagacagaacacacagacacacagcatacaggaagaatggcatgtgaaggcaaagacagagactggagtgatgtgtctacaaatcaaggggccccaaggatttggggcccacatcagaagctgggaaagagacaggaattctcagcttctccttctgaatccctaagaaggaatcaaccctgctgacaccttgattttaaacttcttgtctccagaactgtaatataatacatttctgttgtcttaagctacccagttgctggtgatttgttatggcagccctaggaaactgataggtatactaaaatctctaatgaattgatgttaaatatatataagtataggagagttcatttaaattcttctgaaaatgtcttcttaaacttttaatgatacagtatataacaaccagtatacgtagttggtatcgggtttgacatttaaacaagctgacaaaaaacagctgtttaataaacatctgaattatataaaagttttattgtttattattcatgtgaatgacttaaactgacatctacatttagtgaagtgtgaatgggcctagccaataaactatgggtaatttttttaaagtctcatctttgaactcacaaaaaattatcaaatatcagctattatgtattcttcatgtgaagaaaatgtcatatttatttgatttgtgg

SEQ ID NO: 12211 - DNA, 88457 bp, Homo sapiens
ccctgggcacagcatttgtacccatgaaaagcacgtgcaccagttatgagaaatgcacagggctgtcccaccaagctcccaccgcttggccctggtgagagctcattagactttattttggatttctcctagaccagatctgttatgactgacaggctaaaaagacccacctcatcctcaaaacagggttttctcagcccttgctaggcacaggtgccctgggagaaccccccctagtggtccagtcagctgtttcccacccacatttccaggaggagcacctgtggaaaggcagactccaccccttccctgcacatctcctccagaccatggttggcagatgggcattggcctttgctagaactgtacttcctgtctcataatctctaaatcttcatgaagctacactttccaccccactcttcctttgttcagcaacactgaggtccttgccaggtaccctgttcttcataggagcacccactttccagcccaaagaaatgaaagttgctgcccatgaggtgctggtggacaccatctggatggtccacgaggtactctccttctctcaccacacatgcatcacctggcagtcctaagatctaggatagtccagggaccattccattccagctcactgtgctgaaactagtagacacatggaggtttgcagaaatattaggagtgaggacttgttaaaaggctgcacatttcgttgaagcctttgctgcctccagccccagcctccaggttctctccactcctggtggtgcccagcccagcattgttgggaccctgaagctcacaaggagacctcagtcccaccacagctcagaagacattcctccacctttctgagggcaggtttgaccccacagccttagttccacccttgtggggtrcatccaacatggagctgcctggttccaaatatccgatgatagctgatatttgtgctaatggggacccactggtgaacacaggaagatgccatcaggaatctccagaatgtgaaacgtggtgaacctgtagagagtcgttctttttcagtccagcagttggggctcaaagggaagctaagactcagaggagccctgtgacagagcaggagcaccatcatcttggacaaacaccacaattttaagttcaccttaattaaaaagccccctaaatccagcccaaaaacatcagcctaatggctaatgtcagcataaccagaaacattccaaccctaagataagccacccccctccaaccagaaacatgccaaccctgagacaacctcccctcccaccagagacattccaaccccacaataaaccttctctcacatggaaacattcccagcctgctataagctccccacttcctaaacccttagatacccttagtcagtaagagaaaatgctcctgaccaaaactgaccagaatcccctctcaggtttattctccaaaataaacctgtctttaactgttgagccacttttcatgtttctttcccctttctttaactcttacaccctgagggtaaaggaaggtgaagctctttcccctcattcagggagactgggtttggggtgggggacattgccacacttgtctggatgaaacgcactacatgaaacctcatgtcttctaattcactccataccacccgcttttgccatttgcccactatttttgaatgttttcaactgctcagcatcgagtcacatcagcgtgccctgcaaggactgcaggagtgtcctgcagggcctcaaggtgcggggcaagcttgagggcttcagccttgggggaggtccagaaggcagggccaccttggggttccagaaggaaagaagttctcagggaagaggacagggaccaggaggagtgaagggcagagtcccccgcccctcacgggctgaacagagggcaggcggtgccctggtgatgctcgtgagctgctggatggcaaaatgatctcagaatccagtccttacatgggttcgactttatttagaaggaactatggcacttctaccacacatttcgaagtgtttggtgagctataatccccagtagaggacgattttcagctttatttccacccagcccttaggaggctgcagtgccctgcgtcgccaggagagggggtgcaggcccagttgggggcggagcctggaggagcacggggtggccgcttggacgggaacacgggaggctgacatggggaatggcggtcactggccccttgctcgctgcgcatgctcacagtgtgtctgtggcaggccttgctggctggatggccttgggaaggaggcatgaggtggcttccatgggccaccaggagcctgtggtgctcgtcagcaccatgggacagggatctgtgcatgtccagctgcagatacaacaggggctcagctgaaggaccctgtgtgatgatgcggactcaggggtggccctgggccagtctctttcctcctggtgctgcacaaggactgagggcatcctcggggtttctcatgaatggtccccaccttcagaaggtggccrgagggacttcctgtgttgttcaatgctccccttgtctttctgactccctacaatccttcacccatagcctcttcctccgcgccagggtacttcttcccattcgcccattttccaacgattcacccccttccaacagcaataattacatttccacctccaacaatcccactggcatcttacagtgttgcaggtttgggagcccagtcactgaggctgtgctgagcaggggaccctggtgagtgggccagggaggatcagaccagcctggtctcacccaacttcctaaaagctgaaatattgccaccaaatgcccgctgagcccaggggataattgcatcacaatcatgcagttgcaaggaactatgatcccagcctctacccatctggggcacagatagaagagaacctgagaagagagatgtgtacccatgtgcttgaaatctttaagatataggcaaaatgaagaaacagatggggatcaaaataccagctttattcctgataagaactggattaggaatgtggcttagacatgtggcagtaaagggacccctaacactaaaccccagaactggcttatccccatggcatcgaaccctccctcatgccatgcaggcccctgtccttgtgcacttgagcttggaggggccaacagagtcttggtctctgcaggcaggatgactccagggacacccagcaaggagcaggctcactcccactcctagagaagagtcccctagaagagaagagtcccctagaagatgggtggggaccaagccttgattgattgatgttccacctcctagaaggagacagtttggcaggactggctgctcccactaaagatcccaggcgcctactcttcactcgtcacttctacgtcccttggaggctggccaggttctctattctcatgccccagtggcactgttgctgcagctgcctcctgccctgaaactctctggtccataacgccaatgacctcatctcagggatagacctctgggttcccacatgggggtcccaggttcaagaatcacagcccctccccacccctcgccactgaagtctgaactgaagctgcttttggtgaagctcacgaaggcccatcacctggatgggtgccctgcctgtggttcttcctcaatcactgcctctcctgcttctgagttttccaggctccagtaactggaactacttctgtgacagcaaaaacattccctgttgcctgtactccttgcagccatagaaaatgctccaggagttccattatttccttctaaacaatccagcaggatttttagaacttcatactacttcttaatttggtcctgtccctttcccaacccaggtgtgtctgatgtattccagatcaaagaaactttgcttttcccacagaagcctagagattctccattaactggcattgcttttgcagagtgtggtgtgtgctcagctttttccaaccctgtctgacaagaacatctccttccctgctgtcaggagctgccctagcaagggcatgtccacctgtaaaggtcaacacttgcagatttccagccagctcattggtctggaattccagcccctaagcacacccagagaaaagctggtacatatgtcagtgccactcagtggcctgggcctgcttgctgcccaagagcagtgagaggggtgagtgcagacgccagagccgactggtgtggtccgcgccaggccttgtcagtgctgctgtgctccatggagactgggatcagaggacaactgtgcccaacagatgctcagcttaccagccactgtgcctccataaaactggggagtcatgggggagcgagcaagagaaagagagagagagacctacaggtgtgcagtacctgatagaaacagtgacctcgcccactggaaaagctgtcctcaccagtgtcttggcacctgcttattaactcattttggggaaagcagggcaccagtagaatcagggtagaaaccccccaccctcgtattttcaaatgtacctgaacaagcattcacagcttccaactattgtgcaataaacagcaaaaaaaaaaaaagtccttgaaccaaaattgtccttagctgctctgccctctaagakggggcatagtttacatgggagttgggggargactccatgtttgccccttccccttgctgagatggctgggggtgggggctggaaaaagttggattcagcagaatgtaatttggaaaacatggctctggagcaccatcccctctggcccctgaatcctcaccagcttccaccctctgctcaccttgggccctggattccagcgcccccaggctcccagctgcctccctgtctctgccccatggtccagcctggagttctggtccctggttgtgtcctgtggccccattctcatgcgccctttgcttctatttctttacctatgactttatactgatgtaaagcgagtcttctcggtcgcttcttgttctctgaggaatgttgaatcagaatctaaatggaaaatctgggaagagatagaacctcccgcgggagccaccctgcccttccatgtctagatcatctgggttccaacctccatcctcctccaatgagaagcttttgttctctcaagattccagtgacttctccgaagctctcttcatccctggctgttccaaggtggccccatagtcaagattccttaaacccttgccccttaaaatgtttgcctttcttaccatgctggctccagcctctggtcccaggggtgtggagagttctctcttacttctggctgatttccaggaaggctaagaacactctccccaggttataatgctgagcattttggttctctccagccctgggtccccatgtcaggacctaccttagtccagtccatgctctcccatgggcctgagagaagatttgaagtttctggctttccctccaaccctccaactctcacccccagccatttcagcaaggggaaggggcaaacatggagttttccccccaactcccatgtaaactatgccccctcttaagagggcagagcagctaaggactattttggttcaaggacattttttttttttttgctgtccattgcacaagcaagtggactcccggaagccagccctgctcgtcctctgggccctcctttccctggtcctgcaggtcttgctgcttgtcaggcctctcctccaaccgtctgccacatttcagaaaagctgagaaccccttggagtgaaaaaggaggagaaacacggtgtctgtatcccagcaggaagttaaataaatactttcacttttcttttccccatttgggcagaaatctgtgagggtgagtcagtctgtcggccgacttcctgctccgggtcagggcagccacactgcacgcaggctgggccgactggggagctcataggccaggctctgacacccaggcagggcctagggtgggacgatggcaggtgggggcagcgacctgagcaccaggtgagtctttatctctcttcctttcacctttatctctggcagtattggagctttcatgcctgtagttcagtttctgtctaaagcttcagtttagtcctgctttgcaagaacataggtaggtagtgtaatataatggaataaaagagaatgtaataaggaaatcagatttttacaactgcagcaggacagctgtttgtgtgagtccagcttgccataacacagatgacttttcttgttttgaaactactgctcagctggcggggacactctgaacagtcgtttcagtcatttgtgactgagagttattatttcctcatgagaatgaggaacacaaattatatgtttgtgtttcaacaaacatttcctcatgatctcccaaccctttcacatccctctgccctctctaccttcacatatgtcatgtcaaagaaggtagtttggaaatagacactccagggtaaacagctggcttacttttaaacattggaaactgtggtttcacctgtcttggcaaggggcctcagtcagctttggggctatttccttgactgactcagggtgtgagttctgatacaattgaccttgatccaaagaaggaaaaagaagaaaaaggcccaggatggcagaaagctaaatatttttatttttacttcaatttcctgtcccaagatgggggatgcctctgaccagaaaagagatggaaatcctatcttttctctagtaacgagtttataaataacattacgtaatctttttattttatttcatttttttgagacagrgtctcactctgtcaaccaggctggagtgcagtggcacaatcccggctcactgcaacctctgtctcctgggttcaagcgattttaatcttttaaattttttaatacaaaagaaatacattacattcttactcataaaatttcaaacagtggagaagtgtataaacgaaaaagtcttcttcaccactcacttcgccttgtagcttcctttcacagtcttgtgaagagtcttcggcataacttttctcatatttttcgatgcatttacgtgtatgaagtatgtttttgtaaacatataatttgtgttctcgttttgtaataaatggaattacattgtgcgtgctattctgcattttgcatttctactcattttaatggtggaaatcttagagatcttttcaccttaatgcatatagatctacctcactctttttacatatactattccatagaatttacatagcataattttttaaccattctccaattgaaggacatttagattgttttaaattgttcacgtttatcaataagctataataatgattatatatttctcttttttttgcacatatgcaagtatttctcttgtgcctaaaccttaaaaagtggaattgttgaagcaaagggtgctgttatttacttgtttatagatcctgccaaattgtctttttagggggctgaacggaggtgtttcacaagtagcaaatgagatgaaccatcttcctgcacacagccaaagtctgcaaaggtgatgaaraattacaatttgttttaatttgtattttcctgataatgtggaaagctgaacagcttttcatgtttcttggccactgaaatttcctcttccataatttttttgtttattttttgccaatgtgattcagttgaggtgtttgtctttttttcatgatatgggagagttcactaaatattctgcaaagtataaatatacttttcttgtcccttacatttgtatatggtgacttttatcttattaacagcttaaaatttcatgtataaacatcttacgacatagattttataagacagatgcaccctcattataaatagtgatgcagagagttgctgaggcactctgtgagcacggccagtttttaaagtcgttcttctgttaaggtggcagatttgattctgcctttgttccaggaaaagttccttctctaaaatctctgacattttctttttcaatttttaggcaaaattattcttacattggagcaacttcagccttcacagcttttatcttccccgtggtcctttcatcttttcagttttttactttgagttcacaatagttgtctcaaacttttcctccatgacaattatctagtgatatggtttggctctgtgtctccacccaaatctcatcttgaattgtaatcagaattgtaatttccaggtgttgagagagggacctggtgggaggtgattggatcatgggggcagcttctcccatgctattctcatgacagtgagtgaattctcccaagatctgatggttttgtaaatgatagcttcccttgtgctctctctcttgccatcttgtgaagaagacacttgcttctccttcaccttctgccatgattttaagtttcctgaggcctccccagccatgcagaactgtgtgccaattaaacctctttcgtttataaattacccagtctggggtattcctttatagcagtgtcaaaacagattaatacatctagctttcagtagatttcttgtttcttgtaatttccaatttaaaaaaattgatcgtgtttatttttgaggagggatcttaatttgtttctatagctctgcaagctcccctgtattccacattttgttcatttctcgttcaatcttcatggtttttcttttttaggtttttgtgcaatgttaagaactttgggatattattatcgtctctgagatattcttccagactgattctatctgatcttgtgttccatgtgcctgctgtggctttacaacccatctgggcaggctcgaccagggcagctcaccctaaatatcccatttgctctgttgtaatctgggagagtcatggtttttttcaaggttcctattttatctgagagagaccaaattgtttttcatctgagctacagtttgaagactctgtttttattcttatcaatttttctgaggacaccattaattatcttacccttttccccacttattgtgaaccaggtggccatagaggcagggtgtgtttctgtgttctctcttctctgcccctggcctgtaagagcctcttcttatgccagtaccacactgccgtagcgatggaggctttccaggaactcttgacatctgacgaggcaaaatctcttcctcttcctccaaaatgtcttaaactttgggttcccaaattagcctgtcaaaatcttggcattttgtgtgaaattgcactgactctatagatcaatttgaagagagccgacatatttacaatattatgccttccattctcatgaatatggctcacgtatatgattagtttagaaatgttttctattaaaatgtatttttctctctgaaggtcttgtacttctgctagatttcttcatagatatttgatatctttatgctattattaactatagtagtccttctttatccacggtttcactttctgaggtttcatttagtcatagtcaaccatggtccaaaaacattaaatggaaaattccagaaataaacaattcatgagttttaagttacttgctgttctgagtagtgtgatgaaatctcacgctgtccctctccatcccgcccaggatgcgaactgtccctttatccagcgtatccacaatgtggacaccaccagtccatgagtcactgagtagccatcctggtaatcagatcggctgtcatggtatctcagtgcttgtgttcagagaaccctgattttagtcaataaaggccccaaagcacatgaggattgatgctggccattcagatatgccaaagagaagccgtcaagtgcttcctttaagtgaaaatgtgaaatttcctgaaagaaaaaaaaaatcacatgctaaggttgctaatatctacagttcaatcttttgagagagagaaagagaccacatttacataacttttattacagtatattgttatagttgttctactttattattaaatattatttttaatctcttattatgcctaatttatgtatagatgggggaaaacatagtatatacagagtttggtactatctgcagtttcaggcatccgctggggatcttggaagcatctgctgtggataaaagggaatgagtgtactaaattctctcttacatataaatttgtataggtgacccatgttctaatccatggttatattttttattcttgtttcaatactgaactgttttagttgctatgatcttctaggtagtgttctgtaacctgtcttgctgggattcaactgagagacactaaatgaatagataaatctaacaagaatttacatttttaaaaattcttaatgatcccagctagaaacatggtatatctctccacttatttataattttttgaacttgagtccttattgggtcactttagtgctaggcattttaaaattgtatttgtaaacaggaactcgttttccttttacattttctagttatttctttctggcataggggaaatctatttgttttagtttgatgactttgtgcataggagactttctaagtagtcttctcccttctattattgtcttgtttttttctggagaaataattacatcttcaaaatagcagctttgtctgctctttttcagaatttataccgtgtatttttctttttcttactttttttccttctttttccctttgtgcattaggcaggattgtcagtgtaatactgaatagcaacaacaaaaatgagcatttttgttttgttccagcgctcaggggaacgcttgtaatgtttaacttgagactttctgacagatgccttttatcaagataaggacattttctgctccggtttactaagttatttcttttaatcaagaccatgtataggatatttatcaaaatgtttgctaaagaatctttgaggtcatcatatcattttacttttattaattttgataatttttccaaagtaaaacatacatagagagattaaaatatcaaacagtcaacaagaccttaaaatacaaaagtagctctttcggccatcttccccagtcgtcgtccagtttcccagatggattatctttaaccttttagctcttccttctgtacttacttctgtaatttgaaaagatatgcagatacagctctttgtaatttttcaagttccagacattaatctgttcacataatagggcagaagatgaagacttctcccctaacactccttttcattccccatccattctcgtaatacatcacagtttgaggttcatcagtaatcagtgttatcgttatgagggttatttaaatgatgttcataaccaagtcatatactatgtgatgatcacatttcctttcctgtgcaacatctttcccaaaaataactattgccctcttacacatttgcttggattttgtgtgcccttgttatgaattcttcccaggcaccctgcagaattctaaaattcttctcaggacagtgaggcacattgtgtaacttatcaattccgttttattttcttgggggagcccttctggagctacccattctgctgatccaattagttctggttagtttcagcttccaagactgaccttctgaagctagacatctctcctgtgttgggtcttgttttatggattacatgtatcttctttcttgctttactatctcattttggcttaccgcattatccagtagcctcctgactaagagttcatagaaggtatatatcttaagatcattcatatctggaaaaaaaattattcttaaacctcacaactgtatgaaaatttggtaaatctaaatgtatagtttggaaattaatttggttaactgccttgcagttttcagcattgctaataagaagtcgaatgccattctgatttttttttttttttgatggagtctcgctctttctccaggctggagtgcagtggcacaatctcagctcactgcaacctccacctcccaggttcaagtgattctcctgcctcagcctcccgagtagctgggactacaggtgcccaccaccacgtctggctaattttttgtatttttagtagagacagggtttcaccatgtttgccaggaaggtctcaatctcttgacctcatgatccactcgcytcggcctcccaaagtgctgggattacaggcataagccaccgcgcccgacccccattytgattcttgatcctgtctttctatgtcacctgttttgcctctctgaaactttctggctcatctctttaatcccttgattctaaattctcatgatggtttgccttggcgtgagtgttgtgcttagttctccggggtcctttcaaatggagaccaatttatttcaattctcatcattttgcttgtgatattatttaattattttctcccttctgccttatctctctgttttatgttttggaattcctgttagttggatattgggtttcctaggttgatcctctagagattttttgtttttttttcttgacaatcttgtatgtcttcttcttttgaatctaccttctatgacattttctcaggaccttcatttcttctagtgatttaaaaatttctgccatgatatttttaatttccaaaagcccttttaaaaagttrtttctygtttatagcatcttgttgttgttgtttcaagaaatccaatattttctctctcctaatgaggatgatgatttttagaattgcatctgttccttccaggtttctttcgcagctcctgctccaatatttgcttgttctgaaagaattcatcaagtgtccattgggtgtccattcacatttcagaacgagacactagaaatctgactagaagctctgtgtaaggaatgcctctcgttgactgtaccccattttgattttcatcttccaatttatcctctgaaggaacagtgcctctaattactaaccacttccagagtttgaaagcatacatgggcttactccttgtcagcatttcctctgcaagtaatcaggtattttattctttcattctgtgaaactagctgccatgtatgcacctaccttctgaaatgtttggttgtctcttatttgatgtcctttcctctcctgttccctggttcctgctgcttttctgcctgtaactctctattacaggtggtttcatgggatttcacagggaacaaagatgaatgcagatgtgttcaacccgccaggcttaatgaaatacatagatcgattatctaatgtgatttgtcctggaattcctgagataacacctacgtggtcatgtcacatgattttttcatccattccagtgttggatttacatgtattttattgtgggattttgccttatgtgtttttaagcaacagtttttattttgtatttgcttgatgttgatagcgaaactataacagccttatgaaataattgagggtgattaaaattatakgtatatatatatatataaatggtttctttaatacagacattacctgttccttgaaggattgctaaaaattgtccattaaatgatttgaaaccaatgtctgtgtgtaggtgtggggtgaaatgtagtttagggtaagtctgcaagcatattatgcatttcttctattatttttagttctcatgctgacctttgaggcagtttttatcatttatattgtcctaaagtatattttccctagattctcttatttattggtagaaagttgtatcgaaatttctcttataaagttttaattctttccttctctgaagacatatcattttttaaactcctaacgttgtttattgttgtcttttcctttgttcttttgatcaatctttccattttgttggtcttttcaatgaaccactttttgcttttattgatccattactcttattttttgtttgagatataattaaatcttgcttaacatttttatatttttctatttattttctttcctaattctttacttcaactttgttgaggggattaccttgtgttctgtttctgataccttgctttaaaacttaatctacttgtcagtgtttcttattttctaataaatgcatgttaggccatgaatattcacctctgtgccactttggaaacgtttggcctttataatgtacagtgttttcactggagtttcttagccgtttgttattttgattttgatttcctgattaacctaagaagcgtctggaagcagcttttaaaatttctcagtggaacgagttggggaagtcgtcctctgtccttgggttgtttactctgatcctatcacattgtggttagaaaatgtgttttttaggattttggtttgtgagagtctactgttgttttttttgtggcctagtgcatagtcatttttgaggctttgccacatttgaaaggcaatataatgtaatgattaagagtgtggtaactaatgtcagatgggagagaaagtgggaggggaagagaggatcaacactaggatgattggagagggacggtgtgaagtccagctctgccactgcatagatgtggaggtggggcaagccttgtttcttccctataaaatgatggtatcaacaatggtgttaccagtgggctggtacaggttcttgtcttcaccccagaaaagaatttgaaggccagaccaaactgaaagtacagaagatttattgcagmgtgaaagcaagtacatactcaagagaggattgtgagtgtgctcaaaagaataagctgaacccaatatggccaggactcacatactatacagataagcataatgaaggtgtggaatattccatcataagaggagggattttctgggaaatgggcaggcagttcccagaattggattgccacttttttctttactaaatatggttaatccagaattgacatggcatcagatgcatgatgggattgggaggtttccccgtggaagtcttatagtaataggggcataatgcagtcaagggtccacagccagtcaagtttctggccatcttggattaaaccagttgtggttgatttcttctttgttacattcttatctgtgcctaatctagaacgtctaaattgtctttatttttgcagcctgttgcaacagttcctttccactaaggggtgggtccttgagctaamctatttggccccatttgttttgcttttagctacctgcaagtaattatgtcttgttccctcactaactgcctaccacctgtttcatgagaatctatgaggaggaaacaagttaagctacgcaccaagcacttagaagagtgagtacctcatacagagtgagtactcagaaatgtcagatattttttaatgtactgaaacaagttataacctcttcattacacatctacttaacccagaatgctcattattttrttcaaatctttaacttgatttaattttgacttactggacttgtcaacttctaacagagatgccttaacatttttttactacaattgtgagtttttcagttttcctatatcactgtcagactttcctttcaatattttaaagcaattttcttacagatcatgacttctactacatagactggtagaatatatcttttatcagtatgcaaaaaacttctgtgctgtttgtattactcttcagtctaaattctgtttgtttctgatgtcagttttgccacagagctctcttttattttgcatttgcctggtgtgttgtattagtctgttcttgcactgctctagataaatacctgagactaggtaatttataaagaaaagaggtttaatggcgtttctagttctagatccttgaggaatcgccacactgacttccacaatggttgaactagtttacagtcccaccaacagtgtaaaagtgttcctttttctccacatcctctccagcacctgttgtttcctgactttttaatgattgccattctaactggtgtgagatggtatctcattgtggttttgatttgcatttctctgatggccagtgatgatgagcattttttcatgtgtcttttggctgcataaatgtcttcttttgagaagtgtctgttcatatccttcgcccactttttgatcgggttgtttgtttctttcttgtaaatttgtttaagttcattgtagattctggatattaaccctttgtcagatgagtaggttgcaaaaattttctcccattttgtaggttgcctgttcactctgatggtagtttcttttgctgtgcagaagctctttagtttaattagatcccatttgtcaattttgkcttttgttgccattgcttttggtgttttagacatgaagtccttgcccatgcctatgtcctgaatggtaatgcctatgttttcttctagggtttttatggttttaggtctaacatgtaagtctttaatccaccttgaattaatttttgtataaggtgtaaagaagggatccagtttcagctttctacatatggctagccagttttcccagcaccatttattaaatagggaatcctttccccattgcttgtttttctcaggtttgtcaaagatcagatagttgtagatacgcagcgttatttctgagggctctgttctgttccgttgatctatatctccgttttggtaccagtaccatgctgttttggttactgtagccytgtagtatagtttgaagtcaggtagcatgatgcctccagctttgttctttkggcttaggattgacttggcaatgcgggctcttttttggttccatatgaactttaaagtagttttttccagttctgtgaagaaagtcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctagatattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagatatagaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagagttgttgaattttgtcaaaggctttttctgcatctattgagataatcatgtggtttttgtctttggctctgtttatatgctggattacatttattgatttgcgtatattaaaccagccttgcatcccaaggatgaagcccacttgatcatggtggataagctttttgatgtgctgctggattcgttttgccagtattttattgaggatttttgcatcaatgttcatcaaggatattggtctaaaattctctttttttgttgtgtctctgcctggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgccacaatttcagctcctgttattggcctattcagagattcaacttcttcctggtttagtctcgggagagtgtatgtgtccaggaatttatccatttcttctagattttctagtttatttgcgtagaggtgtttgttgtattctctgatggtagtttgtatttctgtgggatcggtggtgacatcccctttatcattttttattgcgtctatttgattcttctctctttttttctttattagtcttgctagcggtctatcaattttgttgatcctttcaaaaaaccagctcctggattcattaatttttgaagggttttttgtgtctctatttccttcagttctgctctgattttagttatttcttgccttctgctagcttttgaatgtgtttgctcttgcttttctagttctttcaattgtgatgttagggtgtcaattttggatctttcctgctttctcttgtgggcatttaagtgctataaatttccctctacacactgctttgaatgcatcccagagattctggtatgttgtgtctttgttctcgttggtttcaaagaacatctttatttctgccttcattttgttatgtacccagtagtcattcaggagcaggttgttcagtttccatgtagttgagcggttttgagtgagattcttaatcctgagttctagtttgattgcactgtggtctgagagatagtttgttataatttctgttcttttacatttgctgaggagagctttacttcccagtatgtggtcaattttggaataggtgtggtgctgaaaaaaatgtatattctgttgatttggggtggagagttctgtagatgtctattaggtccgcttggtgcagagctgagttcaattcctgggtatccttgttgactttctgtctcgttgatctgtctaatattgacagtggggtgttaaagtctcccattattaatgtgtgggagtctaagtctctttgtaggtcactcaggacttgctttatgaatcttggtactcctgtattgagtgcatatatatttaggatagttagctcttcttgttgaattgatccctttaccattatgtaatggccttctttgtctcttttgatctttgttggtttaaagtctgttttatcagagactagggttgcaacccctgcctttttttgttttccattggcttggtagatcttcctccatccttttattttgagccaatgtgtgtctctgcacgtgagatgcgtttcctgaatacagcacactgaatgggtcttgactctttatccaatttgccagtctgtgtcttttacttggagcatttagtccatttacatttaaagttaatattgttatgtgtgaatttgatcctgtcattatgatgttagctggttattttgctcgttagttgatgcagtttcttcctagtctcgatggtctttacattttggcatgattttgcagcggctggtaccggttgttcctttccatgtttagtgcttccttcaggagctcttgtaaggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagggtttctgctgagagatccgctgttagtctgatgggcttccctttgagggtaacccgagctttctctctggctgcccttaacattttttccttcatttcaactttggtgaatctgacaattatgtgtcttggagttgctcttctcgaggagtatctttgtggcgttctctgtatttcctgaatctgaacattggcctgccttgctagattggggaagttctcctggataatatcctgcagagtgttttccaacttggttccattctccccatcactttcaggtacaccaatcagacgtagatttggtcttttcacatagtcccatatttcttggaggctttgctcatttctttttattcttttttctctaaacttcccttcttgcttcatttcattcatttcatcttccatcgctgataccctttgttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtccgcccgtagctcagagtaatttgatcgtctgaagccttcttctctcagctcgtcaaagtcattctccatccagctttgttctgttgctggtgaggaactgtgttcctttggaggaggagaggtgctctgctttttagagtttccagtttttctgttctgttttttccccatctttgtggttttatctacttttggtctttgatgatggtgatgtacagatgggtttttggtgtggatgtcctttctgtttgttagttttccttctaacagagaggaccctcagctgcaggtctgttggagtaaccggccatgtgaggtgtcagtgtgcccctgctggggggtgcctcccagttaggctgttcgggggtcaggggtcagggacccacttgaggaggcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctagagagacaggcaggcctccttgagctgtggtgggctccacccagttcgmgcttcccggctgctttgtttacctaagcaagcctgggcaatggcgggcgcccctcccccrgcgtcactgccgccttgcagtttgatctcagactgctgtgctagcaatcagtgagagtccgtgggcrtaggaccttccgagccaggtgtgggatataatctcgtggtgcgccgttttttaagcccgtcggaaaagcgcagtattcaggtgggagtgacccgattttccaggtgccttccgtcacccctttctttgactcagaaagggaactccctgaccccttgcgcttcccaagtgaggcaatgcctcgccctgcttccgctcgcgcacggtgcgtgcacccactgacctgcgcccactgtctggcactctctagtgagatgaacccagtacctcagatggaaatgcagaaatcacccatcttctgcgtcgctcacgctgggagctgtagaccggagctgttcctattcggccatcttggctcccggagcctgcgtttttctttaatggaaaggtttttttttcctacttattcaatcagtttacttattattggtctcttcagattatctgttttttcatgattcagtcttggtaggttgtatgtttctaggaatttatctatttcttctaggttatccaatttgttgatgcataattgttcatagtagcctaatgattctttgaattactgtgttattagttgtaatctttcctgtctcatttataagttttaagttctgtctcttatttcccttggttagtctagctaaagatttatccttttttttaaaatcttttcaaagaaccaagtctgagttttgttgatcttttctactgttttcctattccgtatttatttctgctctaatctacattattttctcccttctccttactttgtgcttagtttgcctttcttcatcaggtgtaaagctacgttgttggagatttttcttttttccaagtgtttatagctataaacctgatagaattgctcctgctgcatcccataagttttggtgtgttttgttttcttttatttgtctttcctttttcttcccttcaacttttaagttcaggggtacatgtgcaggatgtgcaggtttgttacataggtaaacatgtgccatggtgtttgttgcacagatcatcctaggtattaagcccaacatccattagctattcttcctgatgctgtccctctccctacacccccgacaggtgcccagagtgtgttgttcctcccatgtgttcatgtgttctcaacattccgctcccacttataagttagaacatgtggtgtttggttttctgttcctgaattagtttgctgaggataatgacttccaattccatccatgtccctgcaaaggacatgatcttgttcctatttatgggtgcatagtattccatggtgtatgtgtaccacattttctttatccagtctatcattgatgggcatttaggtggattacatgtttttgctattgtgaatagtgctgcaatgagcatacatgtggttgtatctttataayagaatgatttatattcctttgggtatatatccagtaatgggattgctgggtcaaatggtatttctgcctctaggtctctgaggaattgccacactgtcttccacaatggttgaacttacactcccaaaaacagtgtaaaagcatttctttttctttgcaacctcaccagcatctattgttttttgactttttaatatagccattctgaccagtgtgagataatatctcatgtggttttgatttgcaaaggacatgaactcatccttttttatggctgctttcttaatcttggtctgatttgattgtgctgtgatctgagaaactgttatgattactgttttttttgcatttgctgaggagtattttacttctgattatgtgatcaacttttgactaagtgctgtgtggtgatgggaagaatgtgtattctgttgtttttgagtggagagttctgtagatatctatcaggtctacttaatccagagctgaatcaggccctgaatatctttgtttattttctgactcgatgatgtgtctaatattgtcagtggggtggtaaagtctcacactattactgtgtgagagtctaagtctctttgtaggtttctaataacctgctttatgaatctgggtgctcctgtattgggtgcatgtatatttcagatagctcttcttgttgaattgaaccctttaccattatgtaatgttctctttgtctttttaaaatctttgttagtttaaagtctgttctgtcagaaactaggatcaaaactcctgcattttactgttttctatttgcttggtaaattttcctccatcccttggttttgagcctatgtgtatctttgcacatgagataggtctcttgaagatggcataccgatgggtcatggctctttatccagtttgccattctgtggtttctttaactggggcatttagcccatttacatttgaggttagtattgttatgtgtgaatttgatcctgccaccatgatgctagctggttattttgcagactagtttatgtggttgcttcatagtgtcactgcgctgtgtacttcagtgtgtttttgtagtggctggtaatggtttttcctttccatatttagtgcttcctttccatagtgttttgttttcatttttgtttgcctcataatatttttaaattacccttttggcttcttctttgacctattggatattcaagaatgtattgtttaacttccctacattatttatgtataccttacagaatttatgaattctctgaatttcctcctgttatggatttcgagtttcataccactgtggtcagaaaagcacttggtatgatttcagtcttcttgaatttattaagacttcttttgtggcctaacatgtacacttgagtagaatatgtgttttgctgctgttcagtgaaatgttctgtatatgtcttttaggtccatttgatctaaagtctggttcaagatcaaaatccttatgattttctgtctgattcatctgtcattgttaagggtgaggtattaaagtcccttactattattgtattgctgtttcttcctcctttcagattggttagtatttgctttagctatttaggtattccaatgctattgtcaaaatatttacaactgttatatcctcttgatgaattggcccctttatccttatatattgaccctctttgtcttatgtggccattttttacttaatgtgtattttgtccaacataaagatagttaccactgctttcgtttggtcactttttgcattggatatctttttccataccttcaccttcagcctacatgtgttcttaaacctaccatgagtctcttacatgcagcaacttgttggatcttgtggggttttcataatccattcaggtactctatttcttttgattggagaatttaatccatttattgataggtgagaacttactattgctgttttgttatttgtattctggctgttttgtaatttgtattctggctgttttgtagttcttttttttttttcctttctttttttcttgtggcattcctttgtgagttgatgaattttaaagtgatatgctttgactcctttctcctttgtggttactgtgaggcttacataaaatatcttatagctatatcatctgattttaagctaacaacttcaaccacatataaaactctacacttttgtttctctcctccctcatattttaattgactaatgttacaatttacatatttttatattggatatctaaaaccaaattactatagttatacttatttaaatgtttgatttttaatttttatgctagaattgaaagtgatttatgcacaatcattacaatataagagatttctgactttgactaaattttacctttactggtgagttttgtatatttatatattgttatgttgttaactaataccatctcattgcagcttgaagaactagaactcactttagcagttcttgtaagacaagtctactgatgatgaactccttcaacttttgtttttttggaaaaacctttatcacgccttcatttaagatagatagatttaccaagtgtaacactcttggttggcagttttttttctttcaatattttgaatgtgtcaccctaatctctcctgggctgagaagaggaggtttccactgaaaactttactgttagtcttatgagggctccattttttgtgataagttatgctttccttgctgctttcaaaattatctttttgtcttttgataatttaattataatacttattggtgtagaattgtattgttgaacctgtttggggaactttgggcctcaagaacataaatgtccatttctctccccaaatttgggaagtttttagtcattacttctttaaattgactttctgctcatttttctttctctcttcttctgtaatttccataatttgtatgttgtttcacttgatggtgtcccataaacacaataggctttttttcactcattttcattctttgttctttttgctcctctaagtagataatttcaaatgacttctctttcagttcactgattctttcttctgcttaagtaagctgttggaattttctgttaaattgttcagttcagtcattgtattttttagatctaggatttctgggggtttgtttaatggttcctattttttattggcattatattttgtttatatattgttttctgattttgttgagttgtccatctgtgttctcttgtagttcaccgaactttttaaagagaattattctgaatgtcagttagctcatagaccttcatttctttagagtcagttgttagagcttattaatttcttttaggggttttattttttgctgattttttatgatccttgtatcctcacattagtgtctgtacatttgaggaagaagtaacctcttccaacctttataggtttgctttggcatggaaagccctttagtagtcagtgtttcctggagatctggacaggtcagctggtagcatccatgaatagtcacagtttgcttttgagatctctagttgtgcaggattattgcctgtgctctggtgtttgctggggccactggctcgcctgtatggtttgttgagtgttttggttggactctttggttgggcagggctactggctggcttctgagatggaacaagacctcaagctactgttcagtgggaccacaggttaggctctgtgattaatcagggttgcaggctgtgttttgcagttgggttgagtcactgtctgggttctcttccagagtagaaccactggctgtgcttcagtgtcaatcagtattgttatcaggtacctgggtttggtggggccacaggctatgccccagcttgctgcaagctgggctcctctgtcagatgggatcattctctggaatccctggttaggcagaactgcaggctgtgcccctcagttgggaggtgtccttggctttgtttactgtccatgcaggtcgctggctggccactgaggctgggcagggttactatttgggcttcctggttagcaaggctagaggccatactctgtagttaggcagagtggctggctcgattacctgcgtggtcaaggacgtatgttaggctttgaggctgggcagaatctctttgggggttccctggtccaacaagacagaaagctaaaccctgtagctggcctggattgctgactaggcacccaagccagttagaattgctgactatgctccctggccaaatagggtcaccagcttgcctctgcagttgggcagagctgctggctgagctctctgctagggtgctgatggcaggaacacagtaccagcatggtgatccatgcactggccactgtgaaccctgccctcacttcttcatttctggtcaaacacaggtggtctagccccactgatttcctctttgtttcccatgagacaagacagaagtgggcctcctaagatgtagcacagaatgctacagaagctggatgtcctcctcaggctctcttttccccactggagaaactttgggctcaggaaaaccctcttgatatggcactttgccagccttggggaggagcaacacagtcaaagtgaaactgtatgactcaagaatttaactgctaaacatctacctagaaatgaaaacgtatatccacacaaagacttgcatgcgaatatagtaacattatagtaacagtaacgtgatagttaactttcacaaaatctatcgtacactgtttccagaagaccatttcatagcaatgtgtaagggttccagtttttccacatctttgctaaaacttgttattgtatgtgtttatagccattccaatgaatgcatattagtattttgttgtggtttgaatttgcttttctctaatgactaatgatactgagcatctcttcttgtctttattatcttccatgtgtctttcggagaaatatctgttcaaatcatttgcccatttttaaattgggttatcttcttatagagctgtcagaattctttacatacctgaatataagtagtttattgaaaatataattggctaatattttctcccagactgtgcctagtcttttctttttcttaacagtatacttgaaacacaaaagatttcagttttgttaaatttcagcttatcactttattattttaaggatcatgcttttgatgttgtagctaactcttcatttaacctaaagtcacaaagatttttgtctttattttcttacaaaagtcctgccatttttgctcttttagaagattactacataatttggggaacccagtgaaaaataaaaatgrgggatccttgctcacaagttattaaggattycagaacagtgaaagcagaacactaaactaagcacagagtcatttgtgactgcacaggatgcatgctcatgaagccagccctgctcttacatttagatccatgatccatttttagttgattcatgtatatgatgtgaggtaagagtctacatttgtatttttgtgtgtatctatgcaattctacttgtagtatttgttgaaaagactatcttttcctcatttaattgccttggcacttttgttgaaaatcaattgctgaaaccacaaggattttttctgcactctcatctctgtttcactgaattataccagtacaataactgtcttgatatgggtagctttataataagtgttgaaataagaaagtataaatcttccaacttttttcttctttttatagattgttttggctattctgggttcttgcaattccatataaattttaggattagcttctcaatttcttcagaaaagccatttggaattttgataggaatcacattgagtttataggtcaatttggagagaattgccaggttaaatatattgagtcttccaatccatgaacatgggtatctctatttatttagattgttaatttctctagtaatgttttgtcattttcagcatacaagtcttgcattctgtttgttcattcctaaatgttttattattttgcctacctttaattttgaatttgaaaactcaatttttacatttctaagtttactagttggttgttttatagaaacaatatcattgaataagttatgggggtactaaatatacttactctaggctgggcacagtggctcatgtctgtaaacccagcactttgggaggcagaggtgggcagatcactcgaggtcaggagtttgagatcaacctggccaacatggcaaaaccccgtctctactaaaagtacaaaaattagccaggagtggtagcacatgcctgtaattccagctactaggatggctgaggcaggagaattgcttgaatccagggggcagaggttgcagtgagccgagatcaagccactgcactccagcctgggggacagagagagactccatctcaaaaataaaataaaataaatatacttactctaaagtcttattctatttgtttattatttctctttcctctgatgttacccaaaaaaatggtaaaaagaaagatctgaagggatctggttagaaccctgaaactgtccactaagccagtgttaacacctggggtgtagtcgtttcatgccttccctattatttattctgaattttatatacaaatgaaagacttttttgtttaatttatataaaaatgggatcataatgtattaatctgaacatgatgttttcatggaacagcaaaactattaccttcaacccaaattgctacaattaaatagctatgtaatatttcaacagtgtacatttatgataatgcactcaaccattctgccaaatgggcaatcaggttattttcaggtttagaggtatgtgttattgtggagttgttgttgttgttgttgtcgttttgctactaaaaacaatgcttcaataaatacttctgtatttatgagaatgtagtcaacaaatacttattgaacaccttgtgtatatcaggtactcaagaaaaatcaatggacaaaacagatgccactgcccttatggcatacatatttttgggagaagagagacaatgaagaagatgataaacaataaacaaacaaatgtgtaatttatttaagacgttagggattgacaagagcatggaaaaaagagaggcagatgaggggattgggagtatgggggcaggatgggggattgtggttgtgattttagataggttggtcaaagaaaatctcattgagaaggtaatagtgaatcaaggatcaaaaagagacaaggaaattagttcactgcatagatacatatatctatgctaggcagaagaaacagtcaatatcaattccctaaggctagagtatgtctggttagtcaagaaacaacaaataggtgagtgtgaccaggcagaagtgatcaaggggagaggagagaaggttggatcattacattacctttgaacagtgtaaggatctgggtttcactcttgaagaaatggagagcattgaaagttctgcagttcttgtttctataggatacatgttgatctttttatttatatagggtagattccaaaagctggatctgctgggtcagtcagtctgtagtatattttaaaatttagcggatgttgccaaatcttttctgaaaaggctgcagtaattcatgctcacaccagccatgagtgtctgtttctctgaatcttctcccacatggcatagtgtcactaatgaaattgtgtttgccaatctaatgagtgagaaatggtttctcattgatgttttagttttaacgtattcatatgtgtattggacattttaattttcttttatttaagctgcctgttcaggtccatgttggagggattgtttgttattttttattagcagactttagtctttgcctattaatatcaggtatattaaccctttgtcatacatattgagaatgtttttctacactgtcttttatatctgtattgctttttaagaacatttaaatcgattaagagaaatcttcctttaactattctcatctcaaattgttctttattgactcakatattctgtcatttcaatatttacattattttatccaggttttttttcgagacggagtctcactgtcacccagcccagagtgcagtggtgtgacctcggcttactataaccctgacctcaccagctgaagtgatcctcctgcctcagccactcaagtagttagatctataggtgcacatcaccacatctggctaatttttgtattttttgtagagagagccttttgtcatgttacccagacttgtcttgaactcctgaactcaagtgatccacccgcgccagcgtcccagagtgctgggactacaggcattatccaccacacttgggctttattcagttttaatggggtttctggttgcaagcacaccatacttacataataatttcagaaaaattgatgttttaaaattactactttttttctaattgggagcattttatatatctccatttatttagatcttatttaatttccttcaataaaatttttatagttcttatacctttaagatgtttataaatatatacatgtgtatttgctatttagtctgagtattttttttaacttatgtctttccaaataagaactagtaagttttatatgtctattttttattcatactccttggtgtattagttcattctcatactgctacaaagaactacatgagacagggtaatttaaaaagaaaagaagtttaattgactcacagttccacaaccttaacaggaatcatgactaggaggtctcaggaaacttaacaattatggtagagggtgaagggaagcaggcacctcttcacaaatcagagcaagagagagggagtgagagacagcaaagaaagaaatgttacacttttaaataatcagatctcrtgagaactcactatcatgagaacagtatgggggaatccacccgcatgatccaatcacctcccaccaggtccctttccaacacatggggattacaatttgccatgagatttgggtagggacacagagccaaaccatatcatttggcaaattagttttctacttctcatgaattttattaggtctctctctagtttttctatgtatataattatacaacatgtattactgtaccttattttagtatttatactaattgcttcattttcatagcctatcgcattagctaaagcttccaaaatatgcatatgtgtatgtgtgtatatatatatatatatttgtatacacacatgcacacacacacatatatgtgtgtatatatgtataatggtggtaatagtagacattcctatattgttttctatttaaatgacttcaccattcatgtttatcataacatttgctgattttagagagttcatgttatgttagttttatttcatatagagtttttattttaaaaatagctgttaggacttatcaaattcccttttaaaatcatttgtgaatatatttaaatacttctccttttatttatcaatgtaaaattacagagagattttataatgttgaactattttttctcttattcaatctcattgccattacctttctctttctttctatttctaaatagcctgtaactacaagttttattttatctttaacccaacacagtgtgttttgttttgctttctaaaatcttaagaaatttattttccttatgcaatatgtttcatttctattgattgtaactttttgagacttctttcgtggccaagattatgctaaatattgataatgtgttctctgtttttaagtcacaagattaaataataaatcattcttattaatttatctagaacctgtatattttgtccatttttggtatatggaaagagtaaaaaaactaagggtgaattgttttgcaatgcccataaaacatttgtcctattatttgtttcttgaattttgaattgacattaatgggaaatgttctgctttttgttttatttaaagttgcataccataaattgcctatttttgatttcaatatattttgtgtcactgcatctttagttggattctatctttgattccaattagtatcaatatcatcaatattgacgataccttcgatatcactaatattacctttcaggatcatttcttcatgtatattcagtgttataatttttcaaccttttttctgttttaccttttataattcattgtttttcttgttttatttctctaaaaatgcaaactatgtttgctctttatttttattttcagagtttcataggttttataagatctgatttcactcaatcagtagttaccttcaacttttcaaattcattgtttaatctgtatttctgtaattgttacagttgaatctgaaaccatattgttccaccatatcattttcatacttgaaacaaattccttaactcagtttttcttcaccaaccctgctcaaaattttaagtttgttgatataatttgaagctttaattcaaatagttaccatttggaatttccccccatttcccataatatttctgtttctcctggggtaactttttcctctttttccttacactagtctttctttctaatattgaagtatttcctcaaatgtctattgatctgtggttatttgtttctacataagagaagactttggaaatcaatcaatgtgattcaccaattaaaaaataaagaaggaaaatcatatgaatatctcattaatgcatttgataaaatttaacatctgttcatgataaaattcccagcatattaggaatagataggaactcagcaaattagaaatagataggtaggaaagtcatatgactaccttggtagatgcrtttgataaaattagtagttcatgataaaattctcagcaagttagaaataggtaggaatgcaaagcacagtggctaacagctgtgatcccaattctttgggaggccaaggtgggaggatcacttgaagccaggagttcaagaccagcataggccacaaagcaagactctatctctacaaaatataaaaataaaataaaaaattagctgggcatggtgacatctgtagtcctagctattcaggaagctgagttggggggtattacttgagcccaggagcttgaggctgccatgaactatgattgtgctactgcactccagcctggaaaacagagtaaaaccttcaaagaaagaaggggtgggggcgggggaagagagagagagagaaagaaaaagaaagaaagagacaagaaagaaagaaaggaaagaaagaaagaaagaaagaaagaaagaaagaaagaaagaaagaaaggaaagagaaagaagaaagaaaaagaaagaaaaaagaaaaagaaaaagaaagaaagagaaagaaagggaaagaggtaagaatatgtataaaggtctaacagacatcacacttagtgatattgctagttgctttttccctaaaattggaaataagacaaggaagttgtctctcacttcttctcttcaacatcgtatttaaactcctgaccagcgaaataagatccaaaaaaaggaaataattgttattttggggaaagaaacagtgaatccgtctttatttgctgatgacatatttattttctttaaaatataaaggaaatctataaatactttactagaactaatacatgaatttagcaatgccataaatacatggttaatagttttcaaaccaatcatatctcctacaatggcaataaggaatttgaaaagcagtatcctttaaagtagcaccagagagaataaaataactagaaataaatttaatgaaagatgtgcttgatttttamaattaatctaaataagtggagaagcaaacgatgctaacagattgcaagctcaatattgttgtcagctcccccaaatttatctatagtttcaaatcaaacccaagaaaaatmcaaaaggcttttctcatagaaattgacaaattgatttgaaaagatatgtggaaaatcaaagaatctagaaagtccaagacaatcttttctaattgacttcaagactttctttaagccatggtattcaacacaaaatcatrtcagcataaggatagacaaacagatcaatggtatggcatagaaagtacagatataaacccatgttcatattgtaaattgctttttgaatattttcgtgaccttggagtggcaaattcttcttagtacactaaagtcattaattataaaagaaaaaataataaattggacttcatcaaaattaaagattttttcctatcaaaagacataattaagaaaataaaagggaagctacagactgggtgaaaatatttacaatacataaatcagacaaaacacttctatccataatctgtaaaaggactcctacctgtcaataaataaaataaaattctataatataaatgggtcaaacatttgaacagacacttcaccaaaaaataaataaattgccagtaaacacatgaaaacatgcttgacataatttcctgattaaagaaatacaaattaaaactaaaattagctatcacatcgtacacactggaatggctaaaactagaaaggccatcactggtagtctttgcaaaaacagtttggcaggttttaaaatggttaaatgtactcttacacaatgacccagtaattccattcccacatatttacccaagagaaatgaaagcattttgccacaaaaagacttgcacaagaacagcagttttattcatactagtctcaaactgaatccactccaatgtccatcaagagaaaaatgagtacgcagastgtggtagattcacacaatggaataccactcaacaacaaaaatgaacaaactaactgttcaacacagcaacatagatgataagcaaaagaagccagacacaaaagcatgtatatgttttgctcatttatrtgaaatccaagagcaggcagtattaacatmtgacagaataaatgacagcaatggttgccccctgagaggctgcctggctgcatgtgttcagtatgcaggttcacaggcagtatatgcattgctctgttcatttttcaaataacaaatcagtttttagctgtgtgtctcccttcaaatctccactgtttcttccgaattctgtagggcaccacgattgctttcctaacctctaggagcatcccctacctactattgcaactagcacttttctgaccactttttgtcttcaaggttttatttgaaatctcttatgtgctcattgtcctccaccattctctttgtcactgtaaatctaattcctttattatcattttaatgaactttaaccagaaactttttttttacaggaattcaaaacaataatgcgacattgtttcctgctttatgttgtgtactgggaagtgccaataattctcttctggttggataaaaagagctcccaagttttcataacatttaggaatactgagatgttgattaaaacattatcagagcaataacatgatcaactaagaactagaattagagactcagctttaaaattgctttaaaaggaaacggcagcgatttctgaaattcagatgcctaaaatgattaactgtatatagcaatagtatggacagatttatattaacacaaagcagaaycagatgttccaggagatatcactgatattctcatgaaattctcaataatgtggtattattatcattattaaaccacattgtattatttatgaattaattttatgatatatgatggtatttccttcctagcagctacagattagagaaggacatcttatttttattttgtcaaattctctcagttgttgattaagctgcattttcaaggttagatttttatttatattccattgactttcatttctctgtggatgacctgcttactccatctagattctgtaggaattcaatatttttattttgaaaaatattccagatatggttaggtgaagatatctttacaatgactttgttcagtttagactgggctttttcagtgccctctatattagtcttgcataggctccatgakatcttctattacatttttgtttgttgcttcaattccatttattctgggctctactgaggaccacctattttatatatgttggttcttcatagcttatccgttatacataaaatcttaccatctccacaaacatctcagaatcttgatgaccattttcayttggtgtcctttttccttaggctgttcacggaagaccaggatgtagatgagggacttgtctatgacactgtattcaagcacttcaaaagacataagctggagatatcaaatgcaataaaaaagacatttccattccttgagggcctccgcgatcgkgaactyatcacaaataaaaygtttgaagtaagtaaagtttatttcacaacctggcagatatgctttcatattttacaagtatttctgtaagtgctcctgtaaagtagaaaaggagaggagaagcagaggtcaccagagatggtcctacttccagctgaggaaatggtgttccatggcaccctctggagttggggtgaatggtactggagaaactggaacggaaacagctgttctccataaatgtacaatgttttgtagaattcatacactataacataaactaaaatttaaaaataattttaatgaattgatttactgaaatcataattgacagagcattttatttcaattaacatcaatttaaaatacctagatctgagaacattaaaacccacagggaattggtgtctagagaggacaaatttggaagtagatgcttgttattctttctccaacacatttgttttcttgtctttcctttttttgtgcatttctggagtcttggaatatgagtaaattccacccataggccctgttggagatacagaacagcgagtcatctctggctatgaatatgcttcctctgtggccaagttcacagcaaggggagaatggtcacctagtttctttgagcccttcaggccaaatcagtcttgggggaagagcaggggttgcccagccaacaaaacagccactcattgattgcctgctacatctatcccaaaaaygtatcaatcaggctcttaaagaactttgagcccacttttatccttcaaagttgctcctttttacatctaatgtaaatgagggtgaagcaatcaggctcatcagtgggtatttttaaggagatgggatttacttctttcattactggctatacaaatatgtaaaaattataaaactttacatgagaagatacctctgaagagaaattgaaattcagtaaccataaaatttgtttttatggctcttctgtaacttgaaagtctgtatttgtattttctccattcaatatttttaaaggattctgaagattcttgtagaaacctggtccctgtacaaagagtggtgtacaatgttctcagtgaactggagaagacatttaacctgtcagttttggaagcactgttcagcgaggtcaacatgcaggaataccccgatttaattcacatttataaaagcttcaaaaatggtaattaggtttattatctaccttttgatttccggggccaatttttttcaataagcatatgtttgagctcctaccatgtgcgatacattgtgttgggcagtgggcatagagtagttaacaaaatagaygtgtcatgagtcttcttgragcccatggtatatggctatggcaaaacaaacatctggaggtctgcttcactggccacttagactcacaggacaaccagagccacactggcatcagatttacttagaagataagaaacacagaacaccaacggggcagcatcagttgtttcttctctttagtgggagtttttgcagtgacctacacagcagtccactaaattgactactacctgccttgagtgacagtttagctgtgggtgcaggatccactttggcataacaccacatatctgtgggagtcaatatctcttgtaacaaccccatagtcatagctttcagggtgccacagggacaatctgagttataagagttatcagttgaaggaagaccacaattattctttccctacaggtatttatagttcatgtatagtttcaggcaaacagtcatgggtcatttctaagcccagagtttgcccagtaaaaccaggaaaatgctacctttattaggtttctagaataatgaacaagaaaattaaccctgggtcaagtttgcctttagtgaaggataaatagttttgttaaccctttacccacaagggataaaagaaacattaatcaaataatcacaaaactgattgctcggacagggactataccaaaytaaagtttggtattggtgctataccaaactaaagtttggtattggtgctataccaaactaaagttttgattcttgacttttttcctgagaaggcataatttatactattataatggtacacagtaaagaaggtgccctctattttgttttacttgcctggaaaacttttattctcctcacagtttgatctcaacccagttctccaaataagagatagagacatcacaagaaaaacagggacatgccctgaagagggtggatgctatggggactggaaagagtraaagcatgtctgcaaaacaggacaaactggatttggctaaatcacagagtgagaagcagtataggagctgacttaagagagatcaattggaggaagatggtgaacggtctggaattgaaagctaaggaatttgaagtttatttactaggcaataaagaaatactacaggtttataaacaaggaaaaaagtttaggcagctatatatgttttggcttattgatttgtgttaatactaacaatatctagattaaaaataaaataatttttgtaacaagtcattcaagtcagaaagtgaataaaaggaaatcacatatctgggcacaaatttcgagtcaatgttatgtttgtaagcaggatggtccaggctgcggggatgaagggaatagtgttacatttactgcccacattctcaggggctctgttcctctgcatggactgcagggattcccttcctagccccagtgcccacaactcacatgttagtttctggcactccttatgcttgggtgacctgcactgaggctcactgtcacctgcctggggcagcactgcccaccgccccacccagcacagcagcctacccaccytcagggagatgctgaagtccacacaggctgcccctgtgtcctctgttatgtttatctgggaactgttcatcctccctgacccaattaagccaacgttctcctgttttctagcctcatctttaaagctgtttgggttttctcttttagtttttatttaggcatgtttttggagatagggtctcactctgttgcccaggttagatggcaggctagtgagctatctctgctcactacaaccttgacttcctggactcaagcagttctcccgcttcagccttctgagtagctgggaccacaggtgcacacaaccacatcaggctgattttgctaaatttttttcagacacaaggtcttgctatgtggtctaggctggtctcgaaatcctaggttcaggmgatgctcctgcgtcaccatcccacagttctacgattacaagcatgagccactgcacctggccagttttctcttttataatggaatctctctaggacttgagaccatccttccagggaatccctctgtttcttccttaacacttgatgtatgcctaccctgccatctgacaattttgcgggtaacacagctcactatgtttccattactcctttatccttaaatcttgagtatcccctttctgtgtaggacacataaaagctcattgttgaggtcatctcttctctgtcccagaagatgataggagaagtttaagtctgacttctgagtcagcctaatgctggaaattcctaaaagccaatttccaggtgttgtccctggttctcacagatctttaattgctttcttctctctcccactcttcagcaatccaagacaaattgtctttccaagaaagtgatcgaaaagaaagggaagagaggcctgacatcaaactaagtcttaaacaaggtaaaaatgacagaataaaaacggtttctcatccgctaagaggaaaaggagacaagggaggtgagggcccaaggtyctgaggggaaattgtgaaacagggaagacacagggaaggaccatggagaagtcaaggagggggttgtatgagctcctaatcagatgcagggtccyggagaagtggccataacaagacattgttggctcaataaccatgaaggaaccagagccaagtgtgtcagtaggccagatttacagatgctaactacctagatgtaattgtgatttagaaaggtccctgtgggaggtcagtatgaagctgtgaagtgttaagaaccacagcccatggcccatggtcaacatcaaagaggagacccttaggggaagaaaagctcctgttttatctgtactctcacattctcaacacttttgacaccaaacatgtggagaacctccccacaccaaccagttcttcagttccctgcagaattgtgtaccccatccttaagggctttccaaaagtcaccttattaacataaactcaggtttggttgaaatggggttgttatgcataacaggaagtgctcttttgactttcatcacttaggatgtttcaagggttttaggagctctggccaggagcaggggatgaagactgaaatatatatttcttattatatcacaggagataattggtgatggcagaagaggggacccatttaaatgtggggatgttgttcaagagcaggaatattcaaagagaaatgcactcatgtagagagactcagagaggaagtggtgcagatgtggagaggatgtaggtattgagagagagagagagaaggaaggaggggaagttaaagaaagagtgaaaaaggcataaaggacaacaaaaataaccatgttattaacagctcactttgattaaacgtctattctatggcaattgtgagtttaatgctcctgactgccatggagatttgtattccttattgtccattttgcagataagaaactgaaatctggacaaaccacttacgaagtttgcctagggtcagatgagcaaggaagaacccccctaggcattctaagccagagccttgttcttaactctgtgatatccagggaacctaataataaaagcagaaacataaaaygcaaatgaggaaatttatgcagaaagaaagatacagaaaaaaaaaaaagaataacatgactggaggaaatggtggcaactcagacacagaatcctcatagaaagaccaaccagaaaatgtgaacagatgtggagtgggagggtgtggtgtaaacgcacataaggacaagacatccagggcttatgatttttcagctttacaatggctttattgaggtattaagtgcatttttgacttatgagattttcaatttatgttgggtttatggaggtgtagccccatcataactgtaggagcatctgtgctgatttatcctttggatatatattcagcagtgggactgatggatcatatggcagttctatttttactttttttgaggaaactccgtactgttttccataatggctgtactaatttacatttccattaacagtgtacaagagtttccttttcaccatatcctcaccatttatcatctttagtctttttgataatagccattctaacctgtatgtggtgatagtcattgtggtttcaatttgtattttcttgatgatttgtgatgctgggcattttttcacatacctgatggtcatttgtatgtgttcctttgagaaatatctgtttgaatcctttgcccactttataatctgtttatttgtttttgtttttttttttagtatggagttggttgagttccttacatattttagatattagcccttatcagacatatggtttgcaaatattttctcccttctgtaggttgtctcttcactctgctgattgtttccttgcccatgcagaaactttttagtttgatgtagtctcacttctttatttttgcttttgtgattgtgtttttggtgtcataccaaaaacataattgctcagaccaatgtcatggagcttttcccctgttttcttccagtaattttgcagcttcaggtattaaatttaaatatttaatccatgttgggttgattttttaatatggcatgaaatagggtctaatttcattcttctgcacgtgaagatccagttgtcccaacatcatttattaaagagactgtcctttccccattgcgtgttcttggcacctttgttgaaaatcagttgaccaaaaatgcatggattcaagctctctattttgttccatttgtctatgtgtctattttatgcaagtaccatgttcttttgattattatagctttgtagtatatattgaagtcaggtagtgtgatgctttcagctttgttctttttgcttaaaattgctttggctagttggggtctcttgtgcttttatacaaatttttaattgtttttctatttcagaaaaaaatgtctttggaacttttatatgatttgcgctgaatctttagagcactgtggatagtatgaacatgttaagaatattaattaatccaatccatgaacatggggtatctttccattttttgttcttcttctatttctttaatcaacattttagagttttcagtgtacaaatatttcacctccttggttaaatttattcttaagtattttcattgtaaattggattgttttattgatgcctttttcagatagttcattgttagygtatagaaatgcaacagattttttatgttgattttgtatcctgcaactttaccaaatttattagttctagcagttttttggtagagtcttcagggttttctctatataagatcatgtcatctacaattaaraacaatttaacttcttcctttccactttggatgtcttttatttctttttcttgcctaattgttctgtctaggacttgcagtactgtgttgactagaagtgacgagaatggacaccctactcttgtttctgatcttagagggaaaactttcaacattttactaatgactatgatgttagctgtaggcttgtcatatgtagatggtagtgttctgaggtacatttcttctataactattttgttgaaaatttttatcatgaaaaaagttgaattttgtccaatgctttttctgcatctattgggataatcatataatttttgtccttcattctrttaatgcaacgtatgaccttttaagatttgtgtgttgaaccatccatgcatcccagtgataaagcttacttgatcatggtgagtgtgctgttgaatttgatttgatagtattttttgaggatttttcacatatgtttatcagggatatcagggatatcatatatgtttatcagggatactggcctgtagttttcttttcttatagtgtccttgccttactttggtatcagggtaatgttggcttcatagactaagcctacaaatagaccccttattcaattttttagacgagtttgaaaagtatcagtatttattatttaaatgtttggcagaattcagcagtgaaaccatctggtcctgggcttttgtttgatgggtggtattcaattctggattacatctccttattcattattggtctgctcaggtttttatatttgtgttggtaggttgtatctgtctaggaatttacccatttcttctaggttatccaattctttggtgtataattgttcatagcaatctcttatggtcctttgtatgtctgtagtatgagttacagcgtcttctcttttatttctgatattattcatttgagtcttttctttttttttagtctagctaaatgtttgtcaattttgtttaccttttcaaaaaccaactctgtttagtttatcttttcattgtttttctagtctttatctcatttatttctgatctaatatttattatttccttctttctactaatcttggctttagttttccttttttgtctgaagtttcctaaggtgtaacattaggctgtttgagatctttcttctttcttgatgtaggtgtttattgctacaaactcctcttctttgaactgcttttgctgtatcccatcagttttgttatgttgtgtttccattttcatttgtctcaatatttttttaaatttccttttaatttattcattggcctattggctgctcaagagtgtgtttaatttccatgtatttacaaaattaaaaaactcttcttgttattgatttctacttttatatcattgtggtcagaaaagatayctgatataatttcaaccttcgtgactttaagtttgtagcctaatgtatgatttatcttggagaatgttccatgtacaagtgagaagaatgtatatttcactcctgtagaatagaatgttctttatgatgctgttaggtctatttggtataaaatatagtttacattttatttgtctttgtggattttctgtcttaatgatctatccagtgctgaaagtagggtatgaaagtcttttactattattgtattacagtctgtctcacctacaaatctattaatatttatttaatatatatttggttgctcagatgttgggtgcatatatattagtgtgcaattattatgtcatcttaacaaattgactgcttcatcattatataatgatcttctttgtcttgttttagtattcaatttgaatttatctcatctgatataagtatagctactccttccttctttggtttgcatttgcgtggaatattcacttctatcttgtcattttcagtctatatgtatccttaaaagtgaagtgagtgtcttgtaggccatagatacttgagtttttttttattattattcattcagccactctgtcttttgattggagaatttaatccatacttaacataactatttatacttaatataattattgctaggcaagtacctactacaactattttgttcattgttttctggttgttttgtggattattatctattattattattattattattattattattattatttttggagacagagtctcactctgtcacccaggctagattgcagtggcatgatcttggctcactgcaaccttcgtctccggattcaagtaattctcctgcctcagcctcctgagtagctgggactacaggcgcatgccaccaagcctggctaattttttgtattttaggtgagatggggtttcaccatgttacccaggctggtctcgaactcctgaggcaatctgtccacctcggcctcccaaagtgctaggattacaggcgtgagccaccatgcccagcctgctttgtagattctttattcctttctttctctcttccttcgtttgtgattaagtgatttcctctagtggtatgctttgactcctctttagcttttgtgtaaatactataggtttttgctttgtggttaacatgaagcttacaaaaaatatcttatagttataataggctgttttaagctgatagcctacaaaaactctgtactgtacttttactctaacttctcattttcttttcttttcttttttttcctttctttcttttttttctttttttttttttttgagacagagtctcactctgtcacccaggctggagtgcaggggcattattatgtctcactgtagccttgatctcctaggctcaggctaccctcctgcctcagccgtccaagtagctgagaccacaggtgcgtgccaccacacatggctaattttaaaaattatttgtagagacagtgtatcactgtgttgaccagagtggtcttgaactcctgggcttcaatgatcctcccacctcagcttcccaaagtgctgaaattacagatgtgagccactgcacccagtctcatattaaattttttatatcacaatttacatctttttatattgtgtgttccttaacaaattattgtagctaggctgggtgcggtggctcatgactgtaatcccagcactttgggaggttaaggtgggcagatcacgaggccatcctggccaacatggtaaaacaccatctctatgaaaaatacaaaaattagctgggcatggtggcacgtgcctgtaaccccagctactgggaaggctgaggcaggagaatcgcttgaaccagggagctggaggttgctgtgagctgagatcacaccactgcactccagcctggcaacagagagagagactccatctcaaaaataaatatattgtaggtattatttttaagttttgtcttttaacttttatactagagatgtaagtggtttacacaccaccattacagtattagcatatactgtattttgactgtggacttattttaaccgtgaattttgtattttcttgtgtttttattttattagttagcatcttcttctttcagcttaaataattccctttagtatttcttgtaaagcaggtctagtggtaatgaactttcttagcttttgtttgcctaggaaagtctttacctctccttcatttctgaaggacacctttgccaaatacagtattttggtgggcagtttttttcttcagcacctttaatatgtcatttcacggtttcctggtgtgtaaggtttttgccaaaaaagttcattgctatctttattgaaactcccgtatatgttatttgcttctgttctcttgctgctttcaggatcctctctaagttcttgaatcttgacagctcatgttggtgtagtcttgtttagattgaatcttttgaccttctggtacctgaagatttatgtttttcatcagatttgcaaagttttatgctattatctctttaaataatctttctatccctttgtctttctcttctcctctatgaatttctgcaactcaaacatttgctcttttcacagtctcataaatcctgtaagtgttccttattacttttcattcttttttctttttccttctctagctgtattttcagacaacctgtctgagttcaaattctttcctctacatgattaattctgatattgatgctctttgttgcattttttcattttattcattgtatttttcagctccagaatttctgtttctttttaaaaataatttcaatctctgttaaatttctcattttggtcatttattgtcttcctgatttcagtgaattgtttcttggtatattcttgaagtttgctgagattccttaaaacaatcattgtaaattctttgtgaagcagtttgttatcttcattgctttggggtgagctatgaggagattattgtgtctttttgatggtgttatgtctctttggcttttcacatttcttattaccttgcatttatatctgtgcatttaaggaagtaaggacttatttcagcctctgtagattggctttgtctgggaaagcctttcaccctacttagaaattctaggaattacatcttgcatagaccaaagaaaggcttgctgctgaaggtgcctaggataatcagtgggcaggtctatgctggggcaggccttgagccagagtctgcagggatctacaccactggtgcagccatcttcaggcacttcagtgagcctgaagaccagtgcatgaraggcagcttggtactgggatgagactgaaggccagagccactggtagtagtctgggttcactgaggctgaagtagtgctggggcaggctgaagactgcatctgtaagggctggcctggagcctggggattcaggattcagcctgggttcagtgtgagcttggaggttcagaccatgtgtaccagctggagtatctacaaataaggaaactgctgattttatatagagttttaggaaacatagttcaggcactacagactttcagaaacaggagtgtatgaatagtttagcatttagccatcaacacgggctttctggagggggctgcggctgattggctggccttcagatgtgtaggactgccactgatgggctagctctcagaaatgattagtgatataagtaatcaatggccaattaggacaagttgaaacagttacttcttactactttctttttgtttgtttgttttcttgtttttgagactgagtctctctctctgtcacccagactggagtgcagtggcacaatcttggctcactcactgcagcctctgcctcctgggttcaagtgattctcctgcctcagcctcccaagtagctgggattacaggcgcacgccaccacrcccagctaatttttgtatttttagtagagacagagtttcaccctgttggccaggctggtcttgaattcctgacttagtgatttgcccacctcagcctcccaaagtgctgggattacaggcatgagccaccgcrccctgccacttcttactgttttcaaagaacattagtattttctggaatgataagagctttttaattttttctattttactctcaggactacaagtagaaaaataaaagtaaagaaaaggagaaggaggtgcaaaacatggggagagcatggctgttatgtgtcaggcgtgattattggagcgggtatatttttttccagagagcacttcaccttggctcagaatattagtgtccagcatcacagcactgggaactcttctctggtcactgtctagaggtcacccgaggaatgtgtgtgacctctagaagctgaaaagacaaggaaataggttgtcctctccagaccccagaaaggaataaaggcctactaacataatgactttaggcagwgagacctgtgtcacacttctcactgacataactggaagataataaaatacaaaaataaaaataaaataacttttttgtttctcattagtatctggtgaactagaaaattaccaaatgaccaaagaaggagaatcagaagagcttgcttctagcttgctatgatgtgatgtaccaagtaattatgacttaaaaatattaaaaacagaaacagagttctgataatgaaaaaaagacaaaagaggacaaaaagggagacttaaaggaagagtcaaatatagggaggagaagtgaaagaagatttcggaggaaaaagtagagaagagggcagcaaccagggtgcagaaaagagggttattggggcaaattaaaagttcataaatcacaattttgccccgggagcagagcgaccagcatgtgaaaatgagaagtgttcctatgtcatgtgtttctcaggagaagtgccagaaagcccggaagcaaggaaggaaagtgaccaagcatgtggcaaaatgggtaaggctgcctgagggctgtgggatggggtggctcagtgggccccacagaccctgggaagagtggaggcaggtgctccagtccgcccagaatcctgttctgtgcatttgcctcacccaagcctttggggaactgcagagaggcaagagatcattataaagttttacttatcaagatgggctctgttgattacatatggatgacgtcatagaatggtgctgctctttaaagtggcagttatcctgtttattgcattaatatgttaagtcacactcaatattccatggaacccaagataacccagtgaacttctgctagtagataatagtgtcattttgctacaccttagaaaggcctcacccaaaagacaactaatcctggtattaattgtcaggggggaagactgcaggtctactcttagcccaacacgtatttttgatagaagacccagggcccatcctagactcctagttctcagttcagtgggtttttggttcctctagaagaaagagagaaatgagtaaccaaacatctttataaactcaagccttctatagtatgaattgtcctaaaatctataacttttatttattaatttctgtttcctcactaccacttgttattttctagatactgtggatattgcaaacaactctactttgggaaaacccaagaggaaaagaagtaagaataaataagaatttacttgcttttgatgttacaaatacatttttaatgccagagttttctttttgtcattgttactgtttctgttattatttgcaatactgtggtagagagaatgatggccaccccaaaaaaygtccacctcctaatccctggacctgtaatctgctatcttacatggcaaacgggactttacagatacaattaatttagagaccttgaaatggggagatgatcctgggttatgtggtgggcccaatctaatcttgtaggctttaaagagtggagaacttttcctggctgtggagaaaggaaaatgtgactatggaagagtcatcagaaacatgtaatgttgcaggctttgaagatggaagagggaaccaaggaatgtggatgacctctagaagctgaaaaaacaaggaaatagtttgtcctttccagcccccagaaaggaatgaaggcctacaccttgactttaggcagtaagacccgtgtcacacttctcactgacataactggaagataatatatttgtgttgttttaaaccactaaatttgtggtaatttgttatggcagcaattaagagtaatacrgattttagtacttggcagtggggtgtggctatcacatattcctgaaagtgttggggtgtctttgagattgcgcagtggaaagaggttggaagaattttaaatagagtgataggaaaatcctagatgaaaaaatggaaattaagtcaattaataaccctacaatggcctgtaagtgctcaagttaaaraaagagtcgsccgggcgcggtggctcacgcctgtaatcctagcactttgggaggccgagacgggcggatcacgaggtcaggagatcgagaccatcttggctaacacggtgaaaccccgtttctactaaaaatacaaaaaattagccgggcgtgttggcgggcrcctgtagtcccagctgcttgggaggctgaggcaggagaatggcatgaacctgggaggcrgagcttgcagtgagccaggatcgcgccactgcactccaacctgggagacacagcgagactccgtctcaaaaaaaaaaaaaaaaaagaaagaaagagtcacatgtactcactttaaataaaaatctagaaatgatgaagtttagtgaggaagctatgtcaaaagttgacataggctgaaaattaggccttttgcagaaaayaattggccaagttatgaatgcaaaggaaaagttcttgaaggaaattaaaagtgctactccagtgaacactttaatgataaagcagaacagtcttattgctgatgtggagaaagtttgagtggtctggatgaaagatcaaatcagccacaacattcccttaagccaaagcctaatccagagtaaggtcttaactctcttcacttctctgaaggctgtgagatgtagaaagcttcataagaaaagtctgaaggtaacaccagttggttcatgaggttgaaggaaagaagctgtttcataacattaaagggcaaggtgaagcagcaaatgctgatgtagaagctacagcaggttgtccagaagctctagcttaggtcactgatagagttggcaacactaaacaacagatttacagtgtagactaaacagccttccattgaaagaagattctgtctagaactgtcataggtagagaggagaagtcaatgcctggattcaaagctccataggacaggaggagtctcttgttagaggctaatggagcaggtgactttctcttgaagccaatgctcatttaccattctgaaagtcctagggcccttaagaattattytaaatctactctgcctgtgctctataattggaataaagcccagatgagagcacatctgtttacagcatggtttactgaatattttaaacccaccattgagacatattcctcagaaaaaaagactcttttcaaaatatcactgttcattgacagtgcacgtagtcatacaggagctctgatggaggtatacaaggtgattaatgctatttccatgcctgctaacacaacatccattcagcaagcccatgagtcaaagagtaatttcaactagcaagtcttaatatttaaraaatacatgttgtaatgctatagctgtctttatatatagtgattcctctgatgaatctgggcaaagtcaattggaaaccttctggaaaggattcaccatttcacattgcgattaagaacattcatgattcatgagaggaggtcaaaatatcaacattagcaggaatttggaagaagttgattacaacccttattgatgactttgatgggtttaagacttcagtggaggaagtcactgtagatgtgatggaaatatcaagaaaactagaattagaagtggaggttgcagtggttcccacctgtaatcccagcactttgggaggccaaggcgggcagatcacctgacatcagaagttcaagaccagcctggccaatatggtgaaaccctgtctctactaaaaatacaaaaattagctgggcgtggtggcttgtgcttgtagtcccagttagttaggaggctgaggcaggagaatcrcttgaacccgggaggcagaggttgcactgagcagaggttgcaccactgcactccagcctgggcaatagagtaagactccatctcaaaaaaaaaaaaaaagatgtggagcctgatgatgtgactgaatcgctgtgatctcatgataaaactgagtgataaggagttgtttattatggatgattaaagaaagtggtttcttgagatggaatctgctcctgggaaagatgctgtgaacattgttgaaatgacaacaaaggatttmgaatatattagttgataaagcagcagcaggttttgagagaatctactgtggtaaaatgctatcaatagctttacatgttacagagaaatctttcatgaagtccatcaacacagcaaacttctttactgtcttattttaagaaattgtcacagccacctcaacatttatcaaccaccaccatgatcagtcagcagccatccacacccaggcaagaccctttaccagcaaagaaattatgattttctgaaggctcaaatgattgtgagcattttttgagctataaagtatttttaattaaggtatgcccattgattttttaagacataatgctattgaatacttaatagactacagtatagtataaacataattttcatatgcactgggaaaccaaaaaaattgtgtcttgctttattgcaatattcacttcattgcagtgttctgaaaccaaacgtgcaatatttctaagatatacctatatgttttatcccaaagatgtttgaaatttttatctgatcaaatctgtcagtcttttcatttatggtttccaggttttgtgtacaatttacaaatatattatcctcctcataatttgaaaacatttttacttgcttgtagaayatttgaaatactttttaatgtttaaatctataacacacatagaattcatttattggtgtatgatgtgagatgataattaagagatataaccccaatacttttttcttcttgatttgaaacatgattttatatatattttccaatatacacagatctgtgtcttatcacatttctttatccattcatctgttgatggagacttaggttgtttctatgtcttaactactgtgaattatgctgcaatgaacatgggggtgcagatatctctttggtttcatttcctttggatacatacccccaaattagatttctgaatggcatgtttttctatttttaatttttggagaaacctccatactcttttctgtaatggctgtaccaatttacattcccacttacagcatacaggggttccttttctccacaccctcacctatacttgttatctcttgcctttttgataatagctatcctaataggtgtgaggtgatatttcattatagttttgagttacatttctctcatggatggttagtgatattgagtgcttttttataacccattggctatttatatgtcttctttgggaaaaagtttattcagatcctttgcccatttttaaattaggttatgacatgattttgttttgttttttgctattgagttatgtgagttccttatatattctgggcaataacccttatcaaatacatggtttgcaaatattttctcctattccataggttgccttttcatttttaaaattatttcctttgctgtacaaatcttttagtttgatgcagttccacttgcttatttctgcgtttgttgcctgtgtttctggtgtcttatctaaaagataattgcccagaccaaaatcgaggagtttttccctgttttcttctttgaattttatggtttcatgtttgacatttaagcctttaatctatttggagttaattgttgtatatgatgcaagccaaatatctaatttcattattttgcttgtggatattcagttttcttagcaccacttattgaagaggctatcctttctccattatttattcttggcacccttgtcaagattaagtgccccttcttgacatttgtatttatcacactgctggaagtcctagtcagagcaattaggcaagaaaaaaaagtcatccaaattggaaagaagttaaaatgtctctgtttccaggtgacattatcttctacgtagaaaaccctatagactccaccaaaaaactgttggaactaataaatgaattcagtaaagttgcaagatttaaagatcagttgtgtttctacacactaacaatgaactatccaaaaagaaattaagaaaataatcmcatttacaatagcaacaaaaagaataaaatgggaacaaatttaaccagaggtgaaatatttgcacactgacaactatgacactgaygaaagaaattgaaaaagatgcaaataaatggaaagacatatcctgttcataaactggaagaatattgttaaaatgttcataccatccaaagtgatctggatagtcaatgaaatctctatcaaaatttcaatgacatttttcacagaaataggaaaaaggaatcctaaaatttgtatagaaccataaagacccaaatactaaaagtartcttgaaaamaaggaacaaacctggaggcatcacaccgtatgattttaaactatattacaaagcaagagtaatcaaaacagtgctggcataaaaacacacataaaccaatggaatagaatagggaacccrgaaataaactcatgaatgtatgttcaagtaatctttgataagggcaccaacaataggattttctttatgtaaatgttccacattttcatttttcttatctgctttatagagctatatataaaacaaattcatcaccttaaggtataactgaatttgttttaacaaatgtgtgcagttatataaatacctycactatcatgatatgtatcatttccatcaccccaaagtccacttgtgttcttctcagctgtctctgattcttgacaacagctgatctgttttctgttcgtttgtcttttaagaaatgaggcctcactacgttgtccaggatggcctcaaactcgtgagctcaagtgatcctcatgcctcagattccagagtaaatgggaatacaggcatgtacaactcaccaacccaggttgttttttttaaatgctgatctgtttacatcactctagttttgccgtttctggaatttcatataaatgaattcatacagtattgaatttacttatgtttagcccctgtcaattaacataatgcttttgagatacatccatgttattgtgtgtgttcatagttactctatttttcatcgctgagaagtatttctttatatgaatacattacagatagtttattcacctgttggtaggcattgaggtgtttccagtttcagctattacaaataaagctgacaggaacatctgaacacaaatctttgggttgggcatgttttattttggggagtgaatgcccaggagtggtgctattgggtcatatgaacatacatgtatgttcagtattttgagactctgccaaaatgtttttcaaaatgattatgccctcttgcattcccaccagtaatgtgtgaagcttctcattgctccacatactcaccaatacttgatagtgttagtaaaaytttaatttttttataaagtctacatttaccatttttcctttataatctgtgattttgaggtcctatttaaggaatcttttcctaactcaagaacctatgttttcttcaagtttttggtgttagcgcttattkagatctrtaacccattttgagttagtttttgcrtatagtttgagctaaagattgatttcttttctttttttgcatrtggatactcaatcattccatcataatttgttgaaaaaagtatcctttctgcattgaattagttactttgacrtccttgttgaaagtcagttggccatatatrtttaggtctattacttgactttttttctgttccatttatctgtatgtctattcttatgccaatacaccatcttgattactacagttttacaaatcctgaaatcaggtagtgtaagacctccagttttgtttttcagaattgttttggctatttcagacccgygcattttgaagattcttctatcttgcagctcagctactgtcaagattacatcattgtccaaggtgcctgctaagctccagccacaatgtccatgttctaggcagtcagaaggagaaagggtgaagagcaaaattatcttccccagaggcctattacttttgcgagaagttttctccrgaactcccctcctcccacaatattctgctctcatcttagtggtcagatcttaaactggtggccatgtcaggtgtragagaggttatgaactgtggtttttctctggaaatatcgatgtctgcagtcttggaggtattctgttagttgatcaggagtggaaagtagatatgtggaaaacaatatgaattgacttcgccaattatttaaaatgtgttaaatgttcctttgcatcctaatgtgtggtcattatttgtaaatgttctatgccacttgagaataatgtacatttgagctatttgttaggctctggcttcactccatgcatatctttataaagcaaaactttgttgtttaaatatgggttcatagtaatttatttcctccatcaaatttgtatagaaacttgttaaattctcacacaaggttgtatatttgccaattcctycttattttgttcattttctttaaatatgttgagaccattaatgactttataacttcttagtggatttcttttcttttatcattatacagcattctgctttatmcatattggtgcttttgccttaaaatctcttttaccaagtgctaatgttgttatacaaacttttttttcatatttttcactcaatttatgttaagccatcttgtgcagctttgttttatgtctcttgtaacagcacttagcttttgcaattttatctgataatcttagctttttaatgaatttttatttgttttcatttattatgattccagatgtatatkgacctgtatcttctgtggtagtgttgaccattcttaatttgtgtttttttgtrtgtctctttcctgatttctgatggattgatataaaattctatattctcccttttccccctgctggtttggaaattaaagacaaaatttctgtaatcttattaatcwtgccccaaaccccagagatgacaaggatcttgtaatggtttcactacaaaytgaataccccatctctaccatttggctattattgtttaatatttaatttttaactataaattttgaaactattatttttacagttgatatttacttaaatcaattttttaaatcattttatgtactcwccattgttctttttctttggtttcactttttgtctagctgaagtgaattctttagtttttctagtgagtgatctctaagtggtaaattctctaagtgytgtatgtacaaatttgtctttcttttgatagaaatttttagctargttaaaaattttaggttgatatttatttattctcagtatagtaaagtgattactacattgtcttctggaatctatggtatggctaataaaaatcattcttttattgtaactataactttttggtaaatattctgtcctttctctctaaaagcttttttccccaatttttaatcatgaaaatttcaagcatgcagaagtcttgggagaattgtatactaaacatcaatatactttcacacagwttcacaawtaacattgtatcattcctgctttatcgcttttctatctgtattagcccatttttacactgctgataaaaacatacccaagactgggtaatttgtaaggaaaaagaatacaggtttaattaactcacagtaccatgtgactggggaggcttcacaatcatggcagaaggtgaaaggcacgtcttacatggcagcaggcaaagacagagtgaaaaacaagtgaaaggggtttcctttataaaaccatcagatctygtgagacttgttcactaccatgagaacagtacaggggaaactgccccccgattcaattttatctcccactgggtccctcccacatgaraataagggagctacaattcaggatgagatttgagtagggacacagacaaaccatgtcactatccatatatacatttttttatccrctcaataactcatggtcaagtttgaaacatttcagggttgcagacatcagtacccttccccctcaaatacttctgcatgcattctttttttaagayaaaatttacaatgaaatgcacaagtattaagagtaccattggatgagttcttacaaccacacttttctgcaccatcraaatctttatcaagatacagaacatgatcatcaccctggaaaggttccttatrtcctttctggtatatctccacccactacytatcagggcaatcactactctttgtttttccatgataacttaatttgggtttttaaaaaactttatataaataaggttttacagcgtgttctctttattgtgagatttatytcactcagcatgtttttgagattcattcatatcattggatgtatcagtaatttgttcgttttcattgctagtgtccattgtctgaatatactgaattttgtttataattctcctgatgaacgtcacctcaagtattttcagttttttgctattaggaaaactctcctcagcacattcttgtagaagtcttcctgttttttcatatctcttatctaaatacctaggagcaaaattgctgggatatagagtagacgcatcagttctttcccctcaagacccaagaaaaggatggtgcagaggaagcccaggtggatggtgcactcacaagtgtgtgctgcagtggaggaatgcttcactgaggaaacccatggggtttgctagctaggcgactgctagcaaacctgcccaaaccttacctccgagggagatattatctttttagctggaacgtaagcaactcacctctggggatattaagcaaatctctcctggggacatctcctctggaaaatttctaaggagggagatgttctccactttatactggtcagggaataaatttgccctataatctggaggctacatgatctctagcttccaaggctgcttgctattctgacatccttgaagcaataccctgataccgtgagtacagaaatgccatggagaatagcttctcaacaaattcttcccacatttttgcttctggcaaatttcctcatgaagacactaccccatcagccactctgattaatttgacccatgggtccagatatatttgatttgttaaatgttgtaggaacaaattgcaaatgtaggtgcagtggctcactcatgttatctcagcactttgggagaccaaggcagaaggatcacttgaggccaggagtccaaaaacaagcaaaacaaccaaaacaagcctgggcaagatagtgggaccctgtctctctacacacacacacacacatacacacacacacacacacacacatttcataaaccgtgaatgctttaggtctttaggtcccttatgaccagctgaccacctctaaggtacaagtcactttatgtgaggsaagcaagttaatgcctggctttcatacaataagcacaatccccagagcacacaaggtgttcgaagaagggaagtgtttacaattgttgagcttccctgagtgggatgtacatttgtcagggggaaggtgaacagtgcctcctcctacatggctcctggctgtctgtaagccttggggttcccagttctgttcgttgtgtccagtccttgatttgtttgtgtgtgtggctggggagaggtgggcatgtgaggggactgcttgaggacagtctgtccaatctatcctctttgtccatgacaccaaccaggtaacagtcaccccccyacccaccccaacaaatgactgagaacaggggtagggacwatgtctagagggttctatgtgggacctcagaagctgggcccagcccctgccgtctcatgcctggtgcggagaggctgactcagcattctcagaggtgggagcactggagcagggtgttttccttytggacwaaggatccagggtagttctgagagacagatatcaccaatgctcctgcttcctccatacctcctagggttggaggtgttcctgccttagatctctggatttttgctcttgcttcactgctgcaaaatctgtctgtaccattctggtggctgtaccttcatctttttctcctaattgtctcttttctcacttagatcttccatccacaaaattagatacaagtagagcaaaagcattttcattagctgtgtctggagtgaaatctgaatcccctgggcactcagaaggctgtgcctaccaggctgatggggaaagaatgaggcatcwtccctaggaatgaccagggtcacaacagaatcctgaattttcaagataggtctacagaacacttgcaatccccaccacttttgtcctggtcactatccgggaaggagatgatccctttctggggactgctcccttcagtgagcctactgccctcccatagtgtgcagacaggaggagatgagggacgtcagaaaatcagtgcattgtggagtcacttttctgataaagggcacatcagactgcaaatggtccagacagccagattcaggacactgatgagtttctggggtcaccatagcatccctggagtcagctgctctgcagcctgaaggagggctgacagtgtggagtcactgctattacttaatgaaattatatagaaattctataatgattatgtaattgcataatgaaaactctccatatcagagttcagaatatctcccaatttccagtacagaatattatccataacaccatcaacctcaaggaggatgtcctctcattgcacatgtgaatttacacaacaaacacttgaaaaagcaacatgaaatagcagttatcattcactttaaggtgccagcaagagttaattttccattaaaaatgttgtttcaaaggaaggtcatctcttatagtctctcccaagcccatggcccaaggctcatgcagaattaaaataggactctgtactcaacttccacactgctacactgatcataaagaattttgccccattcctgtggaccaaagtatgaaaaaatcttgtatactactagcatataaagctcaaataattatatktattcctctgtataattaactttattctctttggtttgaaggaaaaaagaaggggcatggctggagcagaatgggaaygagaacgcagaaaaacaaccaacaaaatggtaagcaggcaaagtgaagtagttacagcttttgagtttattaaggcgctgtccattgtattctggaaggcctgcagttcacgagggccaggagagttctgtacttcctgtatccgttaggatgtagaccaacaggctgtgacaaagaggcctgagaatgcaatggcttcaacaaaatggtttctaatgcatgtaatagtccagaggcccacagttaatagggaggtcttatcatcctcagtatgactttcttcagtagctcaagaaatttttattaatttggaaaaatgttcttaagagggttaagtgaagaaagcaaggtgtatgtgtatgtgtgtgcaactgtaaaatatatatatacatatatataaccatattttatgtgaaatatttatacttgtgaaagtatgtttttatgtatctatcaatccttacatagatatatgcaattatttatctgtgtgtatgaagagatataaagctatagaaaaatcagtggcagttcatttataaagatatatgcagtggttacatttagtcagtataatagaggtgatgtttatatttttatttgtggtatttaagtatatgtgttgtattaaaattttaaaaatcttcaacttttataatgaaaaaatggtctttaaaaggcaacatatgcaaaaagaaaagcctaggagaatatttgttaacaaatcaccatctggagacagccatcctcatctgtggctatctctagatgatgatgttttagaccattttattttctgaattttccataattatatatgttatttattttagtcatggtctaaggatttcctttctcctagtcaatgaaggctgtcttattttccaaatgatgctcagttttgaatcagtggatctgtatagtaagattttagagtcctattgaaaattgtttcttttcaccaatcatctatcttctgctcttctgttcttgccagtttaagtgtctgcccggcttgtggatgtacatttktgtttggaaagaaaaacaagtggttgcatttattttaagaatgggtgtttttggccgggcatggtggctcatgcctgtaaccccaacactttgggaggctgaggcggatggatcacttgaggttggagttcgagaacagcctggtcaacatagtgaaaccctgtctctacttaaaatacaaaatttygctggatgtggtggcgggcgcctataatcccagctactcgggaggctgaggcaggagaatcacttgaacccaaaaggcagaggttgcagcaagtcaaaattgtgccactgcactccagtctgggaggcagagaaacactctgtctttaaaaaacaaaacaaacaaacaaaaaacaagaatgggtgttttcaaattaaaaaattatttggactgagtcattataacattttcatttaagtctgtgtgtattatcctaacacattctaagagacttcaatgtacggttaaattctgtgtgtaatttagaagtcaacactccccaaagcagaaaatgctctggacacctgctcgaggggatccagagtgaaacccaggactccctcacttgcgtttggtccagcctgtgagctgttgttctgcccagttctattaatacattttcccttgcctatccccagataacagcaaagccgatggccagctggtctcgagtgaaaagaaggcgaacatgaatctgaaagacctttccaagattaggggtaagataaagttggtaccacttttcatttgccctgcaggtcaatgcacatgttgaggttttgaggagcctagaagctttattgtttactagtcaaacttagtmaatttcagagcagtgaaatctaaaaaacagcaaacccattagaagccagagttgtaagttgattgtattcatatcatagawcttatctgtccaagttctaaagttgttttcctctgtgttttatctgattttcctgggaattcctttgccttaaatcattggctaattaaaatggctggacctggtaaattgtaagcagaatrcaggtttattttcccactgccctttgaagtcctcctcctagataagttatttcttgtcctgagcaagccctatcgctttcctgttcccytttcacaacaataagagtctcatttcagtaattgagagtctttctgaccaagtattaaaactccaatgtcctccccagtttaaagcaccttccctccttcagcctgggcaagccttagtctggaacacatatagttggggggtgacatggccagtgtcttctcttattctgtcttggccctacccccactccatagctgttggcttggtcccatccaggattggggaggtgagagaaaggggtgagatcagagtgtggaagtgtcttgcctgacaggtgcagccgtgaaatgacattgcaagtggttgatgcacaatcactagctctttcttccatgagatgctttcatcaagtccactgcaagggaaggggaggggtcaggcatcacagcttgacttattttgaaagaaatagagcttttcttctacaacctgggtgtgagtgargggctgaacctgkcataatcagttccaccaactctttctatggtcccataggtggactggtgcattgtcctaggatgcgggygcttggaacttgggtaatcaactcaacctacttgcttgggactttctcaattttgccagtgaaactctcatgtcctgggcacccccttagtcctggacagaccaggacaattggtcattctacttggtacttattggattgttcccaaccattgggacttgaagtgaaattttgagaaaacaggaggaaattgaaaactctgtcacacttctttctagaggttaataccaaccataacaattattttaaaacaactttaaattatattctgaccaccatagtatttattaaggtttrtgwtagggtttcagtattgttaaatgggtattacagcctgagacacaataatatttgaatcctgccttgctcagccacttgattctgagagtaaaacacagtagtgctgtattatgaatttgctggatttaagctccagwttgttctgtaccaaaacctccatagactagagtagacttcatgttgtttcttttttctccctaaaaatatgaggcctaaacagatttaatgaaagctaaatccgacatacccactagtcccagaaaagatgtaacyagacagaaacagctagagagaaaggaagaaataactctgtattagmtggactgttcaaggttgtggccagagctctagtgccaagcctggctggaatataggagggaaaagagcagcaaggatatgacatctggatctattctcactgtacggtgagtgcggaccctcaggagaggagggaggggtgaagcattgaagaggagagacctggagatgtcctggacttccagagtccacttggcatcttgcgtgggagaggaggggaggagagcttctcagagagccacacctgtgtggctgatgttctattgcctggaaacctcatcttccagaggcaggcagcaagatggagcaaaaagattaacatgcstcttggagaaccacagttccayctctttagtagtttttyttagcccttggctgttactatacaagcctcctacctccctatacaagtttattaaactcttctaaagctcttctttgagtgcctgttatcttggttaaatattaacaggatgacaacttgcagatttgaaacttgtttgatcttgggataagatgtctgtaattatcaatattggttccttgggccrtttgggtcttaaatgggtaaaaacctggtcagtaactgtgtagtctaaagaccagaaagtggaattatattaccaagccataggtctactttgggtccgattggtcctttctactttgctggcctaatatgctcataatatgcttagagtttagagcacttaggaataagtaggttggaaaatatttttccatggggcctacatgaccctgaccagcatccctagatggtggtcattggatggtggacatccagcacaagraggaaggaacattttgctttcctgctttggaaaataaaacacatttgaacattagtaaacattgagatgcccactcacagccaattaacatgcacttgggagaacrtcgtcggctgcagtgtctgccatgtcaatccttaattactatttggaatgaaggctgtggaagtctcaattctacccattcctcatggttaaccttcttctgatyagtttcttagatcctaatatttattttttccaaagccatgtgaacgaagccctggtcacatttactattactttcagcacaagggtacaaatatcttcccccaatgtgatatgtrcagcatacatctcacctatggagcacctaatagggtttcccttaactcacagaactgccatttatttgtgtctctgctaagagaaacccaaacaccttcacttaattttgtagttttgtctcaattttctctgaatattttagtstctgtaatgacagtaatcatcattttgatcttgcaaagattaaattagtggatgtgtgtttaacatatattatatgccatatatatatttcaaatatatatttgaaatgaaatatgaaatgaaacttcaaaatatgaaatgaaccttcaaaatatggaatgaagtatttatactgttgtttgagttatatgtgaaatactgatttcaattagtttttttctaatgtaagaataggaaaatgaaatataaagtgaacctaacattagctatctaattcttcataccttaaaggctagggtttaaatctttttatttatatattaaacaggcttttggaaagttacatttaaatggaatttttgaaaagcagcratatatgtaacacagctgctcatttgtaactgtgattttattattctactttctcagggagaaagagaggcaaacctggaacccactttactcagagtgacagagctccacagaaaagagtmcgatcaagaggtaaaaaagaaaagaggaatgcactttcaataactaaacatctaatttcctgtgctttatgctgtattttcagtaataaacctatktctttaattgttttatgaagctatactaactattgaaaaacatatcttattaagtcattttccaaaatgtatcaaggaaagaaggaagtaagttggtgatggatctacaaccagaccctggggccccagggggtcactaaagtgctacttccactgaaatgataaatttcaaggctgaagataggccattgctgtataaagggtataaccygtaagtratttagctgatcttcctctggctacacagaaagccacatgttgcacactaaggttgaaccagmgttgtggttagagatctgtgtcctaaggctttttggctttttaaaaaatctttgactgtgtgatcttgtgctgaccacttggccttctttgccttggtttcctcatctgagaagctagaggatgaattaggccaaccacccttcttattagtccatcccagtctaaatagtgtgcccttttcaaaaccagtctcaggaccaaagaccgcttcccctgcccatcatggcctctacacctctgtttggaagggcaggattagctgctcatcctcctggagtttttctttgaaaaactttcacacctacttctgtagtatccggttctcagttccccaccccctgctwggtacaattttcagattattctagagctccctgagctcctttctcagctgtggagaaagctgataggaggggaaaatggagcaaagcagagaataaaagtagaaggcaggtgctgtctccattaggttatctcatcattagcctctccctccttgaccagtcagtgcccaaatgggagactgattatggtctctggcttcatctctggctacctaactgcagcaaaacagaatagctggagagcgcccatcaaaccaatgacaacaactgtatgtttcattgtcatataagaatcagtggagcttacyacactggaagttaaaacagttttactgaagtctaatttctctgataaagcattcaattttctgtgaaatktgaaaggtgaaattggggcacacattctgtagttaccgatcaaaaatgccacttggaagaaagactttgaaactctagagatttatggaatagaatttcctaagtactctttgtgcctttataggatttacctcagtgggaaggggggatgtgcctttgcaaagtgagacagaatgaagaaatcctctctttcagcttcaagaaagcacaaagatgaaactgtggattttcaggctcctttacttccagtgacctgtggtggggtgaagggaattttacataaggagaaattggaacaaggtgggtttcatagtcttctttaatttgcagctcctatctgaaggcatcacaagaagtggtgaaattatttgtgtgaattacacatcattcaaggagttttgggcccagtttagcttgagggaaggaggaagggatycctaagatgacattttaagactttaagaaatcacacccattagaygctgactcgcacatggagtgtccagggggtacccaaagaacaaaagagaaggcaggaaygtcaattcacagatggaaaatgtcaggtattttactttgaatcagacagaaaagggaagaggccctcaacctcaagcttcatattctctctcccttctggagtgctgtcaccaaggcagggtgcttggcttgggtgatgatcacaggttttaacattaggaagcctgagttccagccttggctgtgccaggaatgactgttccattctgagtagagaaggggacctttctgaatgtgaaatctctcatccaagagagggaacaataattaaaaacctacctcatgatgtagctgtgagaattaatttacatattaatgtaaaatattttacgattgaaaattataaaactgtcaaaaatgtctatcagaatggccttcatctcagacctctcttaacttggctctttgagcaccaattaatataaacattttcattgtgactttttttaacagcttaactgaaatacagttcatgtatcatgtaactcaccacttagagtataccaatcaatgattttttttgtattttcacaggattgtacagccattattatcacctaattttaraacaatttgtccttcactaaagaaaaccccatgtcaattagtagtcaatgcccattcccacctcaccccaatgcccagccctaagcagctgctaatctattttctgctctataaatttgcttattctaggcattttctgcaaatggaatcctatsatacatcccctttcatgactggctgcttttaatcagcatgwtgttttcaaagttcattcatattgtattartacttcatttcttttcttgataaatcatatatttcattgtatagatataccacattttgtttatccattcatcaacttgggttattttcactctttggctgttataaataatgctgttttgaacatttatgtaacaaatttggtgtgaacatatttcagctctttggagtgtatattcaagaaaggaattgctgagtcaaatggtaattctattcttaacttattgaggaaacaccaaagtgttttccacagtagctgcactattctatattcccaccagaaatgtatgaaggctcccatttctctacacactcaccaacacttgttattgtttgtcttttttattatgatcatcctagtgagtgtgatgtggyatctcattgtggttttgctttgcatttccctaatggctgatggggttgactatcttttatatataacttaatttttctattaggtaacatttcacaattaytttttaatatcagctgcccatgattgcacagatgaraaaatctctgttcaataatgccctaaaactgaatgaaaaatgttgtaatagaaggtgcatatgttgccagtgtggcctcctgagccacagggcacctatctcagactgtacccctaagtaaggattctgcctccacattgcctccagagccatctgcagactcaggcctggtctctactcccagaattcaacagcaagttggagtcctctcatctttcagaatcacttgcttttccttctgtaagtgcttttgaaatgcttaaaaggttgctcttgctgataaccatcactctcctcatgggtgaaggtcaaagacatgtgcacccccaccaggaaatatacttagaggggactttcaggctggatttggggcctctgaagtctgagagggaaggccagaccctcctgctattgatcttcatcacaaattgggtggctctagatccaatgtggtgagtggccacagtctgagyrctgggaacaaagagggctcaggatcaagttaccctggtcttacaggaaccttggcraagtgtatacagactgaggatggaaaatggttcacccccatggaatttgaaatcaaaggaggctacgcaagatcaaagaactggaggctgagtgtgygctgtggcgggtggcccctacgacggctgatggaggtattccaatgacaagaggccagacctgtgcccattcttcttgttccctaataatgaggagactgtttattcaccaaatatttgttaggttatagctaaagccttgatgccagtgagtttatcctctcactcaggagagagggaccccatatccataaccacactacagtgcaacacactgatgttgtaccaggggctccatcaggatagactcagcagcttggaggaggaaagggtaattctgactagggtgcatgtggacaattttgtgcactgagaaaaagaagagagtcgatagtcaagcagggcaagaagacacttcagagaaagaatgacctgaaaaccagaatggcatgaaaacaagaaccatagtaaaaatattaacagctctgtggatttaggtagatgggttgtgtacaataaggcacaattcagcaactggggttgtctgtggagcactttaatgccrggctaagtaattcaaatctgtaattgatagcaacaatcagtgaaatcttctgagattggaaatgacatttaaaacagtattttagacagcaatggggctttgaaatgccttcactgtctcccctgctagcaaacctatactcagtctagaatgcttagctcaaatgttaccctcttccttaaatattcactgacctatagccatgggtcctcccttcccagggttcctgagcccctactaatgcccttttttcactatttatatttatccttctgtgagtgctttttgtctgyagacccctttaggttttcccatcttcatgtacccaagattgatcagagtgactgacacccagtagcatgcaataagtgtrtgctgcttggatagctctggtgtaggractccagctggagtggcactggtgcaactggaaaagaagtgatagatggtatgagattatgaatgaaaacctcttaggacttaggaaagaagcacaagagaagggaaaatggtcctgaaaatgattttctggcttctattgattggagtctagaagcacaggtgaagacagggagatggtttctcattcagacacactgggtttgagctggcattggaacactcaggtagaagtatttgggaagaggttggaaatgccagactcacaaaacagaaacgcaggctgactatgtaccttggtctttttatctttcaggaaggatctctacctaatcctycaagaatatattacaggaacaaaaaggtgattattacataattttctacagattcttgtcacacaacwgatttaacatgtacaacatcttattttatggagtctccaattgggtaactataattaagctttcaccttctccacttcccacatataaatwtttttaatatacrctttcagagttactactttgaatactttgtgtatataaagctaggtcctctttggattaaaccgtatcagatggagatgctgaggagccctcaaaacaaacctcctgaatgtgtttcagcaatagatrcagatgttgtaagagtgtcaaagttggaaaatccaacacggtcatggaatacataaaaatatttcataataaggtgagagtatcatctccaactcaaaatcatatttttttcattgatgttattattttctaacttttgtgaaattgatagagcaaacgtctcctcacagtcacttgagacatgtatgaaaccatatatcatttcatgaaataggtaataaaaataatatttcttttctgatctttcacatcctctttcaccttccaaaaaaatgtacacacagatacacagaattctttctcaatgggaaattatttacctttgtcaagatggtgccattggggaggaagatctccagargcaaacgtattttacaggaggagctgaccaggaaaatcttttatgttgatgccacctctttggttctaccagagggactgtgcagacctgctttttatctgtgaaagtgatttttccttcacttaagaacgcaacaaacaaataggttaagtgcagtgtagattcaggacaaggtgatggtttttcsaagactgggtgtgaatgagaacctgaggaggggaaagagaaaaatgtcatccttatgcacttcaggtagaaatatgcattcaagacattcacagacttctaaaacagctcacacatagctagccactaagcttcatattccactgggaacctgagatccaggcctttacattatctgatatactggctratttgaattctcagccactgagacatttcatccactgggtttcccgaagggaaactatgatgtcacctattcagtgagtacactaaagaccagcaactctacctttccccaggtgccaagagtaactcagcctgggtgacccaaatgagctggcaatttccaaccaaccgactctccctctattcaggggtgcaacacttagcagcaacaagctacagttgcctctatatgttatgtctcctcatggggagaacagaggtcccctgagtggcagatccaggatccattatgaactccatgggtcctctgtgcctctcagagcttctcttccttgcagagccacttggcttctggaaacttcagtgtcactatcagtgccacatgataatgtctctgctcaggctcatgacaagggccacataaaccttttggtggtagctgcggtgttgtaaaacaatctgatacactcacccagaataatcgttgtgtgctaatgcttgcttaagagactccagtaatttttttttttgagacggagtttcactcttgtcattcagactggagtgcggtggagcaatctcagcctcgcaggttcaagcaattctcctgcctcagcctcccaagtggctgggattacaggtgcctgtcaccacacctggctaattatttgtatttttagtagagacagggttttgccatgttggacaggctggtcttgaactcttgaaacaatattcatttattcacccattgaacatatacttatcaagcatatactaaattccaatggcattacagaagattgacctcaaaaatcatttcaagccaggcatggtgactagagcctataatgccagcattttgagaggctgagatgggaggatgacttgagctcaggaatttgagaccaacctggacacatcgtgagatatcatctctaccaaaaaaaaatagaaaaatacccaggcattgtggtgcatacctgtagtcccacctactcaggaggctgaggtgggaggatcactcaagcctgggaggtcgaggctatagtgagctgtgattttatcatggcattctagcctgggtgacagagtgaaaccctgtctcaaaaaaaagaaaaaaaaattgtttcaattttattgtaaacatggatgaattacaaatgggtggagtaggagatttaggctagtcagagacgcactcagtgacaaggtcacctctcaggtgcttgtgctttagatcacacttgtttatagccctgtgccctgggctacagacaaaagctgaggctgcctgtatcccagaagggaaaggtgccaactcctgcaatggatatccaaaagcaatctaaataaatctagtgggttacctcttaaaagacagtcaacctgacatcttgtgatttggatagaagggagagcaggagactctcaggaagaagagctgcagcacagaggaccttggagkcattttatcaccagggctrtgtccctaggggagctgcagaaagcagtgctcttctctgggacactttcatggcctccaggacactgggccctgtggtccctgtaggctgtgggggataaattctcagcctgattattattgcaactcctctgggtgggatgacacaaaggccaagtttaggaaatatgcctgagggccccttggagtaagaggacaagtagagcttctctgacttggcctgggcaaactaggtccagactccctgcagggaatgggacttgcattgggctgaacagtagtacttgggcactttttcttccctcagtagatatataggtccaaaaaatcagatatgaggtaaagggaagactgtttaaaaaaataaaactttagacaaaataaatttaatagcatttattggagcaaagagcaattcatgaattgggcagcactcagaacaagaagaggttcagagagctatgctgtagcagcccagayggtgaggccaacacaggagtaagacagagaaattatatttaatggattatcatggaaagatgctaattagaggtagatgacggattccagttggtaaattctctagtttcattttactgtttacatcaggtttcagtttgcttacataggaaattaaagcactggagccaccccagcctactggccttcatctcctcccaattatttttttacaactggttcctgaatcccttcaaagatgactatttaaatttaagtaagtgatagatggaaacaatgcattcaatatcataaatcaatctttctgttttttcaacagagaatactgaagtctcaaaacaatagctcagttgacccttgtgtaagtataaattctgaactacaacccccagaatattccacttctttctccaggcatatgttctgtgtcatgactgctgttgcctgaagcatgttcagtctcagttrgagtatgtggctgtgtgaattcagttgcatcacccaagccaggtagatgtgcttgggccttggatgtcttgcagtgtgaaagcactctttccatctgtttcagtggaaaccctccaatatccttacttccttattcccttgggtagtgagtatgggaggctgagctctagaccactgaggtctcttgaaacagagcttgaagtggtaatggatagggctggcctggtgattaaggggaaggagtaaatgtgagaggataacagcattctcaagtaaggggtatggatgaaagggaaaatcccaaaaatgcactccaaggtgcaggtggagcraagatggtcttaagcatcagccagaaggaacagaccargccaagctattatgtttaaggtgtggagcctgtcattaktcctgtaaaggagtacatacaggacaagaggtcctttacagagcccctatcaccagtctcagggaagccattagggtgctgagctggttaggactgaaaccatcacgacctagcaaatcctgaggcattttaactcaactgcttatctggtgctcagtactatgcaaactttctgatcccctgggccccatccattctctgcttgctatatgactgcctgctttgggttctgctgaaatcatggatgagttctttctttaaatgaaattctggtttgctccttttcattgcagtgagatgccaattttaggcaaggtcaccttcttgcacaactccagggggcaggactcacatagaatatcatgcaatagcactgacacataatagttarcagaggagggatgctcaaatagttttatacacaccttacctccaaagcagtcctccaatcagatttaggtcttttccacactgattttgatgcccggccaactcagggactcacgaatggttaaaacagccctggaggtcagtgtttgcgtggctgmttttgtatgagcttgacatggaggtttatgtctcacagcccacagccagatgtctgtgggaaaaagaggaaaacagatccagcaaaggtatggtcacccctattaataatttttccaaggccaataagaacattgatttataatatccccatgcttccataaccagactttgctcaggctgagtctcaaattatcttgcatcttggagtcacctgaagagctttaaaaaatattgttgcctggatcccactttagggaaattctaaattaatcaatctggactatgtatgacttgaacattaggattttttcaaggtccccagatgatgctgatacatagaattgcctattctgtcacctaaagaagaataccagtgcctgtgcctcaaccctgacccagtgattcagaatctctggtgttgggttcaggacattagcattttatatactctcctgagatgagtctaatgtacagccaggccaacaactaaagaaccagagaaatcaaatctcttcttgaaaagatataagtttggagaaaaaaaagggcagataagaggcaggactaacttccacctccaactcagacagaacagcgtgttgagactcaattgtgaacatttgctacaagaaccaccacaggaacattccagcaaaacaaggaattcacagaccctttgaaagaagtggcttgccactgcaaactctgtgagacagccaaaaaactgtgagttctcaaagtgtgagagggaaaaagtccacctctgaacgtgtatcctcactggggaacctgaaaatccagatcacgggagaaggatttcacctaagctagagctgaaatgaatttagagagctgggcaaaatataaaagtagaagtagcagcagaaagagccctgtaggcactccacatagggccacatgggggctgcgctcaggaacagaggaaacagccagtggctgtggagggtgggctgtccccggcttccagagggagagtgtgattggcttgtttgaataattccatggctggcagggaaatgaaatcagctattcaaaaataagcagaaggtgcaagcggtcctcttgatcagaagtgttggtaggaaaccttatctgcaggagcagagccggcggaggacttgtagatagaccattctaggccttcccagtgttaccagatgtccaggctgcacgtaatattgaactctaattttagtccttacagcacttttcccttgaacggcaaagggctctgtcacagaccggttctttgtcatgaatacacatgcatttgtctacaatacagcatataatgtattggtctctatatttgctctataaattctgttggtttttaatgactgggatttgttccacaacacatggatgcaaatactatcatattttaatttccccaaatgaaattaaatcttgctaaaggtctcacatattgagacttgtragaaatggagaattcattgatttaccattccttttatagaacaaagcaccagctcttttatgggcccaggaaatgaggagagggtctccatcttcaacactgtatggtactgttaccatggtccttggtcattagagatgacacctttgcaccttacaatccaaattagctaagtcatgggagatcttctgccaggatcccagagccgaagagctctgtgctccctgtggcccacctggtcatgtgtactcatggtccttccccctcaaaggtaggtgcacagccctctaggcacaaaacctacagcctaggaacccctaactaggccctgtcttcaactcatggggaacttatggccaagaatatgggatgtgatgatatcttagaaggttattccatcatatgtaattctctgggtctccctttcatgagttgatttgtagtatagacaaatggatttaacactttacttcaaaacctggttttatctgcagcataatacaattattcagattcctataagatcatcctcttgctttgttgctaggctttctgtgtcataatctctggttttataaggaaaacgtttttattctgacatataccccttcctcctgaacttcactgcagaccaggatttgttctgaaatytccatgccatatttttccttcatatcccagggagaagcataygcctgtytatacaggctcacacataagcagtgtgttctagatgcccagaggggtggcyttcctgaatcttgtgattcccagtgacgtggacactgttttaccttctagatgagaaacttggatgagtgtgaggtgtgccgggacggaggggagctgttctgttgygacacttgttcaagagtcttccatgaggactgccacatcccacctgtggaaagtgagaagtaagtgacatgcaggcacctctctttcatcctttaagggaccttccacctgccatgcgcactctccagcagaatgtctgcttgtgtctagatggggaaggagcaggttcatcgggtactgggacccagcagtgtgatccagagagcagtgggagacgctggcagcaggaggtaaatgctctctgtgctctcagggacacctcctctgatatgctgaggccagtgttggggacctttgcctacatactggtattgtcctttccttgaagttttgcagtagggtctcctgtcccagggggttgaggaaaaaaaacaccagttgtttatattttgtgcttattcatacaagacaggaagcacggtctyaggcggatggaggcctgaygtccctggagttgaaagcccagtttctgacacacaggcctggcaggcaggactccttgtgctyccagcagctcagacagggaaaggakagtccccactcayggtgacaccaccttcctgaggcttccctcctgctgctaccactgatgcgagggaaaggccagtggctggagaccccatgtgcagttcttggatactctgggaggtgttcccctccctcccatgactgagcccatcagccattcctgaaggaagacagtggtagccacaggaacggtggccatttccaagctccctgccctctgctcacccatgtccaatctctcaggaccccgtggaattgcatcttctgcaggatgaaggagtctccgggaagccaacagtgttgtcaggaatctgaggtcctggagaggcagatgtgtcctgaggaacagttggtaaatcagatgcaaaccccaagccttctcctttcccctcacacgtgagaaccatgaacaagcgcaagggcaggggaatgtactgaaaggagcctgctcttccgcgccacacttcaatggcactgatagaacaccacaccttgtttgcacaaaaaataactcagccatgacatgtctgtttccaagagccacacatgttagagaaacttgaggaagaagggtgtgagtcgtgtgctgtgtctcatgcatgtgggctcattctctccaagctgcttttcatttacggcctctttcttttgcagaaatgtgagttcctcctcttgaaagtctattgctgttctgagagctccttttttgccaagattccatactattattatgtaagtaacaacagcaacccatgattacaggctgccatgacattacctgaccctgaaatgggccctcgtgagatttgtgatcttaatcccacggggcaagagcacacgctgtcgttagttgccttcaccttgttgtatttctgctggattttatgggaatccacagaaggtagacactgaactatgctggtagcttttccattggtatatttgtcaccagattagagaggcgtgtcaaggcctgaaggagcccatgtggttggataaaatcaagaaaaggctgaatgagcacggttacccccaagtggaggggtttgtacaagacatgcgcctcatcttccagaaccacagggcctcttacaaggtaggtggctcttcctgcttccatttcatttctttccatccttcccctcattttctggtgccaagaaaaatttagtttccctcatcctgtaataagcttgcacgagcaagggttctggaagtgattgattggtttcagttcagaacttaagctcttcttagcaaagaaacattgaatcaaaaggtgtccctgcaaccagaaccccaggtctctgagagctcctcccccacctgccccagaggagacaggagctcagagagagcaattgagtcctgcctgctgcagcatataaagagaagagaatttcatcttaaagtggtattgtgcttcttatctgctcccaatcccagaaatcccaaactccagattctttgcatgtgaatagaccatatcccaacaaggattgccagcaaggagtagaagtgacagagaaaggaacagatcagtgatcttaccttatacccttccactatctgaattgttgaaagaacctagattgcttttctaacccactgaaataagcaaccaaaggcaaaaaagtaataatcccarctgtggaaatgatttcacttttctgccctgttaataagaaaggatcatgctggtgagaaacggaagttactcttagctgcatragttttcaagtttaatctggttaatgttacttagrgtgtttaagataagagtcctacttaataatagtgtatttcacacttcaacattgttaagagagtaaatatcaaatgttctcaccacaaaaaatgatggctctttgagatgatgaatatgttaattagtttgatttaattattccacatagcagtcataaatcacaacactgctttgtactccaaaatacataccattataaattgtcaacttacagtttttattttttaaagacaagagtcctgatcattctcagttgaaaggtatctaatgacactaatgawaaggaacatcgtttttgtctttattacttttttccagtataaggattttggccaaatgggacttagactggaggctgaatttgagaaggatttcaaggaagtgtttgctattcaggaaacaaatgggaacagttgactggtttagtggatgctgaaggccttcaggaaatatgctactggttgccactgacttcaaactgagagcacttgggaaatagcacatgcagggagaggcttttctctgagcctccctcatctgcccaaaaacaaatcctcaaaagaaatttgatcatcatgaatcccatccccaagaatctcatcaaccagggaagaggaactgagatcacagggaaggagattggaggtgataccagcacagacagactctcacctcttctcctgaggtctgctccagacaacatttattactcacaagacctttttcctccrttttttttttgagatggagtctcacacagtcrcccgggattggaatgcaatggcgcgatctcagctcactgcaacctctgcctcccggattcaagtgattctcctgtctcagcctcccaagtagctgggattacagtgcctgccaccatgcccagctaaytttttgcatttttagtagagacggggtttcactatgttggccaggctggtctcgaactcctgacctcatgagccrccygccttggcctcccaaagtgctgggacgtgacaggagtgagccaccacacctggccactcgcaagaccttttatctgaaaaccagccaagctttattcacgacacacttcttcccttcactctcccacttctgtggtcaactccctgcagaactcccaaactgccgttcttttcgatagctcacgatggtgtatgagtgtcaatcatctgacccttcttggagtctcatatttcgtggaactcctgtgcaaacatatattattaaattttttttcctcctgtcaatctacttatgtcaatttaattcattcgtagctcagccaaagaacctagcagggtagagggaagccatttttccctcccctgcaaagcggttggcatcctggcaccatctcctcttctgaccaggtcttttcayccccagctgctgagtggtggctgctgatgccagcagtccccagagtattacccttcgttaaatggaatcagcttcacctggaagtgacgcccygtggcctgaggccggcccctttgcctcaaagcaggaccaagggtgtggtgtgtggctactctgtgctcccaggtatcaggctggagctagtctccagctgtggccacatcgtagcttagcttttgcccacatgatgagcttcccccactcccttctgagcgaaccctcaccatcaatctcttgcttaatggacttcatcccagaatgtgcttctggggaatgcaacctaaagtaatggccccaggaagcgagctctgaggacaggattctggagttggatcactgtctagcccagtgatgctgggtggaatatggatagtcccagaagtgctatcactgagcagttgcccaaattttcacctgtagtaaattggatgagctgcaggtcaagctattttagtacagctatgtactaaaatagctggtacaattgtctggcatttaagaagtgaggaaaagtaactataagaaatatgggttttggtgggtattactaagtgccattaatgtcttgaaaagagtaaatgacaggcttagatctattcattaccaacctaaagagaagagaccctcatacctggagctggaagrcagacagcaaggaaggtctggtacagacctgattttatgaatcgcagaacttcagagaacactgaattctaagctcaggatggtctcttatgccaaagtcaaggccttcaaactcagcatggggctatctaggtagatgtacatgagaactttgaactccagatgccccctgaacctactgggtttgcagaaaagtctttctgccccttgttggaagagagagctaccacccccacccaactcccgatttttctagaatgaagactgtatagagaccgctcaggacaatgaaagtgaacaatcatggggagggcagcaaatgaagagagcatttatcctccgaaggagctgtaggactggccagcgtgcatcagcaggagcaaggagattgtgtctgggagtggatcctggtccaggaagggtgaaatgtgaaaccagataagtgacgattattggcaaaggggcaagcttctctaccacagagtttaactagcctggcttgggccaaaggtgatgattctgatatactcctgggtggctcctagagactaagtataagccatggtacacattaaatcaagtggaagcagagataccagaactactgtggcagagtctggaaaagtgggtcccaaggatagagaagttggtgtgctagaatgactctgcactctacaactggagaatccatccatcaggtgactgagttcctccaaaggggacactactaatgtgtctcagacactaactaaggtgagaaggaatgcactgttgagggggcagcacatccttaagaagctcaatggtggctgtcccctgcaggctggaataatgctagggatgttttatagaactggatcccccagtagtgagtaaaatgatagagttccagaataacagaggccaagtggcagcatttaactgtgaggacaagataaagtaatttccataaggggcatcaacgttagagtgacaactgggaggcctgacctgtaggtgtccatgaagatggctcttaggacatgctgttcctctaggcaagacacatattgctttagacatataatcaaaagagattgaaaatagatgagcagaaggctgaggtcagctatctaaaggtaaagtcttagaccccttgcccagcttccaaacctcagccagttctcagtggaatccagaactcactgatggaaatgagggcagtttctcataaggaagaaccttgtaagtgtgcgcatcactgattccctcaagttttcacgggagggctctatggccaaattttttgagttactcacatgccggggaaaggaaaatacacagatctttcaagggatgttgagtacaatatcacagttgatgctaatccctgaggactcaaagccctttcgtagcccctgttagagtagagtacgtggaggtgaggtaatgtccatctcacaatgggccctctggatccacaggccacccagcaatcatttccccatttcctgaatgtataatcaggatatacattcatacatacatcataaaatatagcaattggctgacctggttccttaacctctggtttcctaacctatgaaataacaatgactgttttagggaaggccaagcagaagcctctgaaactgaagtttcatggtgaaaacaagtaagttaaaagcaatatcacattcttggggaatgatagagattagtgccacctacaaagacatggaggaggcaggggttgttaccccagttacacctccattttaattcagcagtctgccctctggtatctcctggtggttcatgctgctaaatggctcctaaaacttaaccaaggagtagcccctattacagttgctgtgtcaaacgtggtatctttattataacgggttagcacagccttagcaagtgatatgcaactattaatacggaaatgccacttttaaaggatccggcaggatgtaggttgagaggaaattcacattctcaaggattggacaagagtatatctttacagtcttgctccagggcaaggtgaatcctgctctgtgttacaatataggctttctggacactctgcaatacattacattggtcaactgtattgatgacagtatgttcatgagcctgataagcgagaaatgttgactattctgaatgacttagtaagtcataaacactgcagatggtgggagaaaaacgttacaaagatacagagatatgccatataggtaagctttcaggggttcaatggtctggaacgtgtcagagcatcccctccaaagctccaagctgttgcacttcatacctcctgccactaagaaacccagagcttggtggtcctctccaagtgaggagaatcaccgtggttgacattctgatgaaagtgattctaggctttgtaatgtggttgtgtgtttgggaggcagggagtggggaggcagtgggtataccatcttcataaataaaaatgtgctaatcaatgtttttcacttaacaatataagatggacattgtcacatcagtaaatacagctctacatcatctgtgccttacctttcatttatcctcaaaactggatgacagttggctctttgattatttttggtctggtaagcatagtaatttgtactgaggggcagcacagactagcattcagtagcacagcctctgtaagtggaagcccagttcctgcacttctccacttgctgacggtgtgtccttgggcaacctactcatccttcccctgtactgtttcatctgtaaaaaggagatactagtagtaaatagctcactggattattgtgaggattaaagagttaatatttattatgcacttagaaagtgctggccctccatgcaatacatatgtaataaacaagcaaacttaaaagattaacataaacacctttgtatcaattcaggctctttgctgtcaagaaaaacccaatatatacccaaaagaatagaaatcattctatgataaagatacatgcatgtgtgtattcattgcagcactattcacaatagcaaaaacattcaatcaacccaaatgcacatcagtgatagactggataaagaaaatgtggtacatatacaccatggaatactatacagccataaaaagaaactagatcatgtcctttgcaggggcatggatggagctcgaagccattatccttagcaaactaatgcaggaacagaaaatcaagtaccatatgttctcacttgtaagtgggagctgaacaacgagaacacatggacatagggaggggaacaacacactggggactgttgttgggggcaggggaagagagaggatcaggataaatagctaatgcatgcagggcttcataccttggtgatgggttgataggtggtgcaaaccaccatggcacacatttacctgtgtaacaaacctgcacgtcctgcacatgtatcccagagcttaaaattaaattaaatttagaaaaaaaaagaaaagaatccaatcacaaaagaccacataatttattattccatttatatgaaatgtttagaataggtaaatccatagagacagaaagtagattgattggtggttgcctaatgctgggaggttgaggggaaatgggtatgtggtttctttttatggtgacaaaaatgttctgaaattgattgtggtgatgttaaaaagccctatgaacatactacataaatttgaattgtacaatttaaatgggtaaatcgtatggtatgttaattgtatctcaataaagctgttaaaaaaataaaaaagagagagacccaatttatctagggtagacaaaagttacttcgatgatgatatcacagtgcctcacagaaagggccggaaggcagggttacagagttggcaaatggccctggaaaagggcaggaatcagagcatttccaggcaatcatgcaacaggaatgacacagccattccctaaggatgttaagattttactaaatgttgttgttgatttttttaacctctcacaatacttcactcaaaagctcaactccccgcaaacagcatctggctggcctggcctgctcaatggccagcattgtgattaacagcccctcactcctacacccagaagggagagctccttcacccaaaggaaccagggactgttaggcaagggggatggaggaggctggacagccaaggaaatcacagctgactgaggaaacccacctgggacactcacagcctagaccactgctgtctaatggaggaataggggcaattccaggccagtcagagaggtggaattgctgggggatgccaagttccttgggtacacaggagcaggtaactgtttcgccattgtcctgtgctgcggaggcaaagactgagttggtcactgttcatctgacatgaaactaccccttactacattatatcaacaccgagatatttctctcctgaaatatttgttcacattttcccctgaaccccgtggtgtgtgggactgaaagagtctacactggttcatacaaggacggcacactccatggtcgtgtagtgtggccccaggaatgttaagctggaaactagggtatggtgtgttcagggaagggggtgactcctctgctgagacacttgattacatctttaactgtgtcctgctggagctgctgggaaggtgggtaggaccactttccatcccctgatcacctcatcctccagagggttcatccacagttgcctgagtctggatggggaggaggatgtaggatctcagccttgagatctcaggaccttgagtcttggccatataatgatgtagccaccacttctggctctctctggtgtctgttttcactcctctgagtctcacagaatgggattgtgcccatgactggtgcactctgcatgccagtggataggtctgctcttagatgtttttgtaacgtctgtgtcagtacatgtggcccagagtgctgtacaggagctggctggtgctttttgttttgtgcttattcaggaaatacaagaaataactcctgggttcctgcattgtgccattgtctgaatgataaatggtaaatcccggccccacttcctcatgcaccccccagtggggaagcacctaatttccaattctggattcttacaagcacagctcaagactatcattattgtcatcacagctcagcctggaatccaggctct

SEQ ID NO: 12212 - DNA, 23939 bp, Homo sapiens
cctcttttcttgccccattcctgctgccttttttttttttcttttttttgagacagagtctcgctctgtcacccaggctggagtgcagtggtgtaatctcagctcacctactgcgttcaatcaattctcgtgcctcggcctcctgagtagctgggactacaggcacccaccaccatgcccggctaatttttgcactttttgtagagatggtgtggcgggaggggtctcaccatgttggccaggctggtcttgaactcctgacctcaaatgatccacctgccttggcctctcaaagtgctgagattacaggcatgagccaccacacccggcccctggtgccttttcacggggctggaatagctgaggtagcccattctaccctctttctgccttctgcctgggacccagctggcgttctttggtttgctttctctaagctctaggcctgtgctatccaacacagtaaccacgtgtggctgtttaaatttaagtcaactaaaatcacataaagttaattcattcctcatgtgctggaactgaactggagtctgctcacctggcacagtaagaccagatatccattctgagatttttgcagcaatagaaaggaaagtgtttatttgcagggcacccagcaaagaggaccaggcagctaaggcttaaactctgacctccccgatggtttgcaggtaagggtttttaaaggcagtggtaaatttcaggagagcagaagttataggcaaaatcgttgcatggaggttacacactggtcttggcctgaaacagtgggatatcacgcagcttggggcttacaggtcataggtagagtcaacgttttctgatttgcaattggttaaagtaaagaaggtttgtttaaaaatttgggatcagcagaaaagaaggttagcttggactggtgggtgtgactcccactaagcccttcaggaagaaatttacaacaaagagttcagtcttctcccgatacttttggggaggggtccaggtttctaaaaaacaactcagaaacatatgctaagatgttgtatttagtttctgtagaggaaccaaacctctgactctgacttccttggctattgttttaggctactattaccttcttggttatcaagttgcttatttacttcccggggctaggtaggggcttggaatttccttggaaggaactcaaggttttcctttatttccatgcttgtggggagcccagcaggcccctaagagagatccctgctccatctaactcagttgcattaaccacacttcaagggctcactcggtcaccgtacgtggctcgtggccaccgtgctgaccacacagagagcgcatttccatccttcgcacagcaccgttctagagaatgcaactggcttcacaagtcacagcctcagctgtgcagggatgaccctttccctgggcaaggggaggggagatggggaagggctgatgaggttccagctggggcctgttatctgggaccctgcttctccagagaggagaggcctggttgggctggtggtcccggttacttgggctggtgggtgtgactccctctaagcccttcaggaagaaatttacaacaaagagttcagtcttcagcggatccttctggggaggggcccaggtttctgaaaaacgacttggaaatatatgctaagatgttgtctttagtttccatagaggaaccaaacatctgactaacttccttggctattgttttaggctactattacctgagcctggctcagcctgggtggacggtgcctcctcctgaccccactggctggggtaacaggaatgaccctcccttgctgcacccactggctattagctgccatcaccaccccaacccagggtccccactggaggggttctcttctaccccgggtgaccttttccgcaggcggtgttggagtgagcacctctctgtagctgtctctcacactcttgtctgttactgattttttttttaataaaaaggtaagaaaacttgataccttctatttttaaaaacaatgaatttgtgatgtatgaattatatcacacttaagttttttttatttattaaaggagatgaaactgcccaaagaaagatagaaagtggactgtcccaggtgccactgagagcgccactggggtctggagacgtgtgccccaatccctttccatctccctgcaacccttttatttttttaaaggataagctttcactctgttgcccaggctggagtgcagtggccctatcaaagctcattgcagcctcaaactcctgggcccaagcgatcctgcctctgcctcccaagtaactgggactacaggtgtacgccatcatgcccagctaatttttaaattttttgaagagacagggtctcaccatgttgccaggctgatctcaaactcctggcctccagcaatcttctcacatcagcctcccaaagcactgggattataggtgtgagcctcggcacctggcttccatctccccttttcaggccacccacttcacatctgtgtggtctaaatgccccctactcacctcctcccagtgatgcctgccctatgtcgaggctcctgtacccccgggaagggcccctttagacctacccaactgcttctggcaagatccatcctgggagggagggtgatcaggaatgtgccagggatggactgaaaggggtggctgtttcagatttcctagtaaccggctgacaggagaggttggggcgcaagcagctctatctacccacctgcggttgtttgtttaagttgtggttgttgccatggtcccctgagagcttggtaaatgaggagccaaacacacatgggaccttacctgtagacagtgtgctctggggtttagggggcaggctgggggtctctccttccccaaggcctttgtttcaaggcaggcaaaattaacccttctggccccaagacaccctgcagcctgaatccagcttgaatccaggcagatccaggcttctacacaatgacgatttaaagcatttattgagcacttactatattctggacacaatattaagccctacaggggaaagcagggtgggctgtgcaatccagagtcagataggtttgggttcaagttctggctcctcatttactggctgtgtgacctcagaaaagtttcttgatctctctgaacttctatttgtttagctgtaaaatgggaatacccatacctgcttctgaatgatttgataatgatataaagctcccagcacagagggtatgctcaccaatgggagactgtgagctctatgcaagctgggtcctaatctgtcttgtttgctgtaatctaccccctccacatgcttctcactttcccacctccatgcctttgcccatgccatcccctccacttgggatgccctttattctgctctccataaatcaaaatccttcctttcttcaaggcctggctcagatgccaactgcatcacatataggtgactttcatgcttaggctctctccctaactaaggtggaagctcctagagccaagactatgggatagcataacagcacaatggcagagtggttaattgcatgggtttacccctggataagttacttctccatacctcagtttgcttatctgcataatgggcgtaatagtacctacccaacaccacaggtatgttctgaggtttaaatgaggtaatgcactgcttttttcttttttgagatggagtctcactctgtcccccaagctggagtgcagtggcatgatctcggctcactgcaacctccgcctcccaggttcgggccattctcctgcctcagcctcctgagtaactgggattacaggcatccgccatcacgcccggctaatttttgtatttttagcagacacggttttgccatgttggctaggctggtctggaactcctgacctcaggtgatccacctgcctcggcctcccaaagtgctgggtttacacgtgtgagccacctcaccaggccaaaatgaggtaatgcatgtaatgagaccccatctctacaaaaaatataagaaattagcagggcgtggtggaatgtgcctgcagtccaggctactccggggggttgaggtggggaggattgattgagcctggggaggtcgaggctgtagtgagccgagatcatgccactgcactccagcctgggcaacagagtgagaccctgtctcaaaaataaaataaaataaagtagaataaaataaaaatgggccacctgcaccatccaatatggtaaccactagccagattgaacaatttaaagtaaaatgtatcaaaatccaattcaattaaaacttcagttcctcagtcacgctaaccatctttcacatgtaactagtggctaccagatatgtctaacaggacaccccagacagaagatgtctaccatcacaggaagttctgtggagtggcactgtagctgatgaggatttgtgaacatagcaaggtacttgacaaatctgtggtctgggtcaggaaaagagctcagtgtgaaggctcacaactcctgaggagacccccaaccctccctcctggctctccttcacagtctccgatgcccctagaagtaactagcacacctcacattatagggattagggtgagaaaggagactggtgagaaatgggcaggattagtggctcgggaaagggcagtggaggaacccaatctctgtacattactggcctggcaggaagtgggtgtagacagcagctggggctttgcagaaattgaggctggaatgtgaaatggggcagggctggggtgtggagagttacctaactgttcctgagtacatgccacgggctccccaggcagagggaaatggccagcattagccctgccttctccttctggatccaactctgtgaggagcccagagcaaggaagatgtccctgagaagatgtctgatactgaccaacatctactagcctaaagagaccctgggttagcccagaatagaggcccactgtagctcaggggtgggtacccaggatgccccaggagtaggggacctagaaaagccctaggcagaatggtgtgggctagcccagctgctggggccgaggctagcccggggttggtttcagcccatgcagaccccctcaaggctgagatgtggccatgtggccatgtggccatgctgcagcctcaagctgatggtttcttcagagagagtcatggataacagggtctctcccttcctggagctgaagcttacagctccaggggggaccaggagagctgaaggagagtatccctcagatgcacacaacccttgacagtccctatgtctcattagatcttccctctaaccacataaggaggggaaggcaaacattaacggccccattttataaatgaagcaagtgacgttcaaaagatgccatctgtcctcttcttgactgtggacacaaaagaaggacctgggcctcccacccccaacaaagtgaatgaactgtttactacactgaccaagcctcagaatcctaccctttcagagctgggtagaggggggtgatctttgcagaatcctaagtgtgggaagactggggctcagggagaaagggtacccacaaggagcggtcctcattctcctgaaactcccccttctccagggcagtggtcactggaggcctgggagggtcagcgggttctacaggcactcactctgggctccaaggtcacgggaggccagcctcccttcctcccagctgcctcctcctggcaggggacctctggcacacgctccatgcccgcctgcccctccagatctgtccccaagccaagcaggggacctcacttaatcccarttatgtaatctgcaatttaaacagttggcccatgaggaggcgcttggagccacgcccaggagtgggggcaaaaggacccagctgggtcagggctgacaaactaggcttggcctcttgcctatagtggccaccactcctcaagccccagccagcaccatgagcggccgagttggagacctgagccccaaacaggcagagaccctggccaaggtgagagcccctccccctggagttccggaagaccaggggaaaggggctggggggtggaaagaagtggctggaatcctgccccactcagttgattcagcatgtccttgacattgtctctttggtgttacctcccaaagggtcaagccccacggtgcccagtaacatcaaccctgtcccgggcgggggttgagggactagcaccacttccaggcaataacgtgggtggtgcccacccaagtcaagcctgacttcttctcatccaggagccagaaccagagaggtttacctggcagccaggtacccccgttcctccctcccaggcaccataggtaggagctgaaagatgctgctggtctgccctttaaccccttcctctttgggatcctgaaagatgaccagtctgtaaaagcccaagagacagagcagaaagtgttgtctttcaaagagctaaaggaagaagaggacatataattattaaccatgttttaatagaagatgggatgaaaaaaagcagatgttttgagggctaacacatggagggaactaagaatgcatccaaactccaatccacttattcatccacccaattatttatcctttcttcttctttttcttcttttttttgagatggagtctctgtcatccaggctggagtgctgtggagcgatctcagctcactgcagcctctgtctcccaggttcaagcaattctcctgcctcagcctcctgagtagctgggattacaggcatgtrmcaccacacctggctaatttttgtatttttagtagagatgagttttcaccatgttggccaggctggtctcaaactcctgacctcaggtgatccaccaacctcagcctcctaaagtgctgggatgacaggcgtgagccaccayacctggctgtttatcctttctttcatccacccatccctcttcctacccacgcagccacctatccatctttctttctctcaatcacccacccatctctcctctgtccattcactgatttatccacccacccactctccatccatccatctatccattcatccattgatttcttctccctttttccatctacctacccactcacccatctattcttctttctaaccatttattcatccatctatcctccttccattcatccacctatccagtgatccatctgcccttctattcaaccattaacccatcctttcatcaatgtgggccattttgcatgtgggaggaaaggagaggttgtgaaaacagtctttgagtctggaggccaaggctsaatgtgagagagccactttaaccagcatctctcttgccagttccgagaaaacgtccaggatgtgcttcctgccctgcccaaccctgatgattatttccttctacgctggctccgaggtgagggcagaggtgggagaggytgggatcagggggcatcaagaggggcctggtctcaactgctccagagtgtctcatggctctcagggtccatccacacaatcttgcttcacrtgttcaggtccagaggagggaagggggtaggggagcaaggtctcacccaggcccccagtgtcctccatagctcccactggccaggagtaagacaaggcatctttcctgtctcacaccttccttctgttttcccacagctcggaattttgacttgcagaagtcggaggctttgctccgcaaggtgagacctatccactctggaaatttatggaggggatttgtcaggggcaatccatgcctcaagcccctccttccatccctgttctcagggcactgggagcccagtgggatcttaccactcatttccctttcagtacatggagttccggaagaccatggatattgaccatatccttgattggcagcccccagaggtgagccaacaccgccaaacacctcagtctttcacggacgtaccactcaaggtcactggggaccatgaatgaggggcagcaagcctgagaggcctgtggaacccgcaggcctgcagtctcctttcctacagtcataatgaatgtttcctgggggcttgcaargtccaggcctaggttaagatgttagcagcakgagcttctttaatcatcacaatgatggatgctattgtccccattttgtggatgaggacactgaagcccagcaaaaattaggtaacttgcccacagtcccatagcccaaggtagggctgggatttatgctcaggcctgtttgggcccccaaacccaggctcgtaaccaccacggttagcctgtgcttctgcacccctgccccctaaggcattgcctaaagcatcctgtctgggtgggaaagaagtttagcccatcaaggcactgatgaggacagtgccaccactggcatcttagtagagtaatggtcacgtcttcacttgtagggcatgtacccrgakctgggcactctgctttgccaactttatctcagggactttccccaacagtcccaagagtgaggggttatccaaaccattttacaaaaaaagtaggtagaatggagctcagagaggtggtgtcacttgctcaaggacacacagtacagaagcagcagtatctgctttttttttttttttttggatggggtctcactctgttgccaaggctggtgtgcagtgtcatgatcatggctcactgcagccttgaactcctgggctcaagtgattctcccacctcagcctcccaagtctacagatgtgtattaccacagctggctaatttcttttatttttgtagggacagggtctctctctgttgcccaagctggtctcaaactcctggcctcaggagatcccatctgcctcaacctcctgagtagctgggattacaggcatgagcctccatgcccagccagtgtctgtttttgaaccagctctgttaaccttcagaatctgtgttctccatcactaaacccgactcttctccacagaaagggacacgggagacatcaggggcagacctaagaagtccaagggccwgctgagacctggctttgccatttaccctctgtgagcaaggccctcccctgcaggacctcagctttctcacctgagacaayagcactgtcttccagggagggacavtgctttttataccatggtgtgtgtaggcttgggccacccaggtcagcctggtctggggtctcaagggaggtgtgtaatgccaagttctgtgcatcttttyatgcccaggtgatccagaagtacatgcctgggggcctgtgtggctatgaccgtgatggctgccccgtgtggtatgacatcaytgggccacttgatcccaaggggttgctcttctcagtcaccaagcaggacctgctcaagaccaagatgagggactgtgagcgcatcctgcatgagtgtgacctgcagacagagagggtgaggtccaggccaggtggggtggatggctgggggcaggtgaggctgccggggggattggtctcagaaacacacctgtgttctctacaaccacagtcagagggctctggggtcaaacaccagctctgttgcttaccagctgtgtggccttgaaaagtcacagtcacagaaagacagtttcttgaargatacttttgctgggaatagaacccyctttttttttttkcttgagacagwgtctcgctctgtcacctargctggagtgcagtggtgtgatcttggctcactgaaacctccgcctcccaggttcaagggattttcctgcctcggcctcctgagtagctgggattacaggcgcccgccaccacgcagggctaatttttgtgtttttaatacagacggggtttcaccatgttggccgggatggtctcgatctcctgaccttgtgatccacccgcctcagcctcccaaagtgctgggattacaggcgtgagccaccgtaccaggccgggaatagaattcttggttgatgggtttttttgctttgttttgttttgcttcagtgttttgaatatgtcatttcacctgtctgagcctcagctccttcacctataaaacagggatatgaataaataatggttgcaaaagygaaatgaaataatgcaagtatgcaatttagcacacagggcctaatatatatttctcaacaatggtagctattgctattccctctgagcctttctttgcccttgctattccttctgtctgaacaaccctagttcccaccacacacacctacctcccacaactttccctgactttctcctatctatcctttaggtctgaaacttagatgttaccttctctgagtcccccgcctgggttaaataacctcttctgtatccctgaagctcttgtgctgacctattgcagcacttatcataggatccaaatgacctggttgcttgtcatctccccagccagacagtgaactttttaaggacaaaaactgtgggttattaggcactattcattacactttagtgtctggcacacacaaaaaagtgcttgataaatatcagtttatatttatcagtttatatttatattatggaaaaatggaggatgaataaattaatgacaatatgwatgaatggatggatggttcaattaattgatgagtaagttgatatatacgggggtgggtgggtggatggttggatagatggatggatggatggatggatggatggatggatgtggatggatggatggatgagtggggaaatgcattcactggttagtctacttgttcctctgaggacagagtcggggtctagaagaagccccaaggggtcatgtacttggattaccatctcccaagcctacaccctgaactccagaactacttcttgctctcatccttgcagctagggaagaagattgagaccatcgtgatgatatttgactgtgagggcctgggactgaaacacttctggaaacctctggtagaagtgtaccaggaggtaaggagaagtcctagggccaccccccgcttgctttgatgaccagcttggcctgccatgacccagctgcttactgagagccaagatttagtttaaaaatgtcctgggctccctcattgtgactcaaactccagaaggccttaatacctttcctagaagatcccacagaatgggtttcagggacaacactgtactgagaccacacrttccagcttccaccaaaccctctccatgcttgtttcctgacctacaaaatggggatagcaatgtagggatacttcagcaagttgttatgtaaagtgtatatacactgcttggcaaatagtgaacatttaatmaacagtagtcattattattatactaccattattataatatttactaaaaacaattattatgtaattattattagagtatggttataatagtatgaggtgagaaggttccctccagaggccaggggaggtgatggcatgaagggaaaccctccagagccatctgaaacctcccaacaggagattgcacaggagatggaggtaggagaagatgtgatgtgctctctgaagggwtctctcttggttccacagttctttggcctccttgaagagaattacccagagaccctgaagttcatgctcatcgtgaaaggtatgtgacaaatgacttcacttacttgtgcctctgtttcctcatctgtacgctgagggtgataacactgtctttgtcccaggattgttgtgaggcaggttggtttcttggctgtatgcaaatcacttagaatgcctggcatagagtaagttctcaataaatggtaacttctagkgttggccttactgcaagagaaggcagctccagtcccagctctcccagggatcctcccttatttctcctgtccatgatgatctctccctccccagactgcttctggcactggcaactggtgcagccttccctgtttgctgccttttagggatctccagctgttttatttgtgctcatcctgctttactggctgagttttctgctccttgaagccargggctgtgattctccacttttgttgtagccctcacaggcctgggtccatggtggatgctccataggtatttgggtrattgttgtgggtagatgaaaggatggatggatgtttggtgattggctagttggttgatcagttggttgcttgattggttgttcagctgactggccagttggttgcttggctagttgactaactggtggttcrttggagaattggctggctgcttggttggctagttcttagcttggttgactgattgagtggytggttggcattttggttggtargttgttttgatggctagttagttggttgcctggttagcaggttggttagttggttgcctggtttgttgtttggctgaatcttagatgattatttggatggtggctggctggttatttggatggttggctggctggttatttgactgactggctggctagttatttggatggttggctggctggttatttgactgactggctggctggttatttggatggttggatgactggttatttggatggttggctggctggttatttggatggttggctggctagagaacacagttagttgagtggttatctggctgttccattggctgattgctttgctgtttggctgatttgttagatggttgactatttggtaggttggctggttagaagttaaattgtttgactatttgttgtcagttggttggtttgttgcatagttggttggctgtttggtaggttggctggtttattggttgactgaataggtggctgattagaagtttgaatgactggctggtttgttggctgaatggttggttgatggttgcattgcatgattgatgcatgattggttagttggctgtttgttggctggttgactggttggttggatggtttgttgggtgcaggacagacactggaattgaccagggttagtcatgactcctctgtatcattggctataaccattatggagggggttgcccaatgtaattcttttcttcccattatccttacttctatctctccagctaccaaactgttccctgtgggctacaacctcatgaagccattcctgagtgaggacactcrcaggaaaattattgtrttgggaagtaagtagtgccagctcaatttcctgacctctatacatgacctttggagtgaggttgtcccattaccccatctagaactccacacattaggttgggtgcagtggctcacgaatgtaatcccagcactttgggaggctgaggcaggaggattgcttgatatcaggaggttgagaccagccacagcaacatagcaagaccccatctctacaaaaaatttaaaaattagctggttgtggtggtgcacacctgtaattccagatacttaggaggctgaggtgggaggatcacttgagcccaggagtatgaagctgcagtgagtcgtgttcacaccactgcactccagcctgggcaacagagtgagaacctatctcaaaaacaacagaactctacacatcacctagtcagaggctccttcttcccaacagtgaagtgggttttaccctaaagagtgttacctttgctcttttccctgccatacccctttggtggacaaggcctccacacctaccacctcactggtttcagtttggttgcagtcaatttctggtatataggcctcggtttcttttcaacactcataagcttagtgcttccaaaggcaaccttggcagaagaggatgaggcagacgagcagaaagagtagtcacaattcagagaaaggaracccaacaagaaaggactggataaataaataatggtgcatgcatttgatgaattctggagccgccatgagaaataaggctatatgtgaatatttaatgccatggaaatgtctttaagtttttaaaagtagattataaacttatcttcataagcataaactaaaataagattaaactaaaagtataatcttattttatgaaaacatatgtacaataaatacatatttctacaaggaaaaacaacaaaatattttttgttgatagtgagagatcgtgtggtttttaattttattacctgtattgtctatgatttctaaactgtataataatatgtattaattttacaaataggagaatagttgtgtttacaagtgacaggctgagagaaagagagagaagggaaatagttcttaaacccaaaccaatgaccctggcttggaggaaaacttctcccaagcaggatagtcagatcacagaattaggagaactgaggatccaggggtgagggggagcttataaatccttactttctctttcttcctggtacctgagcctctgcctctacccaattccactgggatggggaacttgatagattatgagggcctrgtttgaagggtccaggctcatgccttctacgccttccaaagcctagagcagtgtgggttaccagcacagtccaggccttaagtccacagcctctgccccatgtgactctgctcatttggctctggtatgtggcacattgtggtcttccccttaataccactgtagagaaggaacctcccatggccaaagtgagggggttgggggaccgggtagcctggattagccataaggctggggcatggtaacagccaggacccagaactcttagagctttacatagggcatgaagaacattatggtcatggtgattaggcagagggaagtggggagggtccctccaaaagcccagggctgtccatcccccactaggaggtctgacttgggcatgccacttacttacagagtgatcccaacaaggccgttgacgtcattgagctctaaactctccttgaggcaattagataactcttagtttcactgctcatgactggaagatcttcaagaatgtgctgttggctgggcgtggtggctcatgcctgtaatcccagcactttgggaggccgaggcgggtggatcacaaggtcaggagttcaagaccatcctggccaaggtggtgaaaccccgtctctactaaaaatataaaaattagccagtcatggtggtgggcacctgtaatcccagatactcaagaagctgaggtagagaactgcttgaaaccatgaggtggaagttgcagtgagctgagaccacaccactgcactccagcctgggtgacagagcaagactccgtctcaaaaaaaaaaaaaaagaatgtgccataggctgggcatggtgatggtggcttacacctgtaatcccaacactttgggaggcccaggtaagacaatcatttgagcccaggagtttgagactagcctgggcaacatagtgaaaccctatctctacaaaaaaaaaccaaacaaaacmaaataaaaattagccaggcatggtggtacatgcttgtagtcccagctacgcaggaggctgaggtgggaggatcacttgagcccaggaagtcgaggctgcagtgagccatgatcattccactgcactccagactggacaacagagtgagacactgtctcaaagaaaaaaaaagtgctgattcatctatcaaggcgggaaacacatttccacagcaacacaatgctgagaaagacacttactgtagccccaggcctaggacactggggaattggtcctggcagcctacctcctatagggcttctcccccagttcaggtcatcctggtgggtgtgggaggctaattggtgccccccatgcttgctaaccacccttgaatcccactgctcccagataactggaaggaaggtttgctgaaactcatcagtcctgaggaactgcctgcccagtttgggggcaccctgactgacccagatgggaaccccaaatgtttaaccaaggtacaaagagcccttccctgggacaagagaggttcaagaattaagctggattccctttccactcagtcattcatccacaattacctatagagagatgccaagaactgggtgttaagctagtcaatacaaccctcgcccttacagagctctcagcagctgtaaaggcaaacaagaaataggcgaattttaacccagagggatgagctgggaggggaagctcccagcagacgcaytggcccagtttggagggtcayagaaggcttgaggaggtgggagagtggggctaggatgaagaggatacttccaggaggtggtgaaagtgtctcaggcagaagaaacatgaacaatggccaggagacggaagcaagcccatctcatcccatgtccgcagattaactatggcggggagatccccaagtccatgtacgtgcgggaccaggtgaagactcagtacgagcactcggtgcagatcaaccgcggctcatcacaccaagtggaatacgagatcctatttccaggctgcgttctcaggtaggggcaggccctaacccctcagagacccatcaggctgagcagcaacctgtctcctccccctccccctgacaggtggcagttctcatctgayggtgcggacatcggcttyggagttttcctgaagaccaagatgggggagcgacagcgggcaggggagatgacagakgttctacccagccagcgctataacgcccacatggtgcccgaggatgggaacctcacctgctcagaggccggcgtctgtaagtctgccccagctgggacctggctctgaaaggctagagccacctgtcccatgctttagagaaggaaacagaggggcagtgacacacctcccccattcagggacacacagcctaggttagcaccattcattcatacagtcactcactcagtccatattcatgagcacctactgtgcaccaggagccagagacatacaggccctgaaggaattggggrcacctggaccacagaacacagacaacaagtgatagggcaggtgtagttttccacatgaggaaaccgaggctctgaaaaataaatcaacttgtgcagagccacaaagctgagtgtggttccagggtcccacccgagcctcagggtagctacatagtcctgggcaaaagtctgaccaatctgggaaggacccttggtttgctcacctgtgagccaggagttacaatgcctgttttttctctttttttttttttttttttttttgagacagagtttcactcttgttgtccaggctggagtgcaatggtgcaatctctgctcaccgcaacctccccctcccgggttcaagcgattctgctgcctcagccttctgagtcgcttggattacaggcatgtgccaccacacttaattttgtaattttagtagagatggggtttctccatgttggtcaggctgctctcgaactcctgacctcaagtgatccacccaccttggcctcccaaartgctgggattataggtgtgagccactgtgcccggccaacacctgctttttggggtggttgtgaggaggcaaacagtgtccagcaggcctgccccagaaccccacttcatccaagggggctgggaggtctctgatgaacccaaccatgtgccttcacagcccmgtcatgtgcgtctccaggtgtgagacaatgggatgtaatgaccattgttctcgatgccagtaaagccatgcctgggcacatgccaagaggaggttggtgtctgtttacaggacctgcttgggttggcagttcccatggggaagggaagaggcgtggtgggagcttggcccagcttggcaaacaaagccagtgggaacacaagcctgtcctcctccatggccaggggtggaaaaaagagtgtgtaaagccaagcccaatgcccctctttccatctgtcccccagatgtcctaygcttcgacaacacctatagctttgtccacgccaagaaggtcagcttcacagtggaggtcctgctccctgacgagggcatgcagaaatatgataaggagctcacccctgtctaggtggctccctcatttctcagagacctcctaaccctttgatttctctgtttatatcctacactccctccctccctgaaattgattgttagtcctcctgactctgtgacgttagtgagtacagaaagagatgccctggggaaaactcatctactgtggtcagatcaagaaaggtatgagaggcacaaccttggagggtaccaaggttgcagaagaggaaaaagcaagggtaaaggcaagaagtgggtgtcatgaaactcaataaatagcaaaatgaatcccctagcctttgtcctcacctaccctaaggcaggtgtgtatgcttgaattccttccgtatggctgtgagcaacttgggttggagacatatctaaatcctttttacttccactccctatatatagtagatgctcagtgtatatttgtggcattgaatggaggaccagaaggtagggtgcaggtgactcaacagctgtacatgattaggaggagcctatgtggggtggatttcagcaccttggacaggagcagatgtgtggtggggttggactctcttctggagacccagacaattcagtctccagatttctggcagtggctgtcttttgagggccccagccacaaaggccacatgcctctgataggagctgcctacatcaggctttgtctgacttgcacgctcagcttcccaccctaacccacttcccttgttgcacatagcttatgttttagggactttcctggaagcaaaggcagtcacatctggcataatcataataaagaaaacaactatcatttggcgagtgctctctgtgtaccagaaactgtgccaagagctttgtgagtttagcatgttttattctcatgccatccccaaggccctttatggataaggaaatggaggctcagaggggtgaagctactcactcaacatcttacagcttgggtggcagatccaggacctggggcagggggtgttcgtttgtttgtttatttgtttgtttgtttgttttttgagacagggtctcgctctgtcgcccacccaggctggagtgcagtggtacaatcatggctcactgcagtcttgacctcttgggctcaagccattctcccacctcagcctcctgagtagctgggactacaggtgggcatcaccacacttggctaatttttttgtatttttttgtagagatggggtttccccatgttgtctcaagctcctggcctcaagtgatttaccccccatcagcctcccaaagtgctgggataacaggcctcagccaccatgcctggcctgtttttgctttgtttactccaatgacattgctctcagttgccttgtaataccgcctcctgcctataatcccagcccttggggaggctgagatgggcggatcgcttgagcccaggagttttagaccagcctgggcaacatagtaagaccacatctctatcaaaaaaatttaatatagtaagaatatgacctcctaagattccacttttacaaaggcagtgagaaggcatgatttatttgttctagaccttccagtagaagtgtcctgcatgtcaccctctccagtccctgtttgtgggtagaggaggtgataggccatagagacccacaatactgaagcagcttgtccaaggaaattcacagcagagtggggcagggcttgtgttcctcagctcagcatcctgtccgctgctcacatggcatctgtgaagcacaaccccctgacgctcaccatgaccctgggtgactagggcaaaggccaggactccagagtttccttcccaactttctgctgtgattcggggacgtgaagaggctggcttgagccccagtccctgacacaactcttgccaggggagccggatcacacccgggaatggggatgaatgggaaccaaaggctggtgccatgagaggctccttggaaacaaacaaacggagggctgagctcatccgtgggcaggctatgaggtctgactcaggctagtcaagcaaatattcagcagcagcaagcactttcccacatgcacttatgggtgcaaaatctgatatctgctttatagatgggaaactgagctcccaaaggcactggccttgtatcttcagcctacaggtgacagaaatagtcctggagctaaggctgccccttaccccgtcacctcttcacccccaccactcttctataacaatttgtcagaatgggacaagactgccttcttcctgagctggcagggaaggaggagggaggaggaaggagaaaggaaaaaggaaggaagagaagagaaaatgagggttgtcagatttagaaaggaaaaaaaaaaaaaagcatggccaggtgcagtggctcatgcctataatcccaacactttaggaggccaaggcaggcggatcacttgacgtcaggagttcgagaccagcttggccaatgtggtgaaaccccgtctctactaaaaatacaaaatttagcctggggaggtagcacatacctgtaatctcagctcctcagaaggctgaggcatgagaatctcttgaatccaggaggtggagattgcagtgggctgagatcacaccactgcactccagcctgagcaacagagcaagactccatctaaaaaaaaaaaaaaaaaaaaaaaagacatacttaaaatgtatccattgtttatctaaaattaaaattgacctatgcatcttatattttatctgacaatcctaccaatgagggaagatggagggaagagagaggaaagggaggaggatggaaagagggggatgggttcaccttcttggaagacggtggcagcacccacaatttgggccaatgatgtcatggaatccttgggagaggatggcttagtgtgggtgatgcagggtcgggggacagggtggtctcacccttgaccaccaaaggaaaggcctcgatgttgaagcagggtctgaggtagagagtgtggaccctttgtgcctttgggactaagatgagcagtgctgttgccagagctcctctgtggcagctgagtggaggggacttgcaccaggaggtggagcagtgcaaagaacctaaggccagggccagagctgagatctgcaaagtgcccatcagcatccgctgatgcccacccctggcaagccagctcccactgtgtgcacacagccagtaagaggcaggcttcccaagctccagcttctagcctccagtcttactcagggtctagatgctcagctccagtcctgaatctccaggaggcagcattggggaaggaaagagacccactttgtagctttggccaatggtcactaatagagtttggatatttgtcccctccaaatctcaggaggaaatgtggcccccgatgttggaggtggggcctagtgggaggtgtttgggtcatggcggtagatccttcatgaatggcttggtgcctgcccgccataatgagtgagttcttattctacaattgcttaaaagaggctggcacccctcccctcttcttgctcccttcctctcaccatgtgacacgctggctccccttcctcttctgctatgagtaaacgcttcctgaagccctcaccagaagctgagcagatgccggcaccatgctttctgtacatcctgcagaacaatgagccaagtaaacctcttttctttgtaaattacccagcttccaatattccttttttcgtgtttggtgtttgtttttttttttttttttttggagacagggtctcactctgtcgcccaggcaggaatgcagtggtgcaatctaggctcactgcaacctccacctcctgggttaaagcaattctcccacctcaacctcccaagtagcagggaacacatgtgcctgccaccatgcctggctaatttttgtatttttagtagagatggagtttcaccatgttggtcttgaactcgtggcttcaggtgatccacacaccttggcctcccgaagtgctgggattacaagcgtgagccaccttacctggcccaatattcctttatagtaacacaaaatggactaacacagccccctcattccagaagtgataagctagcagcatagggcaggaaaaccaaggcctgcaggccccccattgtgtgagaaggaaagttaacttagaagttcctgttccaacagcccagaaatgccaaggcagagccagggaaggaaaagtctcactgttcttgggaagctagagttggtggccacaggccatttcccatagaggagtcaaatttctgctgaggccaaaaggcgaggctcccaaccgtgtagacctcaggccagggacaccggtgggcaacactatgctggtgctaatgaggccccagccctgcctcttactccttccccaagaacccaccaccacactggccccttcagagaccacaaatgcatgtcacaaagttaagacatcaggtttttcccctaacaactagtaccaaaaagcacaaggttaaggcaacacaggccaggtgcagtggctcgtgcctgtaattccagcactttgggaggctgaggcagctggaccacttgaggtcagttcaagaccagcctggcaacatggtgaaaccctatctctacaaaaatataaaaattagctgggcgtggtggtgcatgcctgtaatcccagctacctaggagactgaggcaggacaatcacttgaacctgggaagtggaggttgcagtgagccgaggtcacatcactgcactccagcctgggcgacagagactccgtctcaaatatatataatatattatatataatatattaaatattatatattatattatttaatatttatattaatttatattatatattaaatattaaatataatatattaaatattaaatataatatattaaatattaaatataatatatattaaatattaaatataatatatattaaatattaaatattaaatatattatatattaaatatttaatatattatatattatatataatatattgtatatctattatataatataatatattatatataatatattatacatctattatataatatataatatataataatatattatatatctattatatgatatataataatatattatatatctattatataatatataataatatattatatatctattatataatatataataatatattatgtattatataataatataatatattatatattattatatattatattataatatataaaatatataatatacaataatatataatatataataatatattatatattatatattatatataataatattattatatattatatattatagattatatataataatatatattatggattatagattatataataatattatagattatatatagtaatattatagattatatctaataatattatagattatatctaataatattatagattatatataataatattattatagattatatataatattattatagattatatataatattattatagattatatataataatattattatagattatatataataatattattatagattatatagagagagaaacaagggttattttttcgttgtcttctgaaggggccactgcctccaggtcttcctccaaaatagactgagattccatatcaatttcctcctcagaagagagtctctctgttgcgcaagtcaccagccccatcttgtgggcctcccagctggcagggcaccaaaacagagcctcttaagctgcagagagggcaggatggctggaagacctcgagtgccttcctcagggtcacaggagcagcaacagagtgacaccagtgaaggccagtgcaaccagcaaaaagtccttcagcatcttgcaggaggctgggaaggagaggtccaagagcaccccaggactgcccagaggtgcggggcaggttgtacaggacagctagggtgagtccagaggtaggaaaacaaaggccaggagtgcctggggaag

SEQ ID NO: 12213 - DNA, 22203 bp, Homo sapiens
  misc_feature (1)...(22203): n = A,T,C or G, or insertion/deletion polymorphism (see Tables 1-2)
ggcaggaattccttcacagtctcccgacagctggtcatcagcctctgcttcaaaaactcccgtgtcctctagtccagcctggtcttacacttggtttcagtgagaagagctccttttttcttacgttgctgaaatctgccctgttacagcttttacctcttggttctagtgctgcaaatttactctttctgctgcaaaaccttaggatcatttgatttttaaactgaatgaaggctgggtgcagtggctcacgcctgtaatcccagcactttgggaggctgaggcaggtggatcacctgaggtcaggagttcaagatcagcctggccaacatggtgaaaccccatctctaccaaaaatacaaaaattagctgggcatggtggtgggcacctgtaatcccagctacttgggagactgaggcaggagaatcgcttgaatccgggaggctgaggttgcagtgagttgagatcatgccactgcactccagcctgggggatagagtgagactccgtctcaaataataataataaataaactaaatgtaggtatgagactctaccataatgatcataaggatgaaaagaaaggactagaagggacccataggaactgcccttcttccctgactcagtcctgaaggaagaagggacgctagggttcttgaggatagattttagttttttaaactattgcccataaaacatgcttctagtctctttctgttcaggctgctgctttctagacacatgttagtttaatatggtccctcttaataaattagcatatgtcttcagggggatgtccggtgttcaggccagtatatttaagtgtagtccactcggaatagagttctgtacgagcatttccacaatggggatgctaaacatcaaacagacaagaattactagctttaagaatagcagcttcagtaatgttacatggtaagtttgggggcaatttaattctctcagatccttttcgtaggaagtgctagggccagaggcttaaatgatggaagcagggcattgtggcctgaaagctggaataggactttactcattaatttacacatgtagaatttttttttctttttgagacggagttttgctcttgtcacccaggctggagtgcattggcatgatctcagctcactacaacctccacctcctgggttcaagggattctcctgcttcagccttccaagtagctgggattacaggcatgcactaccatgcccggctaattttgtattcttagtagagacggggtttcgccatgttggccaggctgctctcaaactcctgccctcaggtgatctgcctgcctcggcctcccaaagtgctgggattacaggcgtgagcccccggcccacatgtagaagtttatatctctgttgtttcaccttgtttttgacctagtctttcagtgatttgaatcttgattcagtcttttgttattttagtggtacttcccagctttgtgtcatctgtggatgacatatgagtcttgcttcttcatgccaatttaagaagactgaacgggaataggtcaaaggcatggccatgagcgatttctctccagcttttcatggtgttcagcttcaaatctattcacatattggacctgcaagccatcatcttatccacaggctatcatcataggtgaatgtagattgggttagggtggccaagctgaaggtgagatatttttaaaaagctcaagaatgttggagaatccatgggaagcagtgggaaactgaagacaggacttagggaagccaaggttagggatggctttcttaccatctgggttttccattctcccaagctaaagtccacagcaggcagcaggacaggtgtaggcaaagggtgaacctctgggcactggctctgttgaaaaagattggtggggggagaagggagctgaaatagagagagctatggtagcctaataagcaggctagtcctccatgagtactatctctagacgagagcttttaaatgcgggctgtattgtgaagaataatccttgtcagagagtgtgatcagtaggtggggacaatatgggaagaatagtcattgggtcaaggagttagaggaagtgatggtgtcttcctgggagtatgggtgtcttaccagttacgcggataaaggggataatgttgggagttctcaccagtctgctgtgaaggacatgggagtcacgaagcagtttactgaggactcggaggtcacaagcaggaggagccgggctggacagcgttagccttgcagttaggagaagcatgaccacgaggagcaattcttagatgaggagaggtgaggttgaaagatgaggaggaaatcattgtcagctggtattccaggaattcccattcaggacccagacctgaaacccagggaatccacccctcagaccccttatttttgggagaatgggttcccccagcttcctgccccctgcagcgtgtctcctttctctctccccttctgtcatgtttccatatggccctagcccctcaggtgtgttctcaccagtcagctccattctggccggggtgtctggctggcgtggctccctgtttggggcctctcccctgaatccttcctggggccatggaggcggcttaggctcttgcacttctgggcagagtagggtggggcaaaggcgggccaagggtgargaatctatcctgaaagtagcaagaagagtgaacatttaaccaagtttctaggaagagactgcctggcagggtgaacagatgctggggagggcttgagatgctgaccagcctggaactgccaaagccctgaattctctcacattttcttgtgatgaaagcatatggtgtgccgggtgcagtggctcatgcctgtaatcccagcactttgggagtccaaggcgggtggatcacctgaggtcaggagttcgccaccagcctcactaacatggtgaaaccccggctctacgaaatacaaaaaaactagcagggtgtggtggttcatgcctgtaatccaagctacttgggaggctgagacaggagaatcgcttgtacctgggaggcggaggttgtggtgagccgagatcgcaccattgcactccagcctgggcaataagagtgaaactccgtctcaaaaaaaaaaaagaaagaaagaaagaaagaaagaaagcaagaaagcatatggtgtctcctttttgtcaggactcctcagtgaatcggacatggatttggtgccacctacccctgctgagagcagcaggacatgatatgtatacacacatatcttaattagccttaaattctgagcaaccttggttgttaggtcagagaaaatctgggatggggatagagaaggaaagtattgtggcttcagcctggagaagagagtggaaaatgggatgcagggcctgggtgaggaactggcaaacgggcgcaatatgttgaggggtaacttctgcggtggggagtggggctggggaggggaactgcacaaagctgtaactgggaccactagaggtcaggattaaaaggcggtatgggagaaattaacctctattctttccctatctacccccacacataaagccactggagcttttctytggactccaagtcctgaaatactccattatctgaggccaagagatgggctaacagttctgggacttccttcctgagaccagctgcccaggaacgggcacctgctgggtgatgcccaccttaggggcttaccttgtcttaggcgcccactaacatatctgtctcatagctcacacctgcctccctgcccccttggcagaaccccttccggttccttcacaggaccccccacatggcttcctcctcctttcacaagttgtgcaaagaggcttgcacctgattcaatattgggatttcctgtaggtctgtcaacatgagtgggccctcctcccattaccctctccttgcgccctggcttgcctggcccagcttccccagcaccagattcagaaccttaagctaacgaggaatgaccagctaagaatggggattggggctgtgtccatcttactactgtgtttgctaagccctaagtgcagctccctctcttattttctccctgggctcatgtcccctttccttagggccagccagggctgtgctgtattccaccaagtaagtgatcagtccctcagaaaccagcaccccaccccctacccctgctctgccctgctcctcccattctgggaaggctacactcttctcgacaaaggtcagtgcctgtaggttccagtttgcctgcccctcccccagctgggagcccatttctctttgctgtcctttctaccctcacataaccccacaccctgctggccactcaccgggtggagaagggctccaggacccaagtgcacagcaggcagccctctggggagcagatgggtaggaagacatgtggcggtggggcacagcccctccacagcagcaggtcatacgcctgcctgggccacttctgcccaatcagagaagggagccaccagacactggtgaaggcccccggaagtgacgccttctcttccctggagcccctgcctggaccagggtccactcctccacccacacacaccacggagaagatttggatagggggatccatcttttcctggacatgggcaacctgggacctggagggggacaggagcagaagtttttttccaggaggaatctggcaggacatttgtgttgctggggaagaagcacagaggtcttgtttaagattggtggggttttcactccctggctatccaaatttcttttccctggacatcatacctgctgctgaaatccaacaggatgcttgctttcctgcttttctttctgtaatcccctagggagtcctatcttgtcattccccctttcgaagtgggaacacggatattgcccacatgagagaaatctcctgttatgggttggtgttatggggaaagggtttggacgggttgagtggactgtcaggtgcggggcacatgtatgtgcgcacacgtgcactgggttaagcctgagcttaggtgctcgtctgctggggtccagtggcttggatggctacacacacagacctctgtgcccagggccctcctttgcttgttctgtctccgtcttccatctcctaccgttccacatgtgacaagaggaataaccaggcccatgtgtccctgtcttaggaaagacagctgctggacctcccccgcaaatacctccctgctggccccccttttcctttggccctggctctagctcctttgctttcttcccagtcccagtctccccacagtctctgtcctcaggggcttcctggcctgaccttgatcccatcatccccctgtcccccagaacttcctcaggctctctcctgttcctcctccccaaggatgggcatgtctgctgagaagtgtggcctagatcctggaattttcccgtccagccagacgagatgtctcccaagattaggaaggagggtgctgggatagctgggaggatagtgggtgtgtgtgggagggagagacaggagacagggaggcaggcatgaccagggaaccaagagaaaggaggctgggagtgggctggagaggcagagggtcccttgggtgaaggaagggggtgagaaagcaagaggggactgtcgaatgcgcctgaggataagttacaatgagagggagatactgtcactccacagaagggggaatgctgccggtttctggctaggtccctgtcctgggtaacacaagaatgaggagcgacctcagagagaaggtagggaggcaggctaggcagtgagagagggtggtgagggtttggggggcgctgtgggcccaggcagggggagatcggctgatggacctttcctgtacgttgtcatctttaaagacaagtcttcatccttcgggcggaaccgggtcctcgctcacagagcggtccaggcctcaggcctagcctctgcccctccctagcctgaggctcccttcctgggctggacaccgacctcctggtccagccgccctgtggccgccagcagcggggggctccgggcccgcctctcctccccctcttcgcgccccctggtccctcccctccccctcccccgctcccccttcccctcccgcccctccctcctcccctgcccggtcccagcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggaaactgacgcgcatttgaggcccgcccgcgctcctcccggccgctcctcccgccccgcccgggccggcgccgactctgcggccgcccgacgagcccctcgcggcactgccccggccccggccccggccccggccccctcccgccgcaccgcccccggcccggccctccgccctccgcactcccgcctccctccctccgcccgctcccgcgccctcctccctccctcctccccagctgtcccgttcgcgtcatgccgagcctcccggccccgccggccccgctgctgctcctcgggctgctgctgctcggctcccggccggcccgcggcgccggcccmgagccccccgtgctgcccatccgttctgagaaggagccgctgcccgttcggggagcggcaggtaggtgggcgcccgggggaggcgcgggcggggagtcgggctcggggcgagtcagcgccagcccggagggggcgcggggcgcaggtggctcggcgcggcgggcggcccggagggtgggcgggggcagaagggcgcggtgcctgggacccgggacccgcgggcagcccccggggcggcacacggcgcgagctgggcagcggcctccagccaagcccgtccccgcaggctgcaccttcggcgggaaggtctatgccttggacgagacgtggcacccggacctaggggagccattcggggtgatgcgctgcgtgctgtgcgcctgcgaggcggtgagtgcaccccgcggccggcccgggccctggcgggtggggagcgccgggtcgcgcgggcgtyggagtggactcggagctgctgagaaggagcccagtcggcagatgttggggatatttttctggtrgaggaaggggaatcagcccctccaattcttaggtgctgttactgatcgcccactctgtgtgaggctctgtgccaactccgtttcgttccctgctcatctaactctcatggcagccttkctagatagagagtattattatccccattttccagacagggaccttgaggcccagagagatgaagtagcttgtctagggtcacgcagcttgtaagtggcagagctggctgactctgcgggacatcyttgcctgggggggtctcatcagttggcatcttgcactcacttgggtttcccgccttttccgggagcagcctcagtggggtcgccgtaccaggggcyctggcagggtcagctgcaagaacatcaaaccagagtgcccaaccccggcctgtgggcagccgcgccagctgccgggacactgctgccagacctgcccccagggtaagtcttgctscgccctgcggggagggaggcagggccaygatactaggtccyrggccacttggatggggcgtcggactggcctttcccatggccagctgaagcccgtgttcttacccccccgcccgcagagcgcagcagttcgragcggcagccgagcggcctgtccttcgagtatccgcgggacccsgagcatcgcagttatagcgaccgcggggagccaggmgctgaggagcgggcccgtggtgacggccacacgggtagggggctggcgaacagcggggttgtggttgaggctgggccaccaaagcggcgtttgacagtgctcaggccatcttcctcccgtcccagacttcgtggcgctgctgacagggccgaggtcgcaggcggtggcacgagcccgagtctcgctgctgcgctctagcctccgcttctctatctcctacaggcggtgagaaaggggaaggagcaaggaggggtcagctgccggggcccgggagggaaactgggagagctgggaggggctgcttttggctcagtccggcctcacccgacctctcattcccaggctggaccgccctaccaggatccgcttctcagactccaatggcagtgtcctgtttgagcaccctgcagcccccacccaagatggcctggtgagatgatgccatttatgagcacttgcccagtctgggcactgtgccgagagcatgctctgcattgcctcccgtggtcctcaccacagcccagtgggaggaaggcactgacattatgatgcccattttacagaagggggaactgagrctcagtaggataatgtgatttgttcaaggtcacacagctagtaagtggtgcagccaggattggaacccaagcatctggctccagcgttctttcttaagcttcctagggcaccctggaggttcctttccatgttcctttttcataagccctgcctgggcatcctaattggcctagcctgcacagtgtctgagcgtagggccttcttgtctctctgctccaggtctgtggggtgtggcgggcagtgcctcggttgtctctgcggctccttagggcagaacagctgcatgtggcacttgtgacactcactcacccttcaggggaggtctgggggcctctcatccggcaccgggccctggctgcaggtagggagcaaagagccccrggcgtgaagttctgagtcttctctatcacccaggaaagggggggagggtttctgacgggctctcatcatcgtcccttccccagagaccttcagtgccatcctgactctagaaggccccccacagcagggcgtagggggcatcaccctgctcactctcagtgacacagaggactccttgcattttttgctgctcttccgagggctgctggaacccaggagtgggggtaagtgggatgggggcaaaacayrtgagaaggttagggagagcacctgtctcagaaaggcccacatgtgcggccttgcaggactaacccaggttcccttgaggctccagattctacaccaggggcagctactgcgagaacttcaggccaatgtctcagcccaggtgagtggggatctggctctcgctgccacctgtcttggcctcttgctattgcccatcacaccctgctctgtccccaggaaccaggctttgctgaggtgctgcccaacctgacagtccaggagatggactggctggtgctgggggagctgcagatggccctggagtgggcargcaggccagggctgcgcatcagtggacacattgctgccaggaagagctgcgacggtgaggcggggkgggggcctggtgcgccgggcatgcacaactgagagacacagacaagtgccagggtgggtgtgggagagatcctgtggactgggggtgtaagcggccatggggtaaacctagcctcacctgtcttgcccctccgtagtcctgcaaagtgtcctttgtggggctgatgccctgatcccagtccagacgggtgctgccggctcagccagcctcacgctgctaggaaatggctccctgatctatcaggtaagagccaggrgctgcagaaggtgggggaggggtggcgtgggcagcaggccccaggcctttactgcctctccactttgccctcctccatccctgcccatcaggtgcaagtggtagggacaagcagtgaggtggtggccatgacactggagaccaagcctcagcggagggatcagcgcactgtcctgtgccacatggctggactccagccaggaggacacacggtgagggctccaggtggagctggaccccagggcccaatgcatgggctgtgggaagccaggttggatgagcagggatgttcattatcatccactcactcatgggttctcccactcattcatttattcatttgacttttttttttttttttttttgagatggagtctggctctgtcaccaggctggagtgcagtggtgtgatcttggcttactgcaacctctgcctcctgggttcaagcgattctcctgcctcagcctcccaagtagctgggaccacaggtgtgcaccaccacacccagctaatttctgtatttttagtagagacggggtttcaccgtgttggccaggatggtcttgatctcttgacctcatggtccgcccacttcggcctcccaaagtgctgggattacaggcgagagccaccgtgcccggcatgatttgacatttttagtgagccccagactagggactagagtacaaagcaaatcatatgtggcccctgtgcttagcaagctcacagtcaaatgggagcattggacctggagaacagtgccacaggccacatattagtaaatgtaatggcaatggttgctacttatagggcctttccatgtgctaggtgctgcattggtggccttacatagtttttggctttcacagtatccatttgagagatgaggaagtgaagacttggagaagttaagttactcttgaaggttgttacatagctaggaagcagcaggggagggccttgaaactgggcctgccaggtccttatcctgtgtttctggtgtgtggaagtgtgtgtgggtggagtgggggcacaaaatggtccaagacttcagaaccttggactcgtgtgagagctgagaaggcctatcctcccctgcccccaggccgtgggtatctgccctgggctgggtgcccgaggggctcatatgctgctgcagaatgagctcttcctgaaygtgggcaccaaggacttcccagacggagagcttcgggggcacgtggctgccctgccctactgtgggcatagcgcccgccatgacagtgagtgtccttaggggtctgtctgccctttggtttcctagaacatttgagggatggtggcagacagccggagcctggtgtgtctttctttgtgcctaagctccggttgccatctgaaggtggggacatatagggtggccctgctggcggactcttcctgttgctgaggttcaagggtctaaaacttgctgctctccaggccctggacctatggacagtgtcttccagctcgtggaatgtgtgctggggagctgggaatgctgggtttgagggcttgccctaggccaccttctcacctgtcatctctcctctgtctggacccagcgctgcccgtgcccctagcaggagccctggtgctaccccctgtgaagagccaagcagcagggcacgcctggctttccttggatacccactgtcacctgcactatgaagtgctgctggctgggcttggtggctcagaacaaggcactgtcactgcccacctccttgggcctcctggaacgccagggcctcggcggctgctgaagggattctatggctcagaggtaaggatgtgatggtaggcggcagcttggaacatttctgttttttagcttgaagggctgtgtgggcctgtgttggggaaagcagagagcaggcagcctggtatagaagagctggcataaataaaataaattaaacagtgatttgtaggctgggtgcagtggctcaagcctgtaatcccagcactttgggaggccaggtgggtggatcacctgaggtaggaagctcaagactagcctgaccaacatggagaaaccccatctctactaaaaatacaaaattagctgggcgtggtggcacatgcctataatcccagctactccagaggctgaggcaggagaatcgcttgaacctgggaggtggaggttgcagtgagccgagatggcgccattgcactccagcctggacagaaagagcaaaaatccgtctcaaaaaaaaaaaaaaaaaaaaaaaaaaagagctggcatgggcttgggagtcagatagacctgggcatgactctgactggctttttattattcattctcctttctaagtctttttttggtggggtgtcttggatagtatgtaatatcctggacctcaggggggtaggtgggatggactaagcccttcaagtggggtgagttctcatggacttggtcagagagacctggcttccaagctccacactattgccaatgggctttgctaccrtgaagactttatttaacctccctggctctcagtttcttcatctgtgaactggggacagtaggctcagccctaaagtgccttattcctatccattgtcctgtctatgtgcaggcccarggtgtggtgaaggacctggagccggaactgctgcggcacctggcaaaaggcatggcctccctgmtgatcaccaccaagggtagccccagaggggagctccgagggcaggtaggtggcgagtgtgggcagtgggggcagtggggagggtgcagagttggaggggcactgtgtgccattgcactagtcacttgctgtctctgagtcctgggggtggtcgtatcacagcgcccccccggctggtggggaggatgagctacatgaggaggctggcagcccggcaccctatccctggcagctgagatgattgtggagcgaatggcatcctcctgggccactgcagcgctcagggggccgaggtgtctcctgctggctggccagctgccgctggtaaagacgcgagggggagccccagcgctgcctcagttggcctctcctcccaggtgcacatagccaaccaatgtgaggttggcggactgcgcctggaggcggccggggccgagggggtgcgggcgctgggggctccggatacagcctctgctgcgccgcctgtggtgcctggtctcccggccctagcgcccgccaaacctggtggtcctgggcggccccgagaccccaacacatgcttcttcgaggggcagcagcgcccccacggggctcgctgggcgcccaactacgacccgctctgctcactctgcacctgccaggtaggaggtcctggaagggcacactgggtcctgggatctggagcaaggggcctggacactcccgtcaatgcctctgctcctctctgcagagacgaacggtgatctgtgacccggtggtgtgcccaccgcccagctgcccacacccggtgcaggctcccgaccagtgctgccctgtttgccctggtgagttccccgyaggggagtggagggaggagttggcccagtgyggacaggtcctttggggagggaatgagggtggtcactctctgctttcaccatttctttggctccacagagaaacaagatgtcagagacttgccagggctgccaaggagccgggacccaggagagggtgagctggaagggtgcgtgcagggtgggaggccccagaggagccattaggttgaaccaggagggggacaagaaggggagagtatatagggggtggcctgaggggcacagattccaagtgatgcctgacaggactcattagtgttactggcccccaggtgggcccttggcttaggctcgtgtgggggtggcctgaggctcaagccttggttgtgggcccagctgatgagctcatactaatggctgctgggccctgttccccaccaggctgctattttgatggtgaccggagctggcgggcagcgggtacgcggtggcaccccgttgtgcccccctttggcttaattaagtgtgctgtctgcacctgcaaggtatggccacccaatcttctctggtgccataacccagcggggtctgcagagatggggaggggctgccaggtgaggaaggcccgtccttggtgaggagggctcaagaatcaaaacgatatgagaaaaggcccttgcgctctgagagtcggcttcctgtgggaaaatgaacagggctgacctgggtgtggattctggctctgccagctaactagtgccagtgaccctaggcaccttctgtccctgagcctcactttcctctcctgtaagcagatatgatggcacctaccttgcagggttctgatgaggagctgagtttaggtctataaagccagtccgggcctctgagtaaaaggccacagagagactgcatttgaggtgtggaataggagagggagtgggcaggaggcttatgtgccccctgcctgacactccttgctcaatggatccctacaggggggcactggagaggtgcactgtgagaaggtgcagtgtccccggctggcctgtgcccagcctgtgcgtgtcaaccccaccgactgctgcaaacagtgtccaggtgagagaggtggctgagmactgaggcctcacctttgggttgaggcaggctttgtcctgggtgaggggaagggtgctcagttaattgagcattatactgagcactgctctgtgcctagcctggagccaggactctaaatgcagtggaaagaatgtgatatactagtggggtatgatgggttctggttcctgctccatccatccgtccatccatccatccatccatccatccatccatccatccatccatccgtccattcatctatctatccacccatacaaccatccacccattgatgcatccatccatgcatccatccatccctccatccatccacccatccacccattgatgcatccatccatccatccatccatccatccatccatccatccrtccgtcccttcatccatccattcatctgcccacccacccatccaaatttatcacctactaagtgccagaaactgcaacgtgctgggtattcaaagagaatactcataaaaccttgttggtcctcctgggctgatcctttctctttccctctcaacagtggggtcgggggcccacccccagctgggggaccccatgcaggctgatgggccccggggctgccgttttgctgggcagtggttcccagagagtcagagctggcacccctcagtgcccccktttggagagatgagctgtatcacctgcagatgtggggtaagtggggagcagaggcttgtgtgaggtgggtactgggagcctggtctggagtagggagaccttcccagggaggtccctgaagaagctgaaggtcactgtgtcccagtgcctctgggggacactcagtgtctgctctgtcttgtaccaggcaggggtgcctcactgtgagcgggatgactgttcactgccactgtcctgtggctcggggaaggagagtcgatgctgttcccgctgcacggcccaccggcggcgtaagtgagggagtccagggtcagcagctgtgagtggagggctcacctgcctgtgggactcctgatcagggaagggagcactcactgtgtgcaggaacagtgcagcctgcctcacaagtgccattccaatccaccctcacagcaacctggtggaattgttatttatgaccttttctttacaaatgagatttctgaagctcagagaaattaagcaacgagatgaaggtcacccagctgtgtgcactgacctgtttagaaaatactggcctttctgggaccaaggcagggatgctttgccctgccctctatgcctctctgtgcctctccactccctctcccctcctccaacattccctcccttctgtctccagcagccccagagaccagaactgatccagagctggagaaagaagccgaaggctcttagggagcagccagagggccaagtgaccaagaggatggggcctgagctggggaaggggtggcatcgaggaccttcttgcattctcctgtgggaagcccagtgcctttgctcctctgtcctgcctctactcccacccccactacctctgggaaccacagctccacaagggggagaggcagctgggccagaccgaggtcacagccactccaagtcctgccctgccaccctcggcctctgtcctggaagccccacccctttcctcctgtacataatgtcactggcttgttgggatttttaatttatcttcactcagcaccaagggcccccgacactccactcctgctgcccctgagctgagcagagtcattattggagagttttgtatttattaaaacatttctttttcagtctttgggcatgaggttggctctttgtggccaggaacctgagtggggcctggtggagaaggggcagagagtaggaggtgagagagaggagctctgacacttggggagctgaaagagacctggagaggcagaggatagcgtggcagttggctggcatgcctgggttccgcagaggggctggggatggttcttgagatggtctagagactcaagaatttagggaagtagaagcaggattttgactcaagtttagtttcccacatcgctggcctgtttgctgacttcatgtttgaagttgctccagagagagaatcaaaggtgtcaccagcccctctctccctccttcccttcccttccctttctttccctccctcccctcccctgaaagggagaaggggaaacatgcccccgggctacacaggcgaaacgagagaatataacgtgaaaagagcgcaacgtcctgcaaaagactacacatagtatggaacgcgctcaggggagagaggcgagattatggcctgtgagggcggacccgcacgcggcgtgaggggacccgcgcgggtgagttggaagtatctgttggccaccgcgtcccgcgccnnnnnnnnnnnnnnnnnnnncatgtccaccgtgggacgttcaccaactccaacaatagaaaacaaaataaatgtgttaggataatagaactaaacacaaaaagaaggaagaggagaacaaaacgcaaacgggccaaacacaacaacagttaaaaagtaattataagaaacaccacgaaagaaaagatttataacacaaatatgacaaaaaataaaaaaaagaaaaaaaaaaaaaaaaacaaaaacaacacaaacccataagaataagaaagcaaacacaatctaaccctctcccccatacccaacagaggccacccaacaaacatgtcacccacccaacataaacctgtcctcccctcccctccccttcccttcactctcccttccctctcccttcccttcccttctccttcgttcacagcaatggggtcttgctatgttgcccaggctggtcttgaactcctggcctcaagtgatcctcctgccttggccttccaaagtgttgggattacaggcatgagccaccacacccagcccagcctctaccttctttgtctaaagtgaggcaaacacttttctgtttttttcctggaaactcgtgttctggaccagttctggggcaaactggggtcagagtggattggaatcagctctgatccagcttttggctgtgcttaccttgagaccaaatcatgtagagaataagacaagaccctcctgccctgttaccctcttctctctcccctccctcattcctaccatcaagacccaggcattttgacaagctctaggaaatgagggtatcagaacagaaatctaacaaatgtatgtagctgcagatccatctttcatataaacaatgtggagtcaaatgaatctgggattttatgatctggtagggcaggggaaagggaaatcatagcttgcttatggagtgttaggcatgctgtatgtggttaagaagttattgtcttagcccattgaagcatcgagttccagttctgctgttaactagctgagttatttaactttcacaaacccccatttcccttttataaaacacatgatatccccctcacaggattcaatcagaacacgtgcattacacaagctcagggcctggcacgtattcgctgcaaaaggcactctccccgaggtgggatttgtggggctggtttggaatgaaggcagggagaatcgcagggaggagagtggccatgggcttcacttgcgtttggcaactgatatgctgctgaatgcttaggggagaggaggggctggactgaggattcagggatgatgaggatggggataaccacttgggccagagccctggctgttaataggaggatcgtgagggccagatagggatgaaaaagcagcagtattcagcacggggttaagtgtgggagtgaggcaccagttgtggtatgatggagatttggcccagaaatggtgtgctgacagtgttgtcctccttggtgtggaactttggtgggaagaagggttggaaagggaaattttgatccttggatttaacccgagtttgttactgatgctcacaagactaggggaaggataaaggcaggtgagtcactctaggatggctcagtgagctccacagagctggaaccacaggcaccaggagggattcagagcaggcctcagtgcacgtcagctgagtgaaccaatgagcaggtgatgggtccaggcagagccctgtcctctttaggcaaaaacccttgaaacaccgttcccatcctagcctgtgttccaaccaaagctggccagtctccaggccctgcctgagccccagggaagtggtatggtgaaacagaagggccagccctgtccagtgtgtgaggaacttcatttcagacttgttggaagccctgatgttcagagacctcaataatatcattcatttttcccatccattcaatgcccattcaatgcccatccattcaatgccccatccattccccttcaggcaactgcacattggtcagagagccctttccctttccaaaaaaccaaaccaaaccaaaaaccctgcaaaaatgcagcaaaatccaagcagaggaccattttcctgggtttagtatttctgtgtctcaaaacagttacctgtagtatttaaaatttgatctctcaccctggggtcagtcaggccttttacatggcagagggtttgactcaaccactgagcttctccagcaaaacagacagaagggaatacatacctgcttggctgaagaaatggggtggttttgatacaacattttttgaagagaaaactccttcatgtgcagtaatccactttgccaagttctccttgtgcgactacctcttaggcattccctagtgatactctgcccacttttaatataccaaatccagattgtgctaaggtaggtgatgaacagcaaacagtttggagctatggcatggtggtatgctggcagctgtcagttcacttttgtccatgtcaccagagcaggatctgtgcagtgacttaagaacaatagttttcaaatcttggccatggatatgtgaaattgccacagggcagagggacagatgggggttccagggacctcctgggagtgggagggccgaggcaggcagatcacctgaggtcaggagttcaagaccagcctgccaacatgatgaaaccccgtctctactaaaaatacaaaaaatcagccaggtgtggtggcgggtgcctgtaatcccagctactcgggaggctgaggcaggagaatcgctggaacctgggaggcagaggttgcagtgagccgagatcgctccattgcactccagcctgggcaacaagagcaaaactctatctcaaaaaaaataaaaataaaaaaataaagtcaactccatcttaaaactagcaggtaggccgggcatggtggctcacgcctgtaatcccagcactttgggaggcggagacagatggatcacctgaggtgaggagttctagaccagcctggagcctggccaacatggtgaaaccccgtctctactaaaaatacaaaaaattagccaggcgtggtggcaggcgcctataatcccagctacttgggaggctgaggcaggagaatcgcttgaacccaggaggcggatgttgcagtgagctgagatcgcgccattgcactcaagcctgggcaacaagagcaagactctgtctcaaaacaaacaagcaaacaaagaaacaaacaaaacaacaaaactagcaggtacgttccttgccagtcatgacccatggtcataagatgtctacagctcaggaagcagcttcacaatgcctgcaaagacaaactcctatgacagcagaatgtcctgatgtccccatatcacataacaatgtatgcttttatgatggttatagtcaagctttgatgtacttacgcactaaaatgccaaggatagttttctttaaatcagcaacataataaatgtcatgctgtcagtcccccacatgtagacataacttagcttttacatggataagaaacctatataagaaaaccttaggccaggtgtggtggctcatgcctgtaatcccagcactttgggaggccgaggcgggtggatcacttgaggtcagtagtttgagaccagcctggccgacatggcgaaaccccgtctctactaaaaatacaaaaattagcccggcatggtggcacatgcctgtaatcccagctacttgggaggctgaggcaggagaattgcttgaactcgagaggcggaggttgcagtgagccgagactgcggccattgccctccagcctgggcgatgagagcgaaacttcatcaaaaaaacaaaaacaaaacaaaacaaaaaacaccttagaagaggcgttcctcctcttgctttctgaagacactctacgctgaaacagtagctttcaataaaccatctcttctcaccgcactctgcgacttgccttgaattcctttgtgtgcaagatccaataagcctctcttgcggtctggatgagaacccctttttttggcaatacttctgacacaacaaaaatggcagaaaggagaggtctcatcatgtaataaaattaaggcagagaaagatttctctgggcatgctgaaagagacacagtttcacttgtcaaatattaggtagtcacatatgatgtgtgatgaaaaaagcctgtgtgtatggaatgcctacatagagggtattatggaatgctggaaatacattgttagggatgacaaaaggggaggacttattagagattgtggaatgactgtgctgctctgagaatggagcttacaacattgtttggctttgatacgttttcatgtacaaagggagctgccagaattatttttgctcttcataaaactaaatcattgttaacaattatggtaatatacaaatatgtgagaaggaaagaaaaatccacctgttattccaactcctggatagccaaccactcttaaaacaaaattactgatggctgggtgcggtggctcacgcctgtaatactagcactttgcagggctgaggcaggtggatcacctgaggtcaggagttcgacaccagcctggccatcatggtgaaaccccatctctactaaaaatacaaaaattacccgggtgtggtggtttgcgcctgtaatcccagctacttaggaggctgggataggagaatcagttgaacactggaggcagaagttgcagtgagccgagatcgcgccattgcagccttggggacagagcgagactccatctcaaaaaaaaaaaaaaaaattcactcagtatttttctaagtgttagtcagtgaaaacttcattacccagctttggccccgctcccactcccacgccaggttctacccctacagtgccttctgcagcgccttgatcctcacctgtgaagtggctgtgatgtcccagcatagggtatttgtgcgacagcttcaggagcaggagtgcacttctttctgcagaaataaggaaagctctggagtgcgtttaagggaaatctgacctttgcattgaaaatggccagggaggtacacaaacaaaaagtttgaaaaaaatcttccctagcttagagaatcgggcaaattttctgcaaactggctagagctcccccaggggaatccatgcttctcagctgatgggtgttgagcaggcctggaggttgtcctctcctcacgtgagcagcagagattggccagggccccagccatttcttgggaggagtcattcacagttttttcttgtccacctgccttggctgggctggctcagcctcttttggagcctccatttttggagttcgtcatgctccactgaggtgccaggcctactgtggggacagagactcctcactctctcatttgggcagtgggacaagcagggggc

SEQ ID NO: 12214 - DNA, 12702 bp, Homo sapiens
gtcttgaactcctgatctcaaatgatctacccgccttggcctcccaaagttctgggattacaggtatgagccaccactcctgggccttcaagtatttctttatagccatgtgagaacagactaatacacagccctagcaaactaatacggtattcatatgtaaaaattcatcaatgtgtgctcctatgatttgtgtactttactgtatgtaagttatatagcaaccaattaattgttttcttctagcaaacagctcaaattactcctaacacatccattctactcttcaccacaaacctgtctcatagtttattcatcattttctgcatggcccattactatttctgattgtattttaactctaccttagctttttcagctgttgcattttgctgtatttttctaaagataagaagagaaatggtgggagagtgtagaattagtataatcttgttattttgagcacttcagtgagctataaattagggtctgctttctagatctactgataattgtttgaacaactttggatgcttctacttctggattccctcacggaaaatggtgataattataaatagccagatctccaaggttgtaaatattactaagatagcatcttaaaattggtgctatacaaatatagaaggcatcattcttcccagttcagtaataaacatggcttaatcttaatgagaacatcatctctccaccctcgttgtgttcctatctcacatcactgtagatctccaaagcaatatgctggagacacaaaggtgtgtgctaactcttcagctagacgtatggtctttaggagttactgctccctgattttgccccttgcttgtttagatttttcctttttgtctatctggagaacacctactcatatttcaaaacttatctagaactctaaagatttatctgaactctttcctctcctgtaatataaaataagccactctttccttgttcctactttcaataccaatgttgcctcatgtggaaatatgaggatgacttctagtactgctaaccatagctgccccttaatgttaccacgtcccaggcactgatctaagttcttcatatgtatatatattatatataacatatatattatatatatagacttgaaatcctaacagcaatcatataatgttcatactatgaaaaaaagaggcataaattgtttaaatgcatttcctaaagtcacacgtgaagtaaacagcaaagccaggctttggacaaagtctgtgtggctctagcatctgttctcttaacctctatgcaattctacctgtcccattattgtgcttcttgctttttaaccccttttctagacttttatgtccttcagggtggaaacattctctgatgtatctagtgtcttgcacatattaggtgctcaataaacatttgctgaatgggtaaatggtatattattcaatagagacactttcactctcatactgaaaacatgccttcaaatttgtattaaatagtctgaggaatctagaatttcaaggaattctgaaacaagtttcttagaagagtacatacatactcttttgtagtgaatattcacttccaggtttctctgagaaaacgtttgaatttttatttgggtttatttaagcaaagttcatttgcaaagataatcaaggagaaaagtattgcctacctcacagcaagtattgggaagattaaatgaagtaaaacacgtaatatattcagagcagtgcctggtacatagaaaaactaaaggaatattaccgttactgttattagaatcaaagacagaagagagtaactgttaagtgcatggactttgataccacactgattggattcaaagcctagctccagtgtttattagttatgtgatcttgagtaagttactaatcctctctgagccaacgtttctccagtatgtaaaatagaataataatagtatggatctcaaatggttgtggtgaagataaaatgttctaagtgatatatatgagtttatttagaacatttaatcctcacaagtatttgagatgcatactattcctattttgcttctaagtgttatatattaatatatttcttctgtctacttgtctgtttatctcacttcaaaagtgcccatcacttagcatgtatgtgtttggtcttattattatgccatattatttatgacacctgacaaataatatgttcattacctgttgactacattaacttaaaagtctaggatgatttctgggttttcatcttgggcctctggatggccagcagtttaaaacaggtaatacaagaggaggaataccatgggatcacagcttggtggtaccactttaggaatgaactgatctgtcccaacgattatgttacaaggggaaagatctgagcttggctgtgagttacacaccacaaagtacgaggtcccacattgatgaatcggggaaaaaaagataatctaaagtaactagatcttagagtactctgtgagattttgctagatacgagcttaaaaagataggctttatttataggcaatcagacgatactgccagcctctattcagaacagagaaaaacagatcagtgttttgtaatgaccacactctgaaaacagtttgcaaactatattatctatcataagaaaccagagattggaggcctgatagtgaaggtcttcaatagtctaaactggagatattataggggtctagacttgcagatcagtgaggatggagaagagatgccagctcactatgaataagggaggtacggtctggtcaagataactgcatgtgtaggtaatgaatctaggatgaccttgagatatgtaagtcgggtggctagttggagagtcaggaaaactctgagatagggaaggtgtctggttgatttggaggtgcatgtggtttatctaggcagagaagtctaggaagcagttggttatatgagtttaaagttcagacaaggggtcagggctatagataaagatttgcccacagaccctatgaaaagaagaggtaaaggagagaatactccaaaatacagtattaactctcagggagttggtagagaaaatggagccagcaaaagagagagaaggagatgttaagagaagtagaaggggaactgagagaaaaaagttactgaagctgaggaggtgaggagagacttttctggagggaggaaggttacatttcagagacctctagtaggataagcaccaaggtcactccatgagattcatcagagcagtcagtagaatgctggctgtggaatctagattttctgcagatggccagagagggaatgggaagtgagattataaagccagcaaataggaactattgttcctagaagtctttgttttattttgttttgttttgtttcgttttgagacagagtttcactcttgttgcccaggctggagtgcaatggcacaatcttggctcactgcaacctccacctcccgggttcaagtgattctcctgcctcagcctccctagtagctgggattacaggcacccgccaccatacccagctaattttttgtatttttagtaaagacagggtttcaccatgttggccaggctggtcttgaactcccgacctcaggtgaaccacccgcctcggcttccgaaagtgctggattacaggcgtgagccaccatgcctggcccctagaagtcttacggtagaggaaagaagcccaagaaggcaaagggttaaggagccgtagagttaagggaaagatctttttttaggatgaggaacactccagagtaagattgaggaaaggtttgaaaaaagatctctaaagatatcatagaaggtgacgggaggtaattaataataacaactaaccattactacattcgtgccatgtgctaagcacgctctgtagtgagtagttttcactcactgactcatttaatccttgctatcatcctggaggcagggacaattgctattgtcttcatttgtcacaggaggaaatcaaggtacagacaggcttagtaacttgctcaaggttacatagccggtactgtaaattgcagagccagaagttcaaactcaggcagtctggttgcagagaatatgatcttcaccattaagctgtactgaccaactctctaaaatgggtctgagaactttgtccaagaagtggttcattgcttccttggagacaaggcagagaagatacttatcagtttggaggctgagaatgtttatacttaatggcccccacctctccttgtcccataaaatagaacgtctattgagagaaaaagatgaagaagcatgaaagcttagaagccaagacctggaagagccactgggattctactagaattaaataaaaagacttctgagtaaaacacagtcctttgaccttaaaaaatatataatacactgaagtagatatgacaagtgcccaaataactataatctggggcaatatgtgtgaagggacataatagacatagaatgttagttgtacaagggttcaccaagggagacactgtgtcaggttatggggtagaaggatcaaaagaatctcaaagtatgtgaaatatttgaaagacagagtttcaacaagcaatccaggagtcttaatatttttccaacagacagcttactaagagcaaggttcaatgaaaacattgttgatagcgattagaggaaactggagttgacgggaatgtggcgcagaggagaaagagtctctgaccaaggcaggatgagagggcaggggttgagggcattgaacctcacttttctaactaaataacagtatccacctccaagattatccttttcctcctccacctcctctagtttctccttgttattgagtgcttatcaaatgcctggcattttgctaagctttttattttttctatctatctatctatctatctatctatctatctatctatctatcatctatctatatcatctatctattatcgagacaaagtctcgctctgtcgcccagtctggaatgcattgtcatgatccccgctcactgcaacctccaccttccgggttcaagcaattctcctgcctcagcctcctgagtagctgggactacaggtgtgcaccaccacacctggcaaatttttatttttagtagagatggggtttcaccatgttggccaggctgatctcaaattcctgacctcaggtgatccacccgccttggcctcccaaagtgctrggattacaggtgtgagccaccacgcccggccaactctttatatattgaatatatttgatcctcatcacagattttgtgaagataacatcatctccatttcacaggtgacttagctgaggctctgagaggttaagttactttcctgaagtctcagagctagatgatggttaaggcagaattccaccaacatctgtttgatcctaaatccttgcttctcatactgcctctcataattgagtaacagcacctggcatataggagatgtccaataaatttataatggacattaataataactaatggatatatgtcaaacaacatgtggtgcttggggtgggttattaaaatgtttaaagtggacagaacgctgttctgcacatgcaccccagaacttaaagtaaaatacaaataataataaaataatttcaaaagtggacagaaaccaaggtacccttgcgggattggcagaagaggaaaaaactcacttttttctctccttttttagtgactacttacttatattaaacttactatgtgtcaggcactgttttaaacactttatacaaataaaccctcttaatattcattacaatctcatttacagatgagaaaactgaggtacaaaacatttaacctaactggcccatgcacacagctagtaagtggcaaagccaggtgatctggctctggagcccatgctctgaaccatgctgtctctgtgagggtcaaatggagccaagcatggaggaccttgtgcatcaagctaaggagagcagctcttcataagccggcgctcggcgagttctcccaggagaaggccatgttcagttcgrgcgccaagatcgtgaaacccaacggcgagaagccggaggagttcgagtccggcatctcccaggctcttctggagctggagatgaactcagamctcaaggctcagctcagagagctgaatattacggcagccaaggaaattgaagttggtggtggtcggaaagctatcataatacttgttcccgttactcaactgaaatctttccagaaaatccaaatccggctagtaagtgaattggagaaaaagttcaktgggaagcatgtcgtctttatcgctcagaggagaattctgcctaagccaactcgaaaaagctgtacaaaaaataagcaaaagcgtcccaggagcagcactgtgacagctgtgcacgatgccatccttgaggacttggtcttcccaagtgaaattgtgggcaagaaaatccgcgtcaaactagatgrcagccggctcataaaggttcatttggacaaarcacaacagaacaatgtggaacacaaggttgaaactttttctggtgtctataagaagctcatgggcaaggatgttaattgtgaattcccagagtttcaatagtaaacaaaaatgactaaataaaaatatatatattcatagtaaaaacacacacacacacacacacacacacacacactaaaacgctaaggagagcaatccttgtccttttgctttctccagtctgaggtctcttctacacctcttacagcagtcattctttttttttttttttttttttttatgagacggagttttgctcttgtttctcgggctggagtgcaatggcgccatcttggctcaccgcaacctctgcctcccgggttcaagtcgttctcctgcctcagcctcctgagtagctggaattacaggcatgcgccaccatgcccggctaattttgtatttttcgtaaagatggggtttctccatgttggtcaggctggtctcaaactcccaatctcaagtgatccacctgcctcagcctcccaaagtgctgggattacagatgtgagccaacatgcccggcacagcagtcattctttaagacttgccctctcagctaatagagtcattgtatcaccaataccctttcatctacatgagattataaactttgtgagagtaaaagatatctgtcatttttgcatttgtgtcccagcacttgccagatacctggcatatggtcaacacataataaatatttatggaataaatgaaagaaagcttcatcaaatcattcatgcttcaggtatcagataggacatatgttcaaggccattcatttggctgtaaaggagtaaatgagactgggtaatttatttttgtttatttatatttagtgttactctttttaatttaacttttattttaagttcagggggtacctgtgcaggtttgttacacaggtaaactcatgtcatggggctttgttgtacagattatttcatcacccaggtattaagcccagtacccgttagttacttttcctgatcctctccctccacccaccctccacctctgataggccccagtatgtgttgttcctctctatgtgtccatgtgttctcatcatttagctcccacttgtaagtaagaacatgcagtatttatttggctttctgttcctgcattagtttgcaaatgataatggccaccaactccatccatgttcctgcaaaggatatgatcttgttctttgttatggctgcatagtattccatggtatatatgcaccacagtttatctagtccaccactgatgggcatttgggttgtttccatgtctttgctattgtgaatagtgctgcaatgaacatacatgtgcatgtgtctttatgatagaatgattatattcttttgggcatatacccagtaatgggattactgagtcaaatggaaattctgtctttagatctttgaggaatcaccacactgtcttccacgatggttgaactaatttacattcccaccaacagtgtataaacactccttttactctgcaacctcgccagcatctgtgttttttttgttgttgttgttggctttgagatggagtcttgctctgtcacccaggctatagtgcagtggcatgatcttggctcaccacaaccccacctcccgggttcaagcaattctcctgcctcagcctcctgagtagctgggattacaggtgcctgccaccacacctggctaatttttgtattttttagtagagacggggtttccccatcttggccaggctggtctcgaactcctgacctcatgatccacccgcctcggcctcccaaagtgctgggattacaggcatgagccactgcacccgggctttttggtttttaataatagccattctgactggtgtgagatggtatctcattgtagttttcatttctctaatgatcagtgatgttgagcttcctttcatatgtttgttggccgcatatatgtctccttttgaaaattgtctgttcatgtcctttgcccactttttttaacgaggttttttttcttgtaaatttgtttaagttccttatagatgctgaatagtcgacctttgtgagatacatagtttgcaaaaatttcctcccattctgtaggtagactgggtaatttataaagaaaaaacgtttatttggctcataattctactggctggaagattgggcatctagtggcagccccagactgtttccacttacgggggaaggcaaaggagagctggcatctacagagatcatgtggtgagcgaggaagtaacacccagctctcctgggaactaacagagtgagaactcactcaccacccactcccaggaagggcattaatctactcatgaggaatccacctctatgatcctaacacctcccattaggcctcacctccaaccttggggatcagatttccatgtgagatttggaggggtcagatgagccaaactacagcaacatataacagaaataggaaaatgtttgccctcatacattgttgtcttaagatgaatagtattcacaaaacaactcaaactcgggcgaagagggtcttcactggggattcatatcataacaacaaattaaacaaacagaaatattataagactcaatttgcagattacctaagacaaaatcaattttatgtattacatgtcttttgctaatgtatattaagaatgtcctcaaaacactctagcattatggttaacaattactctcatgagtcatttgacttgaaaattgatcttcaaattggaaaagcccttagcagcaaataccagcaaagacagattataaaaatttaaggcttaatgggagggagtttgctctgagtgggagttaggtactgaggaagagaacagagttgaacacatgaacagaggagcaggcagaaaacattaaaacaatgcctgtcactgggcgcggtggctcacgcctgtaatcctagcactttgggaggccgaggcgggtggatcacgaggtcaggagatcgagaccgtcctggctaacacggtgaaaccccgtttctactaaaaatacaaaaaattagccaggcgtggtggcgggcacctgtagtcccagctactcgggaggctgaggcaggagaatggcatgaacccgggaggtggagcttgcagtgagccaacatcgcacgactgccctccagcctgggcgacagagtgagactccatctcaaaaaaaaaaaaaaaaaaatctcagcttcccaatttgctagcaatgtggccaagggaatattccttaacttctctgaaacagctttcctctttttaaaatgattacaatagtacctatcttacaggattgttgtatggattaatggagataacatagggaaagcatttagaagagtgcttggtacatagaaagtagtcaacataagttctcattcttgttattgctataattattggcattattcataggagctattaactgccactgtatttgatgtttgaggaatgatgtcctccctcactcccagccattccagtttcttttcactaatgcaaagtaggagaggtccttgattttcatatatattatcctcatgcaacctttgcttttccatgttacatataggcatcctaagctgtttttatggtacattgtccttcatgctgagctacttagtgatgattttgagctaatctgcaatggggataaagattgggctttggcttgagtcagcgtctattcttaacacatctaggttaatgctgaggttaagcctcagcttctcttcctgacattggccgtctatgggaggtttccccaaacccctgcatagccagggactggaacttattcattcatcatttttttttttttagacggagtcttgctctgtctcccaggctggagtgcagtggcgcgatctcagctaactgcaagctccgcctcccgggttcacaccattctcctgcctcagcctcccgagtagctgggactacaggcgcccgccaccaagcacggctaattttttgtatatttagtagagacagggtttcaccgtgttagccaagatggtctcgatctcctgacctcgtgatccgcccgcctcggcctcccaaagtgctaggattacaggcgtgagccaccgcgcccggytcattcatcattattcattacaaaaatttgtgtgccaagtctgccacggtactgggtgttgtctgcatatcacaggaatcactgtccggggcaggtgtttctgggccttcccgggttttccgcctattgccactctgcgcggagagaagcagatatcgaggaacttgtcagcatgagaaagttcatggggagacggggaagaagagccatcatgacatgaaggagcagtcagctcagcccctatttggcttatactatgaaaactggcaaaaagaaaaagcccttttccccacctctggtggaggaacccagcacaggtgatctcaaaggcttaaacactggaggcttcccagctctctgctgcagcttctttcaagcctgagaaacagggggctggctggctacttcaaactgttgattgcctcccactagaggcctctggaaacctgtaaagtttcttacctgcccttccaggttgcctgggttcaaagaggcaattttataagagagactataattaggggttttatggtttgttttgttttgttttgttttgctctctgggaacagaatcctcctcccctataacatgccatatttgttgagtattcactttgtgtcaggcactgtgctaggcattttttattgtttaatgatcacaacccataagactggtattatttattctttgcaagaaatgagaaaagtaatttccccacatttatttacacagctagcaagacataaagctgtgactgaataagcctaatgactgaaatgtctgtggaatgtaaaagaaaaggtgaaatgaagatctacagaggaggtggagatgcaaaacgggagtgggacatggggtatttattaagcaattgaagatcaggttgaagtattggttttctgaatagttcctacccacagttattgtgtaaaaggaggcattaagaaaggtcttgtatctccatacaaaataagacaatggggtccgcagaaaaagaagggaggggtgrttttgtttgggggaaaaagagcattttaaaagaagttgtgtgtgtgtgtgtctatatgtgtgtgtgtatgtgtgtgtgtgtgtgtggtgaaaagtgacactgaataatagagtgtgaacccacagtgctcgctcacattcacaggtaccaattaccagaaaataccaacaaccatggagccatagggatgccatttatggataaaagctatttatgagaatgagaagactcagagtgggattattcctcttgttagtttcctctgggaagtaaattagatgtttcaggagatgtattcaatctttttagaactctacattacatttactgcaatgccaataataatgtgctgctcttggcttccaaaggaggctttctcaacttcagaatctaagccctcctctgtgcaaggtgctgtgctgggactgtgaggcacacaaaggctcagatcacactctccttgtgttgaaggaatttgcaagccagttagggtaacaacacatcacatatatagatacatgtgcaaaatgcagtctagtgtataggtgccaggtaggaatatagtcagtcaattatatataggaactgggggtgagggaggagttatatctaccttcagttagatatccatttatccattcattcattcatgaattcatgcattcattcatctattcaatacatacgcatggaacatcactatgaccttccatatcccaaacactttttttttttttgagatggaattttgccattgttgcccaggctggagtgcaatggcatgatctcagctcactgcaacctccgcctcccaggttcaagtgattctcctgcctcagcctcccgattacaggcatgcctcaccacgcccggctaatttgtatttttagtagagacagggtttctccatgttggtcaggctggtctcgaactcctgacctcaggtaatccgcccacctcagcctcccaaagtgctgggattacaggcgtgagccaccatgcccggca

SEQ ID NO: 12215 - DNA, 13699 bp, Homo sapiens
tagcatctgagtatctccctaacctaccctccaaagaagctgctcttggagatgaaacaacagaacacattgtttatgtcaaaatggggttggtcttcaggtttgaagtccaggctggggtgctgtccctattaagaattcttcagactgtgtagctaaccatgggatatttggttttgtacactttggtgaagatatcatccagggattccagctctttggccatgagacccagagtttcatgggtgaggtctggaggacccagggacatcttggctatccctctggtggactttcctggtcaatgcattatagggggccccttcttccataaaattcctttctggaggtgacataaaacaccactcccttcactgtcatgtagatgggatgtttttcttctctctgtagtgggccggctcctcctcaataaagagcctcaccaggggtttctgcttagtcgggcatggcacctgcctggccagagctgcaagcagccctgggggctgtaccaggaccagggtcaaccctgctagtggctacagctgcaactgggcctgccatagtgaaggggtagagagggcaagggacagcctgggcagtgaagctgttgctgggatctgaggatatagaaataaataagtcagactccctacctcaaggagctcactatccagtgggagagacaggcataaaagtaaacaaatgaaagtacaacaggtaytatgatgaaaatttgctcaaacatccccaaatggttaaggtggtttcatgcctctgtacctttgtttatgytgctgctccccttacctggaacatcccctcctctccattctttttcaaaggaagtttgctaacagataaaactagagagagactggcagggactagggtatgaggaacttgtgtgaaacattaaggagtttggatgttatttagaggtcagtggggggataacagtatgtgtaaatgttgatgggaatgatccagtggggaaggacggtaaaaccagttatttatttgttcatgagtgggtaagaataaatggatgctgataaagtattcaaagtacaagtagacaactcttcagagatgcttgtgtgtaaaacagatcaaatacagatcaacgagagaagcctggaggggaatgtacatcaaagaaaggcttttaagatgacaaatacttgagactatctcaatgctgctggaaggagagcaaaaatactcattcatttactgcataactgtttcaaatggcaagaaagatcactacagtagcagtgagaggaactggggtaaagtagtccaggaatggaagtagggaactctagttagaggataatggcaacagcccaggtgacgatgatggagtagattaaggcagtggaagtagagatgagacagaactcaaatttacagtactaagtctttggtttcctttcataagacaactaccttcttaccctgctaaattctctcccaagcccctttaattttcacctctgatctcctttagctcttcccacttgaactcttcagatgctcctatagcccctcatatgcaccttaagcccctctaagctccagatccttccctctggaagctaagaggtggtgttagggaccctggactcagagtcagacaaatcccaaacagctgtgtgacctttggcaagtctcttactctcgctgatcctcagtctccttaagagggttcaatgggtgatccgactgtgacactattagtctttgatgccctcctcccatccccagtcgcctttccttgcagtcaaggccctaagctaccaccagcctgggaactccagctctgagccaggcctcagctatcttaatatgtgaccttgagcaagtcaagtcccttctctagaaggcgttttcccatttctataatgaggacaggtgtctctgagctgcctgcctcagggctgtcataagagtccaccttagcgtttggagaaccaaagcagacaaacgtggaacgagccagggctttgcagagactcccagctctgacaccaattagctgtgtgatcttgggcaagtgacctagcctcgcggagcctggctacatcatctgaagagctgggacagtactagtgcccacctcacagggctgtcctaaggcccagcagcccgggccgcccctcctcccgcctcctgcccgcctccagccaacccaggcccgcacctgcgcagcagctggatcttgtcgcggtagcggtcgtagaaagggttggcctggagctcggcctcggccccgaccccgctgccgtcggcgcccccctcgggccggcccgagccggggcgcactgggaagacgcgcagctgcgcgggtgacacgagccccaggcccagggcgcggctgcgcaccgcgcacaggccccggtagagaccggccacctgcaggaccgccggtcccgcgccacccgcagccgccaccaccacagcagccatggccgcccccgcctcctcctcctcctcaggcgcgtcggcctcggcccgcggcccgcgcgcccgctccatcccgctccgagtgcgccgcgcccgcgctccggcaccgaggttccgcgcgcccaaggttccgggcgcgggatagcggcgaggcggggcggggaggagggggcgcgccgctctggccccggcactgcgcgctctcgccgccctgtgtatgccacggcccgcctcctccagggaggctgcccaaattcaacgcccttcctccctctgggaccagcagcctctgcgcgccaagtccgttctctaaagccagcggatctccatgtcctcgcggtgcttgcccctggcactcgctgtagtgccaggcactcgatgtagtagtccgtccttcagcatcgaaggtcttttcatcaactataatcacagcagcaagcttctctttactgaggttgctatgtgcaggacactgagcggcttcatactctgtgtggcagtattatcctcatctaacaaataaggaaactgaggccgagagtaattatgtgacttgttcaagttctacccgacagctgagctcttttcaagatggcagctgcctcccaagcctccttttcctctgcttcctgacatcctccttgaactccagccacagtgacctattctctcccaaagaaacaccaggattactccttgaagagtccttattcaggccctttttgacccctggaatcctctctccttccattctctcaacccaaatgccacaatcttccttaccgtctgaaccaggtgtgagctcctagggtcagggacagtgacattaacatctctgtgtcccacctgctcacagaacagggccagtcctggagtgggctctctgggacagtactcatcatcaggtccttcttgtctgggttttgtctgattgaagcccctcctgggacaggggcagagccttcaactctgctcaatccaacctatgctcatggagatcagccctgagccctgccctgtgcgaggaacagtgtaatggaagatgaataagtccttcaagtatgccagcccatacctggctcacactcctaacacttgctgttttctctgtggatctgcatgtggctgcctcctcatcatctaagggctcagttcacatgtaagcacctccaagggacctaaatgacaacccctccatctctttatagtctttatcccatcactctattgcattctctttatagcagttatcattatctgaagttcttagatccttgtttatattaattcattgagcttacattctagtggagtgaaacagacagtaaatatataatgttaggtgatgctacatggtatgcagaaaaacagcaggccaagagagatagagataaggggacacttgagcagagacctgaaggtaatgtgggaatgctgggggaagagccttccaggtaggggaaacagcaagtgcaaaggccctgatgaggaggttattgagtctgaatgagtgagggcacagcagcagaaatgagaccaagaaggtatagggagggctagttagattgcttaggccttggttaaggactttgattttaaatcgaatgagatcggaagttactatatgttttaagcagtggagtaacatgatctactttttaaaaggatcatgctggctgctggtgggatttaggatatgtggaggcaaggatggaaactctcccaagggtgactaatttattccagtttgcctaggactttcttggctctagcattgaaagccccatgtcctgagaacccaccccaagtcctgggcaaaccaggatgttggtcaccctacagggaacagtaatccaagtgagagatggtggtacttggactaaagtgatagtgataaaaaaaagtggccagattttggttatattttgaaataaaagcctaaagatcttgctgatggagtcagtgtgggtgtgatagaatgaaaggagtcaaggatgacttgcaggtttttggcctgaacaacccgaaggacagagatactacttatgaagaggaggaaggctgtaggtagggtagactttggaggatggataatcagagtttggttttggacatgttggtttgggataatttaacagactggcaaggagggatgtcaaccaggtatttgggtatgagtctaaagttctgaggagcattccaggctggagagatacagttgcgtactgtcagtgtatagtgatatttaaagccaggggtctgggtgagataactgatggaatgaatgtagatagagcactaagaactgagccctagacatgcctacatttagagatcaggggaaaagggagaaaccagcaaaggagactggaaagtaggggccagtgatatacgaggagaacaagggtaagtggaccctggagagaattctgtgctaaatagttccctaagtcacacattggaggactataaagaggggagtcattaaaatggtgctaagaagctgagctacaagcagtggtgcaacatactgggaaggctgacttaagcttaattagggaagggctttctaactgagctgcccataaatgcatcaagctgcctcaggaggtggtgagcaagttcctgactcaagtgagtcttgagtccagggagattagttgctgtgtggggaaaaatctacccccaggagtcaagcatggccctgatggtgggatcagatggtggagatgaactagacaactctcaaagtttcttcaaattggcgatgatatgattctgggcagtctgtcacagagtaggggggctgagctgagtcttgaaggatgagcaggtgttcagtggtggaaaagtgggcaggggcactcctgggtgaaggagcagcatgggcacacctccagagatgtgaatgagcagggtctgttcaggagtacggactaggcaaaagggaaaagtgtgtggaggacgaggagggaagtaaggctggaagtagatgcaggccagatggtgggaagccccacagggcctggggcctgggaaacacttgtcagcacttgaaggaaggtaattaaataaaagacagattgttggagccaaagaaggaggtattgaccacttggttcccttgagcaggtttcttcctgccaacttggttagatactttttgagaacagggctgcccaatgctgtgtgttccttgttacattcctcactggggacaggtatcccatcaaccgttccctaaagaccagcaacatccgtaagtacctgagggacaatggcccttttctggggtctgctctgtgggttcaccataaggggtaggtacagacaattcaataggtgaaccagtctctgatggaagtagtagtgacattccacccaaaaaatgccactggatgaagtcccctccttccattaacccaggaccactkcacaagcactgcccctagaatgcccaattctcagaacccagtgacctctcctttagagaacaaagggcctgggcattctggagactctgattggctgggcagatgggctgactggctgggcagatgggtgggtgagttccctctccccagagccatcggccaggtaccaaagctcagctgtatggattcccaacaggaggacctgcgcttccctgggagtaagtgctcctccagtccctgtcactggacttgtgccttagggcttggggacaaacactcagggaaggccctttgcatggatgggacagtgcctggctgcctggaggagagctaagcagttaggagatagtctactctagaaaactaagaattattttaaggcaaagaccatgctckgatcaaccagagaagatactatcaatagcccaggactatcacagctgaatggaatgggatgggacattggtgtctctgtcaactgatgaactttcacttttttttttttttttgagatgaagttttgctctgttgccccggctggagtgcagtggctcaatctaggctcactgtaacctccacctcctggattcaagtgattctcctgcctcagcctctgaagtagctgggactgcaggcatgcaccaccacacctggctaattttaaaatttttagtagagacggggtttcaccatgttggccaggctggacttgawgtcctgacctcaagtgatctgcccacctgggcctcacaaagtgctggtgaacttttgcttcttgatggacttgcccatagtgaaacttctcagtctgatggattggatgggtcctgggttaggaatcagaggcttgactgagcctgggcagcacatgcccccgctagacctagcttttgtgatctgtaaagagttaaaggtggtgcttaagctccctggaaatctagctttgactgaataagggaatgatgaggcaagtcaataagggagggaaggaacggtgagagtagttaagtggatggagygattgatgcatgggttaagtgaaagaggaatgagaaacagctcaggccccaagctacagctatcagccagcatgcctctttttctttcttgctgccttartgtgggtctcattgtactttggaatcctggggctgtgttctgtgataactggagggtgcattatctttctgcactggaggaagaacttgaggcgggaagagcatgcccagcagtgggtggaggtgatgagagctgccacattcacctacagcccattgttgtactggattaacaagcgacggcgctacggcatgaatgcagccatcaacacgggccctgcccctgctgtcaccaagactgagactgaggtccagaatccagatgttctgtgggakttggacatccccgaaggcaggagccatgctgaccaagacagcaaccccaaggcggaagcccctgctcccctgcaacctgcactgcagctggctccacagcagccccaggccagatccccattcccacttcccatctttcaggaggtgccctttgccccacccttgtgcaacctaccccccctgctgaaccactctgtctcctatcctttggccacctgtcctgaaaggaatgttctcttccattccctcctgaatctggcccaggaagaccatagcttcaatgycaagccttttccttcagaactgtagcctcctctcacygaaggtgggagctgcaggaatcaggtgcagagtaggaaatggaactaacctcaggaaggtggtattgacagaggtcaggacccacctggatgtcatgctatgaaacattaaaagaaaaaaaaaaaagtccaaggctccctcgtttctcatttgctgttaggaaggcaatgtccttcctgtctgatggggtcactttgcaaaccaagttggttgctgagtctcaccaatatgaactggcactggtggttggctgtggggagacacactgaaccagtacttgtggatggactcaatatccctctgttcagtatttaaaacaaaaatgtgtgccaggccctggcctaggtaccccaaggcactggtgttctgtgggatgtgaagcacagctgccaccagagtgatagctgctgagggtacgtgagctatgttgatttacagtcgctatgtcacaggcaaaatgagtcatcacgagccctgtgagccacactgcactatgggctgaaatgcattctttgttattatctatgatgtatgcagctcttacgtggttgcctctttacattatttctaataattcacaagaacactgccaaatggatatcatgatcctcctcttatggatgaagagacaggttccaagggcatatgccatacctttcttagttgcagagccagttctcaaatctacatctgccttgcatcaaagttactggtatgaaagttattgatcatcagttgcttggcatcaaaggtactgatcttcccaccatacgccatagtgccccttccctaatgatatgtcgtgttagaaaacacttggtgaatgcttcggattgtatgtagggtgtcattaagttggtccatgaactggcttggaggaagggctggtcagtgaactgcctaaaattatacgtagacatatatccatagtttttacctttcctacaggaatccatgtccccctcccaaaagttaagatccaccacatgggaatattaataatttttgtacttctggaaatggttctaaaaggtgagacaaagataatactgcccatttggctgcagttttgaggtaagaaagcccagctctatcacaggatatgtgtttctccctttccttttggaaatgaacaaatcctctcattatatttgtaaataacaaaagctttatgtatagtcatttacataatgactgagggggaaggtcaccagattctgtgttgcggggagggggggaggtatccagaatctagcaaacatgtagagttatttttttctgtgtgtgaaaaagttttagcttgtgtatgacccctctttagcaacggattttaagcttttttttttttttaaggtggtgggacatttatggcaaacacgcttttatattgactctcaaaaaataaaacaggcctaagtggagcatctcgggtagacacaggggcagggctcactcctgcctcacctcacccctcccatcctctggatgcaaaaagcctgaaccctgcagcctttgcttcttcaggccaaatattgcagtccttaaggcagactcttaattactttgggcccaccatgtgttactccttgctttcaaaaggtgtaaggcgtccataaatatagaaatcaaagcagattttttttttcccttaaaaatcgcaggggagtgagagaggctttagtcagacacattgagagaaaaaagaaatttttttatttagctaaattaaaatggctgtgttacttatttgaaatatgcaaagctcaaatcaagtcatggaarccctgaattctccctaaacagaaccaaaattgcttatacattaccaaaatagcttcactaaaamaaagtagatttaaatttcttaatatgagaaaacaacaaggtaggttaggttcgtataacaaacaatacacgctctataaagtctcaggawtacccaaatgtgttctggtttggatatgaaagagggaccacttctagctggtgttggtaagcaagccaatgaggtgtgcagcaaacaaaacctgtcactaaaaacaactcaacaggccattatgagtatgagcccatcacagccaaaatcctcaactgtgaccggcaggaccagcaagggggggtgttgaaggggttatgaacagcaaccataaagaaaggaatctccaacagaagggacaatggccagcagtaggtgaagggaacccattcttcagctctgttgcatcatacacattcctgagggtcaggcacctctgccttttagatgacaccacagtcatctagaagtcaggttttctcttcttttggttcttctttttatatgctacctttttgcctctctgatttatggggaggctcttttagtaaacattatacaagatagtacaaggcaaaagaaaacaaggaccaagaagcagtgctttgagtaacttaggaaagcagcagtaggagctgccagactgaaaaggtaaaagggtttaaaaccaaaaccaaaaccaaactcactatccagtcttcctctcagagatgagatatggctggtgaggcttgactacagctaaatacaagtcacaggcttagtaagttaagacaacatacaaataaaagtcccaaattcacactaaataataggcttatgggatgcttaagccagtgagtctgctcaactcagaagaaaggagttcaagataccctacttttgcctggaagatgtactttctcaggcaggatgacaaaaatattcatagatctgagaatgcagtataaacacctctgccaaacttggtagggggagaggatggtactgtatactggctcaggggtgatactagtcagacaagcacaaggtaggaagaacagaagataaaccaaaaaacaaaatggatttctccatgtatagttatctgatgcaagggaaaatacacacaacaaagagttaaggtgtcttcaaagtatctgcctatgaataagaatttgaaactaaaaaggacaagctacattaccctcaagtatatttcatataaatcagttctcaaaaaaataccttccaggtacagacatactatttatggtacagtatatacaaatatagcagtataattcaatttattgctagaattttatttggttgttagaaaatctgtaagggtgtatatatattaaaaaaaggtgtggggtgagagtggatggaaggcagtcagaagggtgagagttattttcaagttacctaaagtgccaggctaatttgttttaacctttccaagaaagtgaaactgagcataagctataatgagataaggggacacattcatgggaaaagacttcatcttgctttaactaaattttaatacttctggaaaaaaaatttaagtttggttaataccaagctgaacatcatgtaaagaaaaaaaaaacagcccttaaatgtttaagggtaccggactgtatccatggtgaagggcaacctgaacaaagttaaaaaggaaatgatctccactaaagaagtctgtggcatgacagctttctctactttctccctgacttggcctataccaaagttaagtttttgtagtttttttttcccctttcaagttgttgcccaaagactgcttctaagaacaacacagcaattctagactcaacatacaggagacatggaggtattattcctttcaatctagggatctttcatgccaggtccacagaagcatttaaaggaagtattgtacttgattgtattagatttgaaaaacttgctaccaccatgtgaaggccctagctccaggcctgccctgctatactttggcatcctttgggtagaaagcctctagctacttctgagctggtaatggtaaggaaactgaatattatttcacatgtttcatctcacagcctttttggctttagtcatcccccagagaaacatattaggctcttggttagcctctaggtaaaatctcaaggggtatggttttctgggtcaaaattagaagcacagctctcttctaaagctctgggtggtcagtgtgagataatggctgggggaatttagccctgccattcaaatggagatggtactggtggtgggagccagctacggctttaagacagacttaagtgggtgggtkgggaaggcaatctagctcactcagcagggaaaatggagctccccaatggataactttttatgctcataaaccctgaaatagtactaaaaatgagaaaaatccccaagacttctctgattcccaggttgggattagctgagggaataggaacaaagaaccagaatcctacttccatgagccatgcctggagtcagtattgtctccagtgtctactccctgaaatcggttcctccagctaccaggacaaaccccctggcagcgcctgggcctttgagggataccttatggagacatggatgtagtttcagctgccacctacaccagatcagcaatttttaataagtcatttgttcatatcctgttcaaaaccattcttcctactttccacacaatatgcacaatgctttctttcatttaaatatttacaaacagaaaaggcctatcttttaaagaaaagacattttctgagtctctataaagtgcagctaatttaaggcaaatttaagtgaaatataaaagtggcttattctctctctatatacatttcccagctttaaaagataaggtctcctcccctcaaaaaaaggaaagagaaaaaaagagggctttaattttttttctggcaattttaaaatgtaagatcttactggttgtaggaaatcatagatttctgaacatcataagtaaaatggtcttcttctttaaaaaaataacttttatatagcttcttcaaacaagttaaaaggtggcaaagtatctgctacagtagtttggaggactagaggactgatgggtaagtaagggttgttttgttgttaggtaaatagatattaggcagtccatttctaaaatatgcctgatgaagctagatacctaaagctacccttagctccaggaatgagtatcttccatctccatcggaatcaaatgctctcaagctctctggttctggcatagcagaacctagggaggtccagatttcctggtaggtcagcttcccatccacgtcctggccagtcttgcggaataaatcctgaagatctgtcaaaaatgaattacaaaaaatgtatacgtctaaacatacagctaaatttagttaaaagtagtctcaactgaatttaaaacactaaaagaaaagctactccgcaaattttgtttccaaatggtaaagtttaggatttcactaaatcaggaagactaatttttgatcccttaaaaatatattaaaaaaaaaaaaaggctgggtgcagtggcttatgcctataatcccaacactctgggaggctgaggcaggaggattgcttgaggccaggaatttgagaccagcctgggcaacacagtgagacactgccaaagtagaagcagtgacagataatcgcaggagaatgaatggtctcatcttctctctgtccagcgtcttccctttagattttcctgaatttattcttatgttgaaggggtgaaaaggaatgcagaggcctaatgagttatgtgataggagctagctcataaaacagactgtggcatattgtgagatttcttgttggatggctgagtggagactggaggaatgacttggaagcccataaaacaatcccaaacactcatagctttctcagttttgacaggaaatccaaagctcaaagaggaaagtaacttgcctacggtcatgtaactcttaagtggaatacaatacaaatttcttttcttttttttgaagctaagtctcactctgtcgcccacgctggagtgcagtggcgcgatcttggttcactgcaacctctgcctcctgggttcaagtgattcttgtgcttcagcctcctgcgtagctgggattacaggcgcccgccaccacgcccagctaattttttttaatgtttagtagagatggggtttcaccatgttggccaggctggtcttgaactcctgacctcaggtgattcgcccacct

SEQ ID NO: 12216 - DNA, 17239 bp, Homo sapiens
  misc_feature (1)...(17239): n = A,T,C or G, or insertion/deletion polymorphism (see Tables 1-2)
gaagccccaccagcatcacccagagctaatggcaacctcctcaaggcacccatacccagccagcaaccaacagggctgctgacctccggcctcagccgaccctaccagccaggccttgctgagccacgcccacttcacctgtgttcagttgcttccggcaggaggggacgctggggtccgcttttgcaggtcatgccaccgaattcaaatgtggtatccgttttgtgttttcagtcgtccctgcattttcttcgtctgaaatcaggacgctaagtagctacagctgtttgtgccgcctttgagaaaatctcatcctgaactcgagaacacagactcaacaggcagacggccgggaagctacaaggcagcgcctcacaacactctcttctttttcattctactaaaagttgctctcaaatcctactggacagaaagtcctaaagcattccaaatgttgctccatttccaaaagtgccggcgctgcctccttgggatcagaggccttctgcgcttgagcctggcacctgccctgggccccagtggacgggtccttcctcttggaccactggccccatgcattgtccatcctcaacaccttccctgtggtgcccagaggcagcgtccaggagcacacccaggtgcccagcgggaccccggagctccctttgaacaggcaccttctggggctggggcccccatgtctgggggggaatagggggctggggcccgtgtctagggagttatgggaccttgcatctgagggggtgtggtggggggctggggcctgcatctgagggggtgtggtggggggctggggcctgcatctgagggggtgtggtggggggctggggcctgcatctgaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtggtggggggctgggcccctgtatctgagagggttgtggtggggggctagacccctgcatctgagagggttatggttgggggctggggtctgcatctgagggccatgggacctgggtttgtggctgctggttcgcctctgggctctgctgcttctcacagtagtcgctgagccatcgcgggtcctgatgtctcacgcgagaagcaggcctgggcaggtggcacctttgggagaaagcgaagggcagcctgggctggaggctgcacccaggcactgtggtcagtggctggggaatgagacacggccctcctgggccccgtgtcccttgtggtggggtctgagtgcctacttctctcaccatggccctcggggtcccgtgcctctgcggcctgagcctgcggtgggtcctggcgcagcacctggacacgggcctccctgcctgaggcctccttccttccttttcacccccctgagcctccttgcccttggctggctgagccggcacatccccgtggcgcctctgcacctcccctgagatcattctgccagcacggtcctcactgcaccctccggtcctccctgcaccctacggccctcccctgagattatttcgccagcccgatcctgcaccctcccggctgccactgcccctccccagggaggccgccacagatgcaatggccggctcaggttggctcctcagtggttgaaagtggttttgtttttggtggaacttgggggcagtgagaggcttgagattattcgttgagatagttttccagaaagaaaaaaatgtcacagataattggttctttgcacttgtaatataaacgcagtaatctttattctaacttttgctagagaaattgaagtcgatgatagcccctttcaattttaagcaggaaccaaagtcaacagaaattctgagtcatagaatcaggccaactgacataaagaaaaaaaaaaaacctgggtcactcacaaccactaggatggcagaaagacaggaagaaagagaatgaaaaaaaaaataagacgttatggcaaaaggatccagagaaatttgggacccttgagcattgctcgtgagaaccattgtggaaacgatagaggggctgcccaagagttcattacagcaaatggacttagcatgcgatccagcagctccactcctacaactgaagacacagactccagcaaatacttgttcatacatgttcataatatcattcgttacagtggccagaaggtgggaacagcccaaatgtccatcaacagatggacgagcaaaatgcggtccatccatgagatggaatattactcggccctaaacaacagtgaagaagtacttgtaagaccttgacaacatgcatgaaccttgaagacgttaagcttgtggaagaagccagatacacaggaccacgtgttgtgtggttccattcatacaaaatgcccaggacaggcaaatctatggaggcaaagtaggttgctacttgccagcctggaggatcagggggtgaggagaaactgtgcagggagttcagagcctcctctggagtcggggaagcgttctggactagatggaggtgggacacaccgaaccgttcacttccacatgctccacgttacagttgtgaatttcactgcaataaattagggttattttaaatacttgggccaaacctcagatttgctgatcattaatccgtggctttgggagccactgagacttggctgtgctgactcccctcctctgcaagttggaagaaaaactcttcccggaggatggttcagacaagtaagtcaaagcgtgaacacaccagcagagcacctgccctatacctgcatggtacctgagcatgaaagacgttcaagaacattctcttccgtcctctgagtcactagcagatggcctgtttcctgctgaaagaagcacctggtacttggtgtttacgaactccactcagtaagcggatcagtagcaacaagggcactttggccgtcagacgcagaagtagcgttttcctccagaacaccacctgtggttgggacagtgccgtgcagccccagcatgtctgtgacgcacacctcctgcctgcggggtggtccccctcccgccacccggttcttccgggttttcgagccctgccctcagcttcccctccttcctcctctccccgattttccagccctgccctcggcttcccctcctccctcctctccccctggcaccgttaaaacattcatgctgggccagatcatgctttttgacaatgtctaacgagctagcaatgaatgataaatctgccgggccgcctctgtgtctcaaagccactaggatctgcagctgtttcaagagcacagaacaagaaagcctccaggaaagggggaaagagcggcatctgagcttggaggaagtcatttctgtgaaaatcttttaatgcaacagggagctaagcaagtgggctgtgtgtgctgtggaaggtggcgatgttggggtcttgcctcctgcagtggatgccggcgacagggcctcgggtggctctcttaggacccacaggccctgcatctggattggtcaagtcccaggggccaggcctgcctcagaggtcctgggcatttcacggctggagggcactgcggaggtccatctgctgccccatggaggagagcgggtgctcagacaccaatcttggtgcccaatcatttcccctcctctgaccttgagggaaaaagccaagatgcagcctctggacaccaaccttgagacattctcagctctcagctcatcagcagagcctggactcattactccagggaagaagctctgcttccgtgggccaggggtaaggtcagacgcaagggcctgaggccacatgggagcccaagcagcaggaggccccaggccagtcagagccctcagggcctcccaggggctggcaggagcacctgctcagtggcgagatgaatgtcctaaaatgctattaacggagttcagtctagggtttaaatcaatttggcaaacatttattgagtgcccactcccaataaggttctgaaaaggctcttgaaaaaatgtctgtgcttttgaatttcaaatgattggttttagtattaggagcaacagaaatcctgttatcactcatccaaataatcagaattaatttaggagttgatggcaagcagagtccgttggtaattaggaaacatggagaaataattaaccatggcaagaaatgcggttacatttaactcctgcgaagttaaaaaagaaccatggtacttttctctgtgaggcttagcaatcccagtgctggtgagagtggcgcctgcctgagcccgtgaggagccctgcgctgttccccaccctgggtgccatgctggccgctgggcccttccttcagggaagccaagctggatccctgagtcactagggcgactgggtggggccttggccggatgacctcccttcagagaaggaccagggcctaactccatgtcttttgtaaatttatttttttaagcctgaatagaaaatgtctccattattcactttagttttaaatataggcgccttctcccggctggaatccccactgctaagctgggaggagcctccaagctggagcgctgggcttgtccagccaggcagcagacactgtggggaggcagtgtgacatccatcagggctctctgtggcaatgacactgcattccttttagaaaactccctctcctccagtcttcctcctgaaggccacccctctctaccagcactcggctcaggaggcctgcgtggctctgactgatgcctttctcggcagctctgtccaggggctaagggaggtgcagatgagtccctgagcgccctcatggggattggtcatttcagtccccatcctgggttcccctggaggatgtgggctccatggtgctgggccgtgactctctctgcctcagtgctcccaatacccccagccgtggaccctggtgagccccatgcaagtgaagcagcccctcccaaaccctccatccttggaacgctgtactgcggctgccaactcctctggcctccactgcagacacacagggctcctctctggagctgaagctgtacctccaggagacactgagttctaggcttagcgccatagcgagccagccccttctccaggatgactgccagggggaagtgtctgtgcatgtgtgtgtttacgtgtgtgtttgtatgtgtgtgtgtgtgtgtgtgtgtgcatgtgcctctcacatgtgtctgtgattaccacccagcaactcctagacctgccctgtcccatggaactttccggggtgtggagacgattcttagcactgagggtcgccacagccacgtgagtgctgggacacaaccactgcaactgaggagcggagttttaattctgttcactttaaattaatttaagtagccacatgtggctaagggcccatactggacagtcggttcttaaaggaggtgaatttgagattttccctcagaagcctcctctgagttctgcctgtgctctcgggggtctcagcatctcgggcgccttccccgccaggcacccccggggcgaacgaggaccgtgggcctgtcctgccaccatcgctctggaggtgaggatgcggctcccggacacccgagggcgccctcctgagcctgagccggacagagcgggggtcgcgggagcttcccggcgccggcgcagccccaggaggagggacgggtcctcgcggtgggtgacggtgtcaccgccagcatcgcctctcccgggtttcggggtggccggggcgcctcctcaccggggcggccgcagagcagggaccccagtgcctcccatggccgccccgacaggggacgttcccgcccggggccattctcaccgcatcgcgcccgggcgggagcagcgctggggcggccggggctggtctcggcggctcctggcccaggttcgtggctctcgcgttccccggggtctgggcctgcgccggcggcggggcgtcttccacccagtgatgtggcgatgcctcccgggctcatgggggaatgtcgggtcggcttcgcgctgggcccacggcctcctcccggtgagacgccctcagggctcccccatctcagcgcccgggacgccgcagccatctcggtgggctgaagggaagtaagattcttgcagagggcgcctgccccagaaaacaaatttcatgtacaggtttcaaagaggccaagacgtccgtggcttccttcaggagaaagcggcaaaacccacgcccagatccgttgtgctttcagcttttcaccaggaaactcacttttctatgtaagagcaagcgagttccacagcgcggggaggccagtggagaggagcgcggccttgcctggctcatgtcctgtttccagcttgccctgaaaacgaattactaaatccatggaggaagagcttggggcctgcctggtcctcggccacggtggggctggggcctgtgactgcgtgtgcagagggtccgcgcccagggcccgggaaaggggctgcgctgccccgagcgagtccccgggcgcccccagcctgctgcagccacctcgggctccacatttcggccccttctcctctccgctgctctgggctcagccaccaagctccacgctgtgggcagaatccactnnnnnnnnnnnnnnnnnnnnnnnnnnnnnnnnnnnnnnnnnnnnnnnnnnnnnnnnnnnnnnnnnnnnnnnnnnnnntctgctgcgactcagctgtggtaggggccaagtttgggtgtgtgaggccagggaggtgcgttgtgttctcgcggaagagagagacgcagcgagggagcccgggcacacggacccagytcaccaacmgcagccaaaccaccaattctgtcccgtggcccttggtgaccggtgacagggagggaaggaaacgtggccagcttccgccagaccacaggcgaacacaggtggggcggcccactggcttgggcctaggagctgcaggagcaggggccacggtccagcctgacgcccctctcttggggcaggaagttccctctgtctgccrtgagcaggggcacttgggagggcccagcataggacctcaggagctcccggagcagcctcagcagccgcaacccctcgaccttgtccagcatcacgccccggtgccagggagacagaccgaagaatcccaccactgtgcaggagaggaagcctactttaattctgttcttgaagtaatggcaggtgaagattcgtatgtcataattaattcctcacttcttaggaatcgcagcgattagctctgtcattcctttgttatcagagagaactgtgagtcctgttattctcactgcttcgccatctgtgagcatgcgcagccctcggctaagttttctaaaaggaacatcacagcgacttccctgacctcagccaggacaaaaggtgaagtctagcacgacgacccgtgcagcctgcatggctggaggccctcccttcccggtctctgggcacaggtgcggggccgtgcgcgcgcgtgcgcctccacggttcctccgggcacaggtgcgggagctgcgcgcgtgcgtgctcctccagggttcctccgggcacgggtgcggggccgtgcgcgtgcgtgcgcctccacgggtcctccgggcacaggtgcggggccgtgcgcgtgcttgcgcctccatggttcctccgggcacaggtgtggggccgtgcgcgtgcgtgcgcctccacggttcctccgagcacaggtgcggggctgtgctcggagcgcctccaggttcctctgggcacaggtgcagggccgtgcaccaagtgcctccacggttcctgtgaaggagtgcgatggccctgtaatttttgtcctcagctccggtttaccacagcttaggcctttggggtcattttaaagtagtaaagaagcttgaaaggtaatcccaaaccaggtggtccttaaatcattactgggttcgaagaataattatcatcagaataatttattatgcatataattgtaactgtgccctgtggacactgcacatggttaaatcaacaccaggagggtattttggtttctaagaactttaaaaatataaggcagatggcattaatacagacaagtaatgaatgaataagaattcataacaatgaagctctaatgcaacgtatgattgaatagggcagcttagaagcctggaaattaggaggctcggtaagatgaattgggtggtggtttccaaacctcctaccagcatttggaagagaccccagggatcagggcatctccagaatccaagccagctctgcatgtccggccagtgcctgcagcattttggtgctgagatagcatcgtgggtggcccatggaaggacgtgtttgatggaagggagataagaaatggccctaataaggaaaggaaaaactctaagctggccagagcttccaagttgtccacctgaggacttggaagagtcgatgatctgagcttgcatctgcagggctgagggtgagcaggggtgagggtagcagagataagagcttgagccaaggagtaaggggtgtgacccaccccttgcttgagcatggtctgtgctgatggtgcacttctcaccaacagcagggcacagggtgtggggcatccagtctgagattaggttaaaaagactgtggcttttgctttggggacactcccggctcatgctgttccgtgccctctgcccgtcataaggacacttggcagccctgggaaggggtcacatggggaggaccagggcctgtgggcagcctggtgaggggctcagacaccccacaggagcctgcaggggcaggaagagatttgggggagaggaaaagatttgctatttaggttgtggtactggtttcttggctgtatacatatgttaggctgataatacttcaattgcacgctgtttatcacactttaattatacactaatgagactgtaaaaactgaggaggtggcattattcgtggagaagaaaaagctcagattaaacaggcagtgggaagacatggtgttcaggggaggtgagcccaggcgtgcagatgctgagcatgggcggtatttgtcaggtgatggagaagctggcatgcattatacctggcaggagtttgaagatcttccatctgtgtttggatgaccacattggctgcagggcgtgtagacagtgttgttgagaattggcttgagtgcaaaggttaaaatgtacagtcactctggggagtagaaagttttgccctttttgaggtgtagggcatgacctttaacactcccaccatcagcagggagaagaggaatgaaaagcacaggaaaacaggccagggagttcatggatggaaatggcatcacaggcaacagccactcacgaagatggacgaggacccaagagagaaccagcgctgctctacacctgcctgtcagtttgtagtggagaggggcactgtccgccgagcctccatccgtggaaacgctcctcttcgagcccggccattgctctggctgggcctggtgaggaatggccgtcatcacggacagtggcctttcctagccctgaccctgcagagtgcctctggagcgcatagtgctggcggacaggaagtcagcagatcgaagacagggtcccggcttcacggtgggtgagccgtgtgatgtttgggcaagtccctcagtctctccactgagctgggtgtgaacgtggtgctctgtggcagtggcacgtgatgactcctgcatggagttctcgtctcagcaggggcagtgccttgcaccccgattttcaagcagcaacctgagagtcctgggaggcccgtcttttcccctcggtctttctgttggccccaccactcacatatttcaggcctcaccaagtcctgttaatcccatttccaaaaaatgcctggaagcttctactcctggctctgcagcctccacctttctctgagctctgcggacgcttcctcacatcagccctggatgactccaggagcctccaaagggagcccctgcttcctgttcccctcccctgcgacctgctgcccatgtgctcccaaggggctcgttcctccgtgtggatgggatcgtgttcctgctcccctgccccacaacccactgcccgtgtgcacccgaggggcatgtttttctgtgtgagtgggatcatgagcctctttccttggtagatgttctctttgcgctggaatgaaacctcagctcccctgtgacaggaagctccccatgggccagtgctgggttttggtctgtcggcatgtgctctccacccagagaagactcacagctggctgctcctctcacccctgaggcttcacagtaaacatcgactcacaggaggggaccacgtgattcccaccgcgtgtcctgttccctccacggagcatgagcttgaccatggtacaaagcaccgcacagctgctttaaccctgggagagaagtgtctttatgagattctctgtgtccccaggaaatgctgccttctcctgtgaagcagtcagtgggccaggcccagtccttaaagatgcagagaacccaacaggcccctcttctgctcacagcttcaccttatgttatgcaaaatccccacaccactagagcatgctggcactgggtcatgggcgcctgcayttcccgcaagcttgtgactcggggtgcgatacctcagcccgtttccaagcagccccatgagatcagggcttattgtgtttgctccatgtatcatgagggtgcatcctgagaaggagagactcgcaggtgggtgcaaatgatttgcagtcacagaggagccaagagctcctgacgggactaatgaaagcatgcctcactttagccctgggccaggttcacgcctcaccttagccctgggcgggttcacgcctcaccttagccctgggccaggctgctgtgtgccatgtgctgtttcttcatcggggggtttgggtacagaaatactaaaaatgaatcttgaaagaggtactgatggcttcttgcagttttttggatacaaacagattggttttttctcaaagaagatgagtgactatgttgtcagtgtcatggtgcaaagatgaatacgcacctgcggctaacaaagctcccagcgatgggggatgacctcgcaaatgtgtcgtgaaatgtgcagaagagggtttcatatgcaggacagaagtatctgggggataggtgagcagtcatttctcacttactcatctctgggcactgtgacgtgactcacatctgcaatcccagtactttcagaggccaaggtgggaggattgcttaaggccaggggttcaagaccagcctgggcaacatagcaagaccccatctctacaaaaaattaaaaaattaaccacatgtggtggcatgcatctgtagtcccagctactcggccggctgaggtgggagaatggcttgagcccaggagatcgaggctgcagtgagctatgatcctgcccctgcacttcagcctgggccacagagtgagatcgtgtctgtaaaaaatcatcatcatcgtaaaatgaatcacctgccacctgccatccatccttctttctgaaccgtgtctggtcagtttcctcccagggacctggtctcctgctcctggctgtaacttggtgtaagagttaaagaaagaagaaagaatcatgaaaagtggtttgacagtccaagacaggtttattttggagaataaacctgagaggggcttctggctgatttcagtcgggagcattctctcttacagactaagaatatttagggtttagaatattaaggagcttgtcacaggcttggattgtttctatgtgagggaaagtttattgcagggttgggatgtctctagtcagaggggagtttaccttagtgttgcagtgtttctgtttatgctgacattagctgttaggctgatgttttggggcagatttaggtggttttttaatcaaggggaacttaaaatggcagtgtgtgtccaggatggtgatgtcctgctcctgctgtagcttggagggcagtggctgtggtgcccgccttcctccaacagaagacgggcaccaggagctcattctgcagattctttctgtcaccacctgtgcggtctcggtggtcacagcccaggttcagtggcaggatgctgtccccgttcttttaatctcaagtaagcgtatgaggacagagtgcctggtggatccccatcccccgtgggcaccgtcccaggactcttaccatgagacctgctctgggcttcagctccagctctgggctctgggtgccgcccttgcccagccctcccttctattgcatgaccagcaagaccaagagccctaataaaggacagcaaggttaacggtttggacgaggaaaagctgggattttaggaacaacggctgccaggccctgtcctaaagggagagtggagtctgtggaggagcctgaggtggccccagggactcaggaacctgcggctgagagctggagagcgtggctcacacaggtaaccccgggaccagcgcagtcagccaggagaaggctgagcatgctggggcacactccgttttagtggccccgagtttgttctattttctgttgagccagaaagaggagattgtattggattcccttgatccagggttgcaggcctgtttctgagttaytgatttctgtgccaaatgagtctccttgctcgctggtcaaagaccttgtccgttctctttttcttttttttttttttttttttaagcctctggggaattctccccataaatcatgtttccctgctactgagcagttgaagtgagaaaccatagctggcactgcccctgcagagtagccaagggcacctggccagggcgtcggccgcagcgtcagtggtggagctggcccagcaaatctgccctccccggcagtttctccatctgcgtctttctgccgaagcccctccgtctttccccactgctcccacagtcttctctggacctgggctgcacactctctcctctctgcccctttcctctcctcccttccaagcatcccaagatcaagggcatggagccagcatatggttctcaggagccgtggccggtccaggcgagaggcttccggacgcagaaaggccatggctgtggcagtgcatgcgcccctgggtgcaggctcccccagcacgtccccatccgacagaggcccagtcccacacggcctcgtcaggatgaactgtgtctcaagcgactggttttcctggggtggaaggcaccatcagtgagaggtagaaggaggctgggctgtggcctggctgtgctggtcagttggttcctgggcccagggggagtgcttggcaagtcactgggctcttgccctccttgtgggaagatttttaggggagggaagagtacacctaaaaacagagacgtcattagccctggatctccctggtgagcacttctgtggcagcctgaatcctccaacacaacctgtctgtcacagacatagattctgaaaagaagcacgtggtctagaccctggatcgctcaacagaaaagtgtcatgagcactgcaccttccaataagaagcatctcccgtagctccggatccaccaagagaccctgtcattagccctggatatcccagaaggaacgcaaggtcttccagcaagaaacatctgcatagccctaagtccctgaacaaggaatgcctgtcattagccctgaaacccaagaagaaacacctcaggccactgggccccccagtgagaaatgcctgtcacagccctggctgccctgaggaagaaaatgcctgttcttagctgctgggtcggtgggtagttttggcaaatgctgctccacgggcccggggcctcctgtgcctgcagaggcaggagggccagttcccgcagctgcacccagtttattgctcccagccgtgcgcagcctcacccagatggctgccaggatgcatgtggcgcagcccggggccgtccctctgatctggagcctgggtggtcagtgggtttcccaggcagtacggtggcctgcggccaggacggagcagtgaggggcaggctcaccgggctgtggagggagtggccagcatgtgggcaggcccaggtctggggcataggcactcatgcatggctgctagggcaccagcggccctgatgtttgtgccctgggggtgtgagcactggcttgaggcagggcctggggcagcggcactggaacccgtgtggtagggccggaaagcactcagagcggctcctgagtagcagcaactttgtttccaggtcatccctgcttggccagcagctggggcacaggagcatgcaggctgcagccctcaggcacagggcagtggcagtgggcagtttagggaccaccagacgccccgggggccggtgacaggggacttgcctcactgctcaccacagagccctggcaaccccgggatcacagagacccggccgccccaggagcacagagacccggcaacccaggagcatgcctccttggccccagttccgaacagggcttgtgcggtgaggggcgagggctgtcctgtgctccctacacccgcagaagccgtctggccaagtgcccgcctgcccagaggtacatccatcctggggcctggagcacgcagccccgggagcccttcatgtgtgtccgcagggcgccgttgaccccggtacacgccccgggttcctgtgggggctgcgcctccttgattttcggcctatgtctgaacagaatgggccatcccaggaggagtcacctagactgcttgcttgccccgcaggacccaatctccaggccgggatcctggtctctgtccactctgacagccttgcccacccggcctttgtgcccaggcttagggcactcccaggtcccggcgttcccactgcacctggggcctcgccctccctagaccccggctccttggcttttccttgggctccgccatgtctctccaccgtgtctgtctccactgtctctctgctgtgcctccatcatgcccgcagcgcccgcaagygccctttgaataattgatttggtgcagcttgaagccgcctgggacgctggagcccctgcctgctactgagggatgacagacctcactggcttcctgcagagcccagcgcccaggtcctgcttgtcactggccttggttgagaccccttgtctaggtcatgatttattttgaggtttagtgcgaccacatgtcagtgctgaggagaatgatgatcagatagtgaatgagacaaggatgtaaccgtgaagatgaaggcaacgtttgccagactccgggctccatgccacatacgccaagtctcaccacatctacccccagaagagcccagcctggagggaaatgccttggattcactggccttgtaggtgggtaacagccctagtgttgccaggagcccccaagtaccacagccttggtctgggtcacccaggactctcgcgcagtgggtgcgttcctcgctcactgccttccctgccccaaacagactttcttcaagcgattgccgggccacggcctaggtctgggcaactgccccctcatctcagggactccgcacggcacccctgtgaagtgaagtctctctcgtcatggtttacagataagcgcctagtccagaggcccagggtctgacccaggcagtggggggaggctaggaccctcagggaggactacgcacacacaggcagctctccccaccccgttcccgggctgcagaaggggtgctctgggccttcttcccactgtctttggcacatagcttgttttatgtggaaatgagagaaccacctgaaggtgctgcctgcaggtcagtggccaccatgggaaagggctgcctccaccctgggctgtgggcgtccatcctcaaagcttatttcaagaagaaaagaaggatgaatgcggggtgtcctgccctctggaaaaaaatcgctgtttttaattacaagacaatgagtgcatgcatttggagaagaacagagtgcccagggccttctgaggataatgagcttctggtgaccacacacaagcctctgggcccatggaaaacactccattgctggacttgcatctcaggccttagagaggcatggtggggaagacaggtgagccacccaagtctgcacactcggggtctgcacttgccagtgatcctgggacagtgggagcaggtgccttttaccaattcaggatggggcaggaggacagtgctgttcttgacacaactgtgtgtgcagcaggtgaggccactgttcccaaacgtcagagcaatctcgggcagcaggcagccagacacaagcaccagagaccagggctctggctgtgtcccactgcaggctggctgtgttcatgtgactgtggaggatggctgtgcccatgtcactgtggagggtgggtgcgcccatgtcactgtgcagggtgggtgcgcccatgtcactgtgcagggtgggtgcgcccatgtcactgtggagggtgcctgcgcccatgtcactgtgcagggtgggtgcgcccatgtcactgtggagggtgcctgcgcccatgtcactgtgcagggtgggtgcgcccatgtcactgtggagggtggctgcgcccatgtcagtgtgcagggtgggtgagcccatgtcactgtggagggtgggtgcgcccatgtcactgtgcagggtgggtgcgcccatgtcactgtggagggtggtgcgcccatgtcactgtgcagggtgggtgctcccatgtcactgtgcagggtggctgcgcccatgtcactgtggagggtggctgcgcccatgtcactgtgcagggtgggtgcgcccatgtcactgtggagggtgcctgcgcccatgtcactgtgcagggtggtacacccatgtcactgtggagggtggtgcgcccatgtcactgtggagggtggtgcgcccatgtcactgtggagggtgggtgagcccatgtcact

SEQ ID NO: 12217 - DNA, 510510 bp, Homo sapiens
tgttttctataaggataaagccttaacctcgaaacaagattgatacggcccttttttcaaatgcacacttcagctctactaaactttcttctccttccttgtccacaccccgactcctctcatcttgcctattgttgccccacacacgtctccaccttccggaatcatttttgattcatgcttcagatcttagatctctgagaagttccctgggttttgtgcaccactctctgccccactaactttgatgcccttccagtggtgtgctgaagccggctggtacaggctctcgaagccgactgtgcatatcacttcccagctccagtgttgcatgacatcactttggcatctggaaattggccatgatggaagtattgatagcatggaaatcaacaaatggtacaaatgagggttttattaaaaaaaaacaacaacttgttggtaagcatttacaagcacaccaccatgcccctcttatattttcataacactctgagcactgtgtatttcttcatttgttcagtgaatatttactgactgtgtattatgtgccaggcactgccctctatactgaggatataaatgtgggtaaataatatcgttcttgccataatggagcttagagttaaaaggcggagactgcccttagtcaagtaagtaagtaaataaataaatattcagtgataattacgttaagaactaaaaatgctttcaaaatatataatagggtatttgacctcatctaggaaggttttcctgagctaaaatctgaaggacaattttgagttgaggaaggaacaaggtgagggaacagcattccaggccaagggaaccgcatgtgctatggttggagggagcatgcctcctaggagcaaggagataagacaagtttggctagaagggagtcagagagtttcgtgtgagatgcagctgaagagttaaccaggaagcaagccatgcagagttttgtaggccctactaaggagttttgtcctatcctaaaagcagtgaagtgttttttgttttcttttcttcaacttttaagttcaggggtacccattactgggtatatacccaaaagaatataaaccattctattataaagatacatgcacrcatatgttcattgcagcagtattcacaatagcaaagacatggaatcaacccaaatgtccatcaatgatagaccagataaagaatatgtggtacatatacaccatggagtactatgcagccataaaagggaatgagatcatgtcctttgcagggacatggagctcctttaggagctcttgaaaggcaggcctggtggtgatgaattcccttagcatatgcttgtctgaaaaggatcttatttctccttcacttatgaagcttagtttggctggatataaaattctgtattgagaattcttttctttaagaatgttgaatattggcccccaatctcttctggcttgtagggtttccactgataggtccaccgttagtctgatgggtttcactttgtaagtaacttggcccttctttctgagtgcctttaacattttttctttcatttaggccttggagaatctgatgattaggtgtctttggattgatcttcttgtggagtatcttactgcagttctctggatttcctgaatttgaatgttggcctgtcttgctaggttggagaagttctcctggatgatatcctgaactatgtttttcaacttggtttcatcctctttgtctctttcaggtaccccaatcagttgtaggttcagtctttttacataatcccatattcttggatgttttgttcattcttttttattcttttttgctctattcttgtctgctggtcttatttcagaaagatagtcttcaagctctgagattctttccgccacttggtctattctgctattgatacttgtgattgcattgtgaagctcttgtgttgtgtttttcagctccatcaggtcagttatattcctttctcacctattctkgttatctggctatcagctccagtattgttttattatgtttcttagcttctttgcattgggttacaacatgcttctttagctcaggaaagttcgttgttacccaccttctgaagcatacttctgtcagttcagccatctcagcctcagtccagttctgtgcccttgctggggaggggttgtggtcatttgcaggagaaaacgcactctggctttttgggttttcagcatttttgcgttgattctttctcatctttgtgggcttatctacctttaatctttgaggttgttgactttgaatgaggtttttgtggggtcttttttgttgatggtgttgttgttgttttgtttgtttttctcttaacagtcaggccacttgactgctgcagtttgctggagatccgctccagaccccagttgcctcactttttcctgtatctggaggtatcactagtgaaggccacaaaacagcaaagatggcagccagcttcttcctctggaagcttcatcttgggtggtttctgatctgttgccagccctcatacacctgcagcaggtggttagagacccccattgggaggtttcacccagtcaggaggaacgggattagggacccacccaaagaagtagtctggctgctttttgtagagcaggtgtgctgtactgggagtgggggtgggtggggccctcatagtctggaccacctgtattctccacagctggtaggctggatcagctgagtccactgaaccataaagatggtggttgtccctctccaaggcaacctgtcccagggagatatcagagctctctccatagcgccctggctggagtgactgaagctcctgcagggaggacccacccatgaggaggaatggattggggtcccacttaaagaagcagtctggctgcaatttggcaaggcagctgtgctacattgtgggggacccttccttgtatggtccatctgtattatccacagctggcaggcttgaatggctgagtctactgaactgcagagatgatggcctcccctccctccaggagctctgtcccagggagagatcagagctctgttcataaaacagttgctggaggggcttaaggaggtcctctctagcgaggaggaatgacttggggtccygcttacagaagcagtctggctgctttttggtagggcaggtgtgctgcattgtagcagagggaacccttcctagtttagaccgtctgtattctccacatccaggaggctgcagcagctgagtcggctgaatcacagagacggcagctgccccacctgctgggaactcaaacctgtctcaggcagactcctatccactgccattggctggctgggattccaagctggtgggtcttaacttgtggggtgtcatgtaagtggggcctgaagaatggtattgcttggctccctggattcagcccccttcctacagatggatttcctgccttgctgatgattgtggccagagtatgtaaaacttctgggcctctttgtatgtgcctgagtggctgctctgtcaagacaacacacagctctgtgtatcagactcaaggccctggtggtgtggagtcatgagggggtctcttgatccacaggttgcaaagattcatgggagaagcatggtttcctgggttgcacaatcactcaccacttcccttggctgagggtggaggttcctttggctctgtgctgctccgaggtgggctccccaccctgcccaacttttcttcattctccatgggccggtggtttgcctagtcagtcccaatgagagaacctggatatttcagttgaaggtactgaattcacttgccccttctcattcctccctgagtgctgcgggcaggggcttctaattggccattatggattgatctccctgcagtgaagtgttctaagtaggaagaacacatggtattgtggaaaatcaacatagcatggtggctcagaaatagattctggagccaggcaggttgcttggtttggaattctggtcctgcaacttactgcaacctctctatgccttagtttcctcacagtttaaagagggataaaataatatctataggtctatttgcgaggttttaaaattcttggaatagtacctggctcattatacatgctatagaaatgcttattcaattaaataaataaaagcatctttggtaagataactctgaacattgtatggtttagtagaggatgctgacaagaataaataattaaaacatatcatgaagtaagcataaaagatagtggtaatgcaaagatgcgaatgagctctgcttcctgtgattagtgtgagcagacaaattcactgtactcagaagcttaaagcctagcgtgggaagctgacatgaatgaaaaccaacgggaaaaaatgttagagtagaggtgtaagcaagagtgattaatttcaacttgaaagcaaatgggggaggtttcacagagaggggcccagcatgttggttgattgcttgggctccagaatcaggccagctcagtttaatgctgactttgtacctcactggttttgtgacttgacctctctaatcctccatctccttatctgtacagtggggggaaataataatgataataataggtagctcataggacaaataagaattcacagttaatgcatcaaaaatcttagcacaaggcactcaataaatgtgaagcttttattgttattacgagttgaaacttgagtgggaaagaacttcgttcacattaaacatgagaaaaggcccagaagttgaaaagcatttgacataattaaagaacagcaagtcagtgccacttaaacggtaatccaaccaccgccagtcagtgaacagctttttactgctccatgaacaggtaagtatagaaattgtgagtaagcatttagaaataaaaacaacaacaacaaccaataattgaaaaactaattttatactttttggcatactcattgtacacttgtaataaaaactgggcttgtagtttttgtctcttttcttatttgctagcaggttttgatttgtattttacagaaataatggtccatgtcagattggaaataataaaaacttgtcttttacccttgatagtttgagaaaaaagtaattcagtggggttagatatggcatccgagagatgattcgggaaaggtgggccagggccatgtttatgtggaccctccaatgcctcagagttcacacttgtttcagtgggcaacaggactagtaaggtttagagggactgttaaccgaaggtgagtggactttgcacattttatggtattttttttttcccagtaggcatgtgcttattctttcttttcttttctaattaaaagttctgtttggtttttttagttaagaggagagactggaactgctcagtgtttcacaaagataactgtttgtatttgataagagtttcgttaaacaaaggaatttgcacttatcaaaacataaagcattgaaaacactgagcacatactctgtgaccagaatgcgtgtgacttgttgagataagccacaccgggtaatcagatgagtctcctttcttcttgggcaccctcatataattcaggcacaaacgaaagagaaaacgctttttctgatctctcagttcgggtcatctctgccttccatcatcaccgcctaacaatcctacacctggcagggtgggaaaacggtttaataatctcttccctttgggaggcgtttgacagctcagaaagcatggcctttactcaggctcagagacacacaaaaacctttcacgttttcctttcagcttcgcagccccgtccttctccacctgcacgggcacccactgaagcacaggacccttctgccaagccatgagccttctcaggcccctgccgcccgcctcgcctgaggctgcgcttctgaaaagcacgcggccctggcctgcgcaccacccagtctgaaggcgacgcccctgcacgaaggagtcaggcctaggggctcgggacccagggcgacactcaattttctaacaggagccacagcccagaagctgagaagccttccggccgatctgtggccctgaggtcgcccttggagggcgagtgagaaccccccaggcgttccggaggtggcscccagcccgaacccggcgcccgccccggcttcccgagtcaggtctttgccccgcctctcggccccgcggcctggccggcaagcagggctgcagtcacggggcggcgcggagggccccagcccagtcaggggtgtggccgccgccaccgtaaggctaggccgcgagcttagtcctgggagccgcctccgtcgccgccgtcagagccgccctatcaggtgtgtttgcagccgaactggcagtgcccgcgggcggctgggccgaggccttggctcctacccgcgggggtcgggcgggctgaggctggagcaggccaggggcgggggcagagggggacggacttccagcatcgctcattcgggggcgtgacgggaggacctggctggggagcggcgggttgggagcctgtggctgccccttcggtgacagtggagtcaccgagcctagaaatggggaagctgtgacgtgggggtggtggaggrtgctgcgggacagcagcgagcacggccctcagccgtccttcccaacacggtttcacttcccctcagctccagggctcagccccaagccgcccccttcatcccccatctgcaaacaatcctggtccccctgagcctccaatatgccttatgcagttcttttggggttcctttcgcattttaccgtgtactttcgcttttgatgcgtctagtttctgctactggactctcctagaatcgaagttccatgagggcaaagtcccatctgacttaggactcagagctactcaataagtaattgaatgagtacctatgccgtagaactgagtgaattaacaaatgagtaagtgaataaatgagtgcatacgagatacagctgaatcaatcagtgcatgagtgaaaataaagatgtatgaagtggaagcagtggagacgcaggcttacaactcctgttttttgatagctttccaaaaagttgtgtgaatgtcgcacttttgcaaatggaggcattctgattgggaccacttaaaaagagttctatgctgttcaaatggtctctggaaacgccccctggtatttccatttttgttggacttggctatatgtgtttgcttaaaacaaaatatgcctaggttttttcttgcttgtgttttgttcacttctactttggacgtttaaagaatcattgtcactataatattatttcatgtatttcttaaagataagggtgactctgaaggcagaaccatatgactctgacttgtttgtaaaaccaggcttttcttttgaattcagagttgttaagaatcttgtctgttttcctgagacaggtgctggctgatttgcaggtgactgaagaaggctacataaggcccagaaagacgcttatctgtttgtaaacaaataggcttagcacatagctttaatacagttggtcactgcagccgttcttacttgccaggtccaggttccagaagagctggatgaccttggacttgccacttgatctctttaggttttaatttcttaatctccaaaatgaagatgtttagctaggaaccctgcctgagttaaacctctgggattcttttgtatcagggttagaaggtgaaattacagatgatttcatggagttctgcttacttcacctcccatagcattttgtctctgctctcttctttgctgtttacagctcatttcctttcttctccacatctgcaacaagaaagcctgggagctcaagataagtgtaataaaccctaggctggtggggagaaaggagggtaagattttcttctacattgtcacaggctcctggtcctgggtctgacttttttccagtgcaacccagtctgacaatgccatatattcccagtatatctggggaactgcatcactatttcttcrcatgcatttgagattagttatcatagatcacattttggagctggaaggaccttggagattttttaaaggcacttcaaaagtcattatacatacatatttaaatatttttgcatgctacatttaacaaacacaaagttccaaatgtgttaagtaaaatgaaattaatgttacctacttcagtgaattcaagtttataaggagaagtggaatacacatgttgcttggtgaaaagggccaactttctcacactgttttcccaatgaggtcatgtgtcatacaggcatggaatgttacaaagctgatatttatggggcactgaccatacaccaggcactgttatatttaacctttttacttatrttgccccatttaatcatcactatatatctaagagctagatactatggtaagtcctatttgatcttcttaactagaaacagtacatggaaaatgggagagttaggactcaaaactcaagcagatggaaacagggtttctcccagaaacaagacaatcctgccaggaaaaactgtgtgactttgaagaatgtggtctctgtgtgtgttcaagcatatatacaaaccctgggttatttgggtaaatgaatttagaatgagagcacagggtgaaatgatgaagactgaattataggggagttggttgttttatcattttgaaaattattgaattccattgagattccaggagactctgatactttgacctaggtgcccatgcatcttaattttaaatgtgttcagacttaccaatttagggaatataaaatgagtgacatcgacagctgccatcagtgaatggcacttaagggctttgaaccatgagtgctaagcagtgttgtttcttggactagctttgtgcccttggtaaggcactgcctcccaacctctttctttataagaccaacaacccctagtatagacaaagaacaatgcctacatctgtgtaatccagagacaagaatgcaggatgggtttccagaacccttataattaattgaagagagcaaaagacgaaaagagaggcccataaaataaatgggaaattattttgtttctttttcgtcagccaagtttagccccatggaaagcagagaccagttgtggccgcctgaaaaactaagagctgatgccagtttgatttagctcaggaggctgaaactttctgccccgaaggctggtgtgatggaatagaccttcccattgctcacaatattatgaaaaaaacattaaagcaacaatttttattacttgccctgcagctagagctttaaaatgtactttcttctcccctaccctccctaaaccacttagcttttaaaaacaaacaacccattcatgtgtttgttacagtcacattattagttctttctctttattcctgggcccttttctttaatgcagcaaagtatttggagggatgtacttgtggatctgtggaattttactttattttattcagaaaatattaatttcaataaccatttattgagtgtatactatgtgacaggtaaagatgaatgagaacaaatctaaataggagagtgacccatctgcaaacaattgcaccacagggtaatgtggaagtagtggccactcactcttccaggaaagaggtatgattggaactcaggaagactttgcagagaaggtgaattttgaactgtgttttaaagcctaaagaccaagcagagggagaagggtattccaagaatggagaacaacaagagcaaggaaaaggaggcaagtatgaacatggcattcttcaggagatgggagttcagtgtggctgtggtagggaggtgtggtaaggttagggccagacagtgatggtccttgaatgtcatgttatttaaactttatcacagtctagataatccttttcagcattatttttgttttgttttgttttgaggcaaggcctctctctgtcacccaggctggagtgccgtggcaagatctcactgcgacttccgcctcccggttcaagtgattctcctgcctcagcctcccaagtagctgggactacaggcacacaccactacagcctggctaatttttttatttttagtagagacgggactttgccatgtgggccaggttgatctcgaccttctggcttcaagctatctgcctgccttggcctcccaaagtgttgggattacaggcatgarccactgtgcctggctcttttcagcatttttaagctgaattttaaacagaggaatgatatgattggattttccttagaaaatagctacagtaataatgtttcagaagaattggggaaggaagagccagaaggccacaggaaaatgaagatgctattgccataggtctaatgaaataggataaggatctaaactaagataggtttgagagactatttgaagacagagcaggattaatgactagctggagctggatatgggaaatatgtttgaaaataatctgaggttttggaattgcttaactgggtgagtggagatgccactaatgagggtaagaaatataaggtgaggaagaagtttcgggagaaagacggtgagtgagcagaggtagctgtggaacatctgggtggagatcccaggatatagccttttctgtagctgtgctgtgatgtcacacagtcaagaccttggccaaacattacaatagggcctcagtctaaaaagacacatcaatttaataactcacttaaaaaatacatcatacttatctaatgaccattacattatatttcaggcaagttmttagagaactctgattcttatgtaagtgccagtgaaggaaaaaagattggagactcaaacaatgaggagttattataagctgccaggagaaactgaaaaagagaaatacagaccagagtcattcaaaggaacaaagataaggaaatggcaggagtgttgcagaaagcagtggtttctgaagacacaggtataggcagatatgaaatacagagaagaaatttgagctggcgcttccaaataactgtacttctttaatggtaagatatcccaagctttgatttctcatcttattcastttgtcaggaagagacaaacaggtgtgggtgctgggcagagggcttgatctcattttgcagagaaagtgtttggagactttgaactaagcaaagagtaacagggaaaataagataaaaatgaaaagggtaatgattcggagaaatttttcagagaatttaaggaattctatgacaaacaggtgttaaagaaaaaggcagatcaacgcagtgttctcttgatatagtggtattagacttccttggaaaaaagattcgcatagcgccttatatttaaaaagcaattttatatttgattgttacaagaacctaggaagcaggtgcagccaggcattattatctttcttttataaacttaaaatctggcatgaaggaggctgcagtttgtttcatggctcagacggctcagatcccatggctggcagggactcagagccttctgactttgggtccattgctttgtccattgtatcaacgccttgccttaccttggaaccttggccttctgcagtgtgcctccttcccttatcatatcatatcacataaatgtaaaagtaaagcagatggtatttgaagaccaaaagagccaagatctctggggagacaggcagtgatgtgaaaggatccttagcactgattatgctatatacaatagggatgttcatgaagagttgtgcatagagtgttatctacgtaaatcaaatgacactttcagtgcagtaggggagtccacaatatccaaagtgttatgaytaaattttttatgaggcaaataatccctttataaaatgaacaatcagtcactccttgatatattatctgaataaatccagattttcaaatatggggttgacttaaagcaagatacatctctagtagcctacatctatatttatcatataygaagatttttctgacttgggtattgaatatgaagatggggatctggagctgkatcctctaattgttagagaccatttaaaatacaatggacatcatgacttgcagctaaatccattcagctacctttactgtttaccaagcacctaacaggtatgccattggatggggcaaaactcagctgggaaatggagagagaagcccagcactggcactgccttgagtctgacagttagaccacaagaaagtcataaatgtaaattcaccaatatagtgagccagggtaagaaaactagaaactcttatggtccttgaattctacatcagtattaaaatgaaaccaagtatatttcaaagcaaagactgttatattagacccagagttattctgtactgacaaaagataatctttgtaaggaagaagaggtagttgtgactctttatgcatcaaacatttaaaaatgcatatctttaaaacatgtaaaactaatgattagawctatgagaaataagcgaagctatttgtaggacactttagatctgttgttttacatgacaaatcaagtagacaaagtcaaatggtaatacacaagatttgaataatataactaatgaggttgaataatataatttatgagtgaatagggatatggaacatttmatagtatattttattattaatcaaaaaattatgttatgtatgaatatatatgtacatgatatatattgggatatatatggggtatatgtatgtatatatgtctccttttttgcattaataagttcttttttattttactgtaaattggcaaattatggttgtatatatttatgaaatacaaagtaatgttgatatatrtcataatacaaccttccatacaatgtggaatgattaaatcaagctaataaacatacccatcaccttaaatacttatcatttttgtggtgaaaatatttgaaatttgctctcttagcaattttgaaatatacaacacagtataattaactatagtcatcatgctgacaatataatctcaaaaaatttattcctcttgtttaattgaaactttgamccctttggcattccccattttccccaacccctcagactttggtaagcaccattctactctacgcttcttagttctgttgtttagattccacgtagaagtgagatcatgtggtatttgtctttctgtgcctatgtctggcttattgcatttagcataatgtcctgcagcttcatccatgttgtcacaaatgacagaatttcctcatttttaaaggcagaatagtatttcattgtgcatrtgtgccacctattctttagccatttatctgttgatggacacttcggttgattctataatttggctattgtgaatagtgctgcagtgaacatgggattgcatatgtctctttaatataattatttcaaatctttggctatgtacttagaagtgggattggtggatcatatgatagttctatctttagtttttttgaggaccctccatgaagttttctgtaatggctatactaatttacattcccatcaacaatgtataagagtttcctttacttcacattgtcaccagaatttttttttgtttgtttgagacggagtcttgctctatcgcccaagctggagtgcagtggcgccatctctgctcactgcaagctccgcctcccgggttcacgccattctcctgcctcagcctcctgagtagctgggactaccggcgcccgccaccatgcccggctaattttttttgtatttttactagagacggggtttcactttgttagccaggattgtctcgatctcctgacctcgtgatccgcccgcctcagcctcccaaagtactgggattacaggcgtgagccaccgcacccggccccagaattttgtttttgaggcaggatctggttcttttgctcaggctggagtacaggggcgtgatcttggctcactgcaacctctgcctcccaggctcaagccatcctccctcctcagcctcctaggtgactgggactacaggtgtgccactgggcctggctaatttttgtatatttgtagagaaggagtttcgccatgttgcccagactggtctcaaactcctgagctcaagcaatctactctccttggcctcccaaagtgctggattacaggagtgagccacagtgcctagtacatttgtcattttctgtctttttcataatagccattctaactggggtgagatagtctcattgcagttttgatttgcatttctttgataattaatgatgttgagcattttttaatatatctgttggccatttatatgtcttttgagaattgtctgttcaggctctttgtccattttttaatcaggttgcttgttttcttgctattgagttgtttgagttccttatacagttcatccttgagcaatgcggggcttagcggtgctgactccctctacagttgaaaattctagtataacttttgattcccccagaacttaactactaatagccaactgttgactggaagccttaccagtaacataaatagccaattaacacatattttgtatgttacatgtaatatatactatctgcttacaatagagtaaggtagagaaaagaaaattttattgagaaaatcctaagggagagaaaatatatttactatttattaagtggaagtgaatcaccataaaggtcttcactcttgtcatctttatgttgagtaggcggaggaggaggaggaagagaagggattggtcttgctgtcttaggggtggcagaggtggaagaagcgaggaggtgaaaggcgagggaggagaggcaggcccacttggtgtaactgtctggaaatacataataatttctgtatggctacttttctctttctaaaaatgttgtaaagtttatcttaaaatgtttctatacagtatcagtctttcttctgctatttgcattagcttcagtgcccatatcatagaagcgttcatgtcataaaagaagtcaaatgcagtcttaaataatcagaacgcttctgccagattgtctgatgttaatttgctttttggtacttttatatcctcctcatcatcataaggcactggttcagaagcactccgtcaagttgtcttctgtcaattcctctggtgtgtagtgtctattagctcttgaatttctccaagattcatatcttgacaccttcattcaccaccttttttcccactatatttacaatcgctttcattatttccttgaattggctttgtcataaaccctgtgaagtcatacacaacagctgggcacagttttctcctgcaggaacttattgttggcttgatggctttcacagctttttctataacaatgatggtgtcttcaatggggtaatccttctaggctttcatgatgttctctctatcggggttctctaacatagcactgacatcctttccatagagtactgtgtataatgagccttcaaggtccttatgatcccctaatctagaggatgattagagatgttgcgtttgggggcaagtaggacacttggatgtctttgatgttgaactcatggggttctaggtggccaggggcattgtctaatatgaaaataattttaaaaggcattcccttaccagcaagatactttctgacttcagagaaaaagcatcagtggaaccaatccagaaaaatagttcttgtttaagccaaaagactggtagctgatgtttatctttttccatcaaggcttggaggttagcagctttatagatgacagtcctgaccataaacctgactgcatttgcatgaaacagtagttagcctatgccttcctaccttaaatcttggtgctcacttctcttccttactaataaatgtcctttgtggctttttttttttttccagaatacagcatgttcagctgcattaaaaccctgtttaggcaggtatcctttctcctcaatgattttttaatggctttgcaatatagtttgatatcaggcagtgtgatgcctccagttttgtttgttttatttaagatcatcttggtgattttttttaattccctatgaattttagggttattttttctgtttccttttaaaatatactttctggccatttttctctctcttcgtcttctgaaattatgtgaagattagttcccttgactgtgattgtgtcacataattcttgtaggttttcttcatcttttccattcttttttctttttgctcctctgatgaataatttcaaatattctgtatttagctcattgattgtgctgcttaattgagtctgctgttgaagatttctattgcatttttcaattaagtcattgtattctttatctcttgggtttcttttttattgtttctacttcttctatattctcattttgtgtattgtttctcaaatttcatttaattttatatccatatattcttgtagttcactgaactgctttacaaggatttttctgaatcttttttctgccactttatagatcttcattttttagtctgttattggaactttgttagtttcttttgatgattacagatgctctttgacttacaatgggcttatgtcctattaaacccatagtaatttcaaaactttgtaagtaagaaatgtgtttaataccccagtaaaccaattgtaatgtcaaaaaattatgagttgaaccatcataagtgcagatgctccttgacttacaatggggttatatcctgataagtccgttrtaaagttgtatagttgtaagttgaaccatcataaattggggaccgtctatatttgtaatccttgtgttctagcattggtgtctgcacatttgaagagacagcttcctcctgagtgcagtggtataatgacagctcactgcagccttgacctcctgggctcataagattctcccacctcagcctcttgagtagttgggaccacaggtgtttgccaccatgcctggctactttttgtattttttgtagagaggggtttcaccatgttgtccaggctggtcttgaactcctgggctcaagtgatctacttaccttggcctcccaaaatgctggaataacaggcataagccactgcatccagccccaacagcttgctcttctggtctttacaggtattctttgtcagggattgacctttacttcttagtctaggctgtgattctagttgggtcaggtggtaatgaccccatgcaggcagagctcgctatagttggctgggtgctgcctttgctctgaggtctgatggggctgctggctcggctcccatgcttcggggagaccactggctgagctctgctataatttctgattggacaaggttgtagggtgtacttcctggctgggtggtactacttttttggttcaacagttgagcagggctgcaggctggactctgagtttaggtggagttgctgctcaggatggatggggtctggagtatatgctgcatagaactgcacagttgaggattgcctgtctctgggcagggccttagagtgggctctgagtctggattgagtcactctttggatttctgcgtcaggcaattccaacccctatgatccacagaaatgccctgtgatggtcatctccacatctcccgcctgggtaaggcattgaggtcgcctctgaggctggccgtctaaagactcaaagcaggctgaccttctcatcatgtttctgtgaacagtgaacttggctttgcaagtgagccataccattggctggtatctctgattgtgcaccaccactgggaggaacatagagccatcaccaaaatttgcacactggtccctgtgagctctgcctcctttctttgtttatacctaacccaggaggtctagccatgtcattactgccagtattccccatgaggtcagatgggagtgggctttctgggaagtgtctcagaatgctagggagctggatgtctagaaactctggttaccttttttttttttttactgtatgggcccagttaaaaagatcctcttggctgggcacagtggctcacgcctgtaatcccagcactttgggaggccgaggtgggtggatcacgaggtcaggagattgagaccatcctggcaaacatggtgaaaccccgtctctactaaaaatacaaaaattagctggacgtggtggtgtgcgtctgtaatcccagctactcaggaggctgaggcaggagaatcacttgaacccaggaggcagaggttgcagtgagctgagattgtgccactgcacttcagctggggcaacagagtgggactctgtctcaaaaaaaaatcctctctctgtgtgtcaccatgctgatctgggggagcaggaggggcagtgtagtcaacgtgagattgttcctcttctaatgtggtttttatttgattcagtggcctattcattcagctgtctccgtttctttctcaagtttgtaagttttcacaaaagtgttcttgtctttggattgttgcttgttggactttctgtagagggaagtgaagccaagtgaagcctgggacttcctattctgccatcttgctgatgtcatgcctacatgtttacagaaaattcacatcctcttataacatttatgagacattgtaaaaaacaaaacaaaacaacaacgacaacaaaacccaaaagccttaaatgaagactttagtgaattccagagtccttcttactcttactggccttgtgccttagccctctggtttagcccctgtttccagctagcttttaacaggttgagatgatgaaaagaaaacatacctctctcctttcataatgctgtgaagtagctcatataattcatcttccacgtttatatacgtatgtctcttttgtgcccagagcatcattttgagattcttttttcattatcaaaatacattggatctatgttattcataactaatctgaggctgtatttgttacatttgagtattttaaatcattaatgccatatgtattgtataccaaaatttaccatctaaaacacctggctattcttttgtagggtttttcttttcattagcttttttgagctaaagcttaaagaaaatcagggaccaaaggaaggttagaaagtggctggaggtatcataaacaccaactaagttctttgagaagcagaaggtgcatcatggaaatcagcattattctgacttcatttcattgcctactcagtccaaattttagggtttacaacttaaactaataactcactggcaccttgcatttcctgtggcttaatggttaagaacatgggctttgaagtcattgtcctgagttcaaatttgaggtctaccaccatcacctatgtgactttgggccaaacacatatactctttatacctccatttcttcatccataaaattgggataaaaattataactgtctgcagtgggcagaatactgtcttccctaccaccccctacggtgtccatatcttaatccctgaaactgtgcatgttagattacattgcaaaggggaattaaggttgcagatagaattaacattattaatcatctggccttaaaataggaaattatgctggattatcctggtgggcccaatgtaatcacaaaggtctttaaaagtggaagagtgaagcagaagaagtcagagagttaggaagatgtgattatggaagaatgttcaaagagagacagtgccactggctttgaagatggaggaagrgggccatgagccaaggaatgtgggtggccacgagccaaggaatgtgggtggccactagaaactgaggaaagcaaggaaatagattctctcctaaagcttccagaaagggatgcagtcctgccgataccttgcttttacgtgatgcatacagtgtcagacttctgacctaaagaactgcaaaataataaatttgtattcagataccaaatttgtggtattttgttacagcagaaataggaaataaatgcaccgccatatggggttgttgtaagggttaggaaatgtaaacctttaagatagacctgccacatggtaaatgctcagttagtattagccactattattatccattggtactttagtttcccttctgtctttgctcttttgtggtagttgtcttgtaattacccaaatttgtggttatcttccctacaaagactatggccctaggtgtttttcactctcattttagtctatactcagcctccagtaatttgtcaaaattaccatttcagagttcctaccattttgtggttccagcagcttctgttccaggtgagtagatcttggctgtgactctctggatttgcctgtctctccagattttagggtggtagtttgccctgcaacttcagttctgtggggcatccaaggaaagtcgctggttttcactttgttttgtttcattattgtaaggacatgagtgctgacttccgagttctttacatgttggtactgaaattggaagtgtgggcagtgctctttaccctacggctttaataatctttctatacacatgagatcttcatctctacactttacttctttctgatttccattatctggttttcacttcattcatttcatttccaaacatgctttttctgtattttctatttargttagtggcatctcaatccaagggatagtagttaatttgatgtgtctgaaatacagggtacaaaacaggctcatagtcggggagattgcccttaactctccacctttcctgaatccttttcttcagaattagtaagtcgccaagggctgttgtgtctatgaattttgcccacatccttgctgtcattacgctagtcctaactcttgactcggccatgcagaatattttaaaccactttatcctctacactgcctcagagttaratcataagttggatcatgttacttcctctctcagaagacctacattttgaaaaattgcttgtggaataaatcccaaactcctaatttggcatttaaggttcttaaagatctgtaattaaggtatatttctaggtggattcatagtgcatgtacctactgtatttgctagtgctaccacaacaaaatcctgcagactgggtaggttaaacaacagaaatgaattttctcatggttgtgggggctggaagtccaagatcaaagtgtctgcatgtttggtttcttctgaggcctctctttttggcttgcacgtggccatcttttctcgaggtacttacatagtcttctctctgtgcatgcacacccctgatatcgctctgtgtattccagtttcctcttcttatatggacaccagtcagattcttttagggcccaccctgatagtctcattttaccttaacacctctttcaaagccccattttcaaatagtcacagtccaaagccctgggggttagggctttaacgtatgaattttggggaacacaatttagcccataacaccgactgtatccctctatgtattctgtactcatgaatgtataatggatcacctaggaagatttagaaaatactgatttgggggtctcacccaacttcttgtaggttctgaatcagtaggtctgaaatggggctgagaatacatttggtgtgtgtgtgtgtgtgtgtgtgtgtgtgtgtttatacttctccctagtgctttcccagctttcctagactctttaacattattggtgaacatactataaatgttcatacctttgctcatatttgttttttaactgaaaattctcttcctaccatacctatgaaatttaatatctatgaaaattaattyagccttctaggctgatctgaaatatcatcttttctgttatctttttcttattctctccagagataatcctgcaatactttgttgtgattttattttactttatataagtactgaagaatttattttgttttatatgatagtcatttgccttcttctttcactagctttctgagaccaaagaggacatattctttatttctgtatatatgaaacagtggcagttgctctgaacatagtagataattaatcaatctttgcagtgtgaaaaatgaactagttaagaaatgctaatatttttattgtgactttttataaaatggagatcattgggtaaaaaatgaacatatcaaatgtaaaacaagtggcagacttttttttaaaaaagactttacttttttttgaaaagcagttttagattgagaaggtgtagaaatatcccatacactacctgcccctcacatgtgcattccctaccagagtggtacattcgttgcaattgatgaacccatatagacatatcatcatcgcccaaagcccatggtttgtattagcgttcactcttggtggtgtgctttctatgggtttggattgccctaaaaatcccctgtactctacttgttcatccctcccttcccctcactcctggcaactactgatcttttctctgtgttcgtagttttgccctttccaagatgtcatatagttggaatcatacagtatgtagtcttttcagattcgcttctttcactgagtaatatgcatttacttctcctccctgtctctttatggcttgatagcacatttctttttagctctgaataatattccattgtctgggtgtgctacagtttatttatccgttcacctactgaagatcatcttggttgcttccaaattttggcaattatgaataaagctgctctttacatccatgtgcaggtttttgtgtttacatgttttcaatccttttgggaaaatattaaagaatgccattgctggattgtatgttaagagtatgtttagttttttaagaaactgtcaaactattttccaaagtgggtgcaccattttacattctcaccagcaatgagtgagcattcctgttgctccacatcctcaccagcatttggtgttgtcagtattatggttttgggccattctgctaggtctgtagtggtatcttgttttcttttccatttccctgcttacatatgatgtgaagtatcttttcacatgtttattttccactttatatcttctttggtaaggtgtctgttaaggtctttgggtcattttttaattgggttgtttgttttcttgttgctgagtttttaagagttctttgtatattttggataatagtccttatatttaatatgtcttttgcaagagtggcagaatttttgttcattatttttttcttgaattaaatatccttaacattacacataaacagtatttttaatgtgtattttcaatttggaacttttaacatttaaaaatttctcttgatgaagatatgtgataataaaatggggggcaaagtgaagacattgtaacaatttttgataatcgcatcttcttctgcattgcatttttcagggcagagtattaatggtccagttcttaaagataaatggattcctcaatgtttatttgtagtatatccttgtttattctcctaatgaagaactgcatccttaaagctggcataattaggtagacttgtctattagctgagctactaagctttattttcctgggccaatgaataacagaaacaattctcaaaataattaaatctgttaagacccagttttggggtaaggagctggggtctggcatttcctttttgttggtttttcaaaaattattaaaacttcaatgcttggccaggtgtggtggctcatgcatacaatcccagcactttgagtggcaggcagatcgcttgagcccgggagttcaacactaacctgggcaacatggcaaaacctcaactgtacaaaaaatatgagaattagttgggtgtggtgtggcactcctgtrgtcccagctacttgagaggctgaggcggcaggattacctgagccctgtaagggtgaggctgcagtgagccaagatcgcaccagcactccagcctgagctacagagcaaagccctgtctcaaacaaaacaaaacaaaatctcaacgttaaactttctagagaatgggtaatcacctttcaagtcatttttccaaacccatttytgaaccaggacaggcaataacagagattggcaggggaaggactgatgtctcctcacaagggaaaaaggactctgcattgaaaacacagatgagcctttggatgtggaaatttacaaggctcagagagccccgaaacatcttcagaagtggagcccagcagaataatgggaggctgtgtgctggcttggcactggagactgtctggcacaaactacactgtaaacaactcctcaaacattttcatctgcatacatgacacatgacattagattctccaaatgtccaattaaacacttgtcaatggaagaaatgtttgtttcctcagctgacctgttgtcagccttggccttcctgatggggaagcagtttcagctgatactgttgtatgctcttcctttctgggcctgatcttgtccctgttgagaactgtggagactgtgccaagctgtggaccatgggattaggttaggtaactaaagaaaatatccaggctgtgagcacttttcaaacctaagaaaatctttagtttcttttgcacagttgtaaaccgtttgtgcttaaaaaattataaaagtgattgcagttgagatagagaaaagagcagtgctgatatgtgtttatatacttctaagggctgacttcatttttttcaacatcttaaacttctattgaacaaatattgtgtgtgtaggtgtgtgtttgtgtgtgtgtgtgtcatcatctctgttgacagaaatgctcaatgataagtctctgtgactggaagagcagtgaaggacttggacacatgctgtagaaacataaaggaagtgaggaaggcaatattggagaagaatcaaaggagtttaaattattctttggaaaagttggagtttataaattaaaaaaaaactgtatgaccttgagcaaatttctatttttactagtgtcagtttcctaatccataaaatagggaatataatgtcaagaacatcgaaggttattattaaaattaaataaaatgatctatgtaaaatgcagcaacacttgccacattgtaaattctcaagaaatgctagctaatattgaaatatgaaataatacttctttggtccaaagatgtttaagcattcctatttggtaaagagaaggagcaaaagamcaagagaaaaattagataattggtacagtatgaacagagtatttggctttggaaaggagggtgggcagttctttcactgggacaggagctcagaatgactctataggtaaagggatagaagaactttaaggtgaggatgaagaaagacaaagcatgtcatggtcattctattgtctcttcagttacgtagaagaggagagctttttctgagcatgagggggaataggagtgaaatttgaggcttaaagagaatggaaaagtttcatagcagctgctgtggagaatttgatacgtgtcaactgaagataaatataagggttgtgcagcaatgcagaggatatggctgaggtcagacagccttagtttatagtggcatgattttgggaatgtagatgatggcattatgtaccctggagcaaacacagagaaaattcaaaattacctttgaggaataagaaaggaggtgaggagtaagggtaaaggcgtcctaaggtgctaatgaaaatgctgttgaaatcattaaccaccaagtaaagttgtgagccaagattaatctgaaatggtgatttgtgtggatagaagtacaaatagactggaggtggggaggcccttcactggacaggcaacattaatctagctgccattgtaccrcacacatgctgaatgatgatgatacaggaatgaaggaaacataattcacttgggcagctcaagagcatttttttaagctcttagtatatactggctagatcatccatatgacagcaatgcttcccttgaaaagctttaagtctagtgatatgctctggataatttaaactcagactgtggggtactttgaaggaggtaagcagagggtccgaggaaacaatagaagaggacattcaacatgacctgtgaaaagaaagggcaggtcagtaaaagtatcctggaaaatatcttgcttgagctgaatcgattgtagagagccagggtaaagaatggcagaaagggagaggcaaaagcaagggagaaaaagcaaggaaaaaacagagcaagggagtgatttggctagggcagacaaaagatttcagagaagggataattaagatgagttacatatgatactattactaagtgagagaaataaggaagacatgaatgaaagtgataaacaatgtgttggtaggaacagaagaaagaatgtcaagagaacagaatgatgagatttaatgactgattgaatacgtggggaatgaatgggtgattttacactcttgatcctgaattatagggacaattatggtttccttaacagaaagagggaaatcccgagttagggaagatttaggggaaggtgatgagtttggagatgttgaatcagaacatatggtttcaagtgaaagtaattcaaccaagatgggattaaaccaaatgagagaatttgtgatgttcataattagtaagttcataggtgcttctggatttaggcatacctggctctccagggttcaaatatgatatgggcttatctctattcctatgatctctgtctcttagattagcttgtcttgcttgttttcattccaaagacaggctctcagtatatggtaggcaaatgggtacctccaggttcacattccagcgatcccggtggaaataacttttatttgcaacatccatatattttaaatgtaggttttattattattcagatatggtgaggccaggagattaggagaaaattgccaatggaaaatataatttgttactcatatctcctatgatatgggggcacacaatgacatgcagaccacacagggaagcaccagggtcagttaggaagcagaaggagtgagggaaagagcctttattgtggggtttgtgggaaggaatggatgagtcaaagcaagtaggcttaggtttggctagtttgaatgattttcgtgggctctgggttgtagagttctttagcaagacgtctggtacctagccctgtggttataaaggcaggagaatattggctaggtgtatgaggatttgataagggaggtcatgctggtgggatgggctttggattggctagtttctgtatgaaaggcatgcttacaggggtgttatttgctatcactagcaattagctaatgctgtgagggacagtccctcctggtccattgagtccctggatgccagaacattaagaatacagaaaataagagaatatagttaatacattgtataccaaygccaggaaagattctgatttgccttacttgagtcattccagctctgtagtttaggtgcagagtacagggtgaggaatggtattgtgattgacagtcaacctaraccagagtgtagggatcagggaggactaccctaaagaaaataaagccagaacatgggaaagtatgctggtaaatcaaaaactgtatcgactggtctatcacaaggtggctagagccgtcttggttgagatgaccaggtggccattcaaatatggctcttggcctctagacttcgaagaggctaaggatttttatttttgttttagcagctctcgtacaccatgtattgctcccgggcttgatggccctcttctgtcctgcttttctaaagcctatatagttcctgagctcagtgttaaaaaccaaactggagttttaggcatcatttaggttttctgattctcttggtgaggtaccagtgttttcctcaatgcctacctcaraaaccttagctttgactcccttcctttcccttctatcaagtcatttatcttcttctgaaatagctcccagatttacttcttccttactcatattagctgttgcctttctagtctctcttttttaatacggctttctgaatattgccagagttatctcactggggaaacatcatccccacttctcccacaaaaaaaatctaccccgccatttggacattacagagagtaaatggtgtgtacatattacatgggtgagtgtctgaagacctagattcaagtcacttcacgttcctcctctgcattttattaaagatatttggtagcttacataagaaaatgcatgttttaaaactttttataaatcataatgtagttcagatgatggtgattttttgatttctctaattttgaaattctaattttcaggcttatctttttctttttttttttttttttgagaaagtctcacactgtcacccgggctgaagtgcagtggcacgatctcggctcactgcaacctccgcctcccgggttcaagcaattctgctgcctcagcctcccatgtagctgggattacaggtgtgtgccaccacgcctggctaatttttttatatttctagtagagacagggtttcactatgttggccaggctgatctcaaactcctgacctcgtgatctgcccgcctcggcttcccaaagtgctaggattacaggtgtgagccaccgcacctggccttatctccttttctaaatgaacctctccgtcgccacacttaggccaagtttgtttctatctttatatctttctatattgttcccaacccgaaatccccttctttgctctactgtctgccaactaaatattagctatccttcaaagtgtgtctgaagtcctgtctcttatatgaagtcttgtctaattatctagatcacctgtattctctatttttcttacacttcaatttcactactgattatttacctttaattattatatatcttttattctccacaatatgtttgatgcttctgagggcagggatcctgacttttacttattttgtatcatggacagttctgggcataaatttaaaaaaaagttgctaatgattaattattaattggggaaaagtactaatttgcaataatcacactttggatatagtttgtgagcttcccttttcctcatggggagaaataagtttggattgattggactgacagatgttgaaacaatttggttcagttagacaaattcttattgagttctaggacatatgggtaactgctgaataaatattcatttgttcatttattcagtcaacaaatatttattggatatccattgtctgccccacactgtgcaagttaccataatatatgtctgcaatcagacatttagatattgaaaatctaaacatgaatcttacatggttctcatcttcaatttgctttattacatgaccaaggatgagatcattgggtgattataaagcattgcagaaaagtaaatgatatgcttgtggacatttgaagaagggagtaatttattctgactcgggtagctcagaagaggattcaaagagaccatattcaggaaaaaatgaaacatgtagaaaggaaatattaacactcatgtttgctttgtgaaaattttgcattttacacagtgtgttgttaaaaattaacgtgttggagagtttccatttccaggaagatggagtaaatgtagtttttcctatttgtctcctaagtgcaactaaaaacccttgacattatatatataaaacaaatataagaagactctgaaaggtggagagaataaggcaaaccagctggagacctcaggacctgaggaatgacacattactgagttccctgggtttttctttttgccttgtatatctcagacttagagctgaacaaatgggtaacttggagatgccaatggtgcagacaaaaaaaaaaaatctccagcaaaagcctgttttctctaacaaaggacccaaaaagggataatccagcaaaacaaaacttttaaaaagtaaccactctattgcaaacaaacagaaaaaattgtggccccacccttatgtattcagcaaagactgagtggatatcttagatgtctactctaataaggctgtgatgaggtatctgaatatccctgccagggtagggtcagagaagaccaagtagaggtactttccttcccatcaaccagtaatgagcctcctgctgcccccaccacatccccacttgtgatgtcagcggggatcttggacttgtggcctaattgacaataatgcacctctcccttgccctgctggcatgatgtcagaggagatctagtggacttttaccgtttcccagaagtattgaggccatcttaccacagtgtcagtggataccacatggaggatctacaactctcactttcactcagaatgtatgaggagaccctgcccctccttgagtgtcaatggaacctggacttgtacctctatctggcattgatgaggcagtgacacctcccactctccattgcccctgcagtagtgtcagagaaatccaactaaaatggatgtggagtctcataacataatataaatatctgggtttcaattgaaaattacttgtcacagaaagacaggaggaaaaaaaacctagagaaacaaaaaacagagaagaaaaatagaaaataagaaataaaattgtggacaagttctaatatatcaacaattacattaaatgttaatggcgtaaatgtaacaatttaaaacagattgccagaatggattgaaaaacatgatcaactctatgctatgtacaagaaacttacttcatatgtaaacatataggcaatttggaaaggagagaaaaacatatgtaattgattcttgttaatcatggtagttatgttctgtaaaactgctgtgaatgctgaatttgtaaatactaaactgctgttcctaggggaaatacagagctagattcctgcaagcctctggtcacatttttctcaactggtcaatgaataattttattttatgtgttctgtttaaagacrccttactgagtatatattatcgattcattaactttgaactcattgccaagagctctagaactcatatctgaacaaagcttatcgcacacacatgttttctctgtaaggtacatcagagctttcatttgcttaggaacaatagggctttagtactatgcttgaggccattttaaacagtaaaatcaccaacaaaaagtacaaacatatcaaaaccgtggcactaaataaactgtgagaacagttgtttacagcatgagagctaaaacaagaaggcaaagtatttacttgtttgacctaggctaggaacatgtgtatggagtgactcaattttttttwtttwtttwtttttttttttgctgtactgcacttgtgcacaaatgactgcaaaagcaatgcaagtatgattttggggttacaaataaattttagtgagtaggcaaattagcaaatatggaatccacaaataatgaggatagatggtgtcatgcaaagatcaatcaaaggaaagcagatatattaatatcagataaagtagacttcagatgaaagaaaattaacagagacagacattatctaatgataaaagccttatgctaatgtttataacagctttatttgtaatagccaaaatggaaagaatccagttgtccttaaattgatgaatggttaaacaaactgtgatatatccatactatggaatactactcagcaataaagaggaaaagattatttatataggcaatgacctggaagaatctttagggaattctgctgagaaaaaaatcaatcataaaggttatatacacgtttctatttatataacaatctttaaatgacagaattatagaaatgaacaacaaattagtggttgccaggatttaaggagtttgggtgggggtgggagtagagggatgcgtgggtgtagctgtaaaagagcaacaggacggacggatccttgtggtgatagacatgctctatgtctggactgtctcaatggcagtatcctgcttctgataaagtactgtagttttgtaggatgctgcactggggaaactggggaaagtttacataggatctctctgtattctttcttataactcaatgtgaatctacagtgatcccaacataaaaackgtaatttaaaaaacttagcgtactttactgtatgtagctcctttccttgtacttgataaccttaagtctttttgtcaaccagtgatacactggtctacaaatatttattttgaattcctgcttcgttctcagcattatggtggctggaactattaggaatacaattacagaagcataagatttagagtacatataaaaaagcgtgtgtgtgtgtaaagcatatgcaagtatgtctgagagagtaaacataattctcatctttcaaaattttagtgttccactgtaaattgtaaaagctatagtgtaaagtagcatttgtaatcctattcagctcttaacttgccaagaatatcctctcaggatgtgttgcttcactacagtaccaaccattgtgttgtcaaatccatgtgaattatgcaaaacaaaagaaaaacaaatggcctacctaaggtttggcagctgcaacaaggaaactatcaatttgaggtttattgtaatacattaaatttgaaagaatattcttccaagtaattctagggcttggaatgaatgaaggatcatttgaaaaatctgcaactcatttctaaaagattaggaaaaaagagaaaagaacatagttgccaacttctccttggtttgtatttatggaatatatgaaggtttagcattttagattctttcctaattctcagttaatttacctgtagaatctctttgaagaactacttttacatttctttcattttgatgagaaaattgaaaacttggggcaactaaaaagaagtgtttagcttgagtgatagttcattaatatgatttttaggggcctggcagaaacaaatagatcctagcaggtcttgtgatttagaggattattagagatttgggtgaaatagataagtatttctcctttgatagaatcagataattgtctctctgtgcaatgtccaacaccagctttctatgtaataaaaataaactgaaaacaaacaggaggcaaaaataaagcttcatggrcttcttaaactgtttgtgaaagttgttgttctagagatcataaggtagggagttaataaatactttgttccttgacagggctaccccattgtaccactccaaaaccatgggaatggtgtcctgtgaggttgtatagtacacagtcagccttgttctgtgcagcatccctgggacctgccatgtactagacactgttctaggtactggggatatagcagtgaacaaaacagatgagaaatatccctgccttgatggaatttccattctagactggaaattgagacaatgagccaaatggataaattaattttatagcatgcttggaggtggcatattctatgccaaaaaataaagcaaaggagttggaaaacaattgctaggattggggagttgtttcagttttaaatagggtggtcagatcacttgagtgcaggagttcgagaccagcctggccaagatggcgaaaccccatctctactaaaaatacaaaaattagctgggcttggtggtgcgtgcctgtaatcctagatactctggaggctgaggcatgaaaattcctttaacttgggaggcagaggctgcagtgagctgagcttgcatcactttactccagcctgggagacagagcaagactctgtctcaatttaaaaaaaatggggtggtcaaggagtgcttctttgagaagtgaatgttgtttctttaaaatttttttttaaaatgttagattcagggggtacatgtgtgggtttgttacatgcatatagtgtttaatggtgaggtttgggcttcaagcatagccatcacccaaatagcaaacattttcaaccaagatgaaggtgtactgttmactctgggtaagagtgtgccaggcagaaggaacagttactaccaaggtactgaggtgggaatattgcccttcagcaaagaggctagagtgactggagcagagaaggggaatggtagatgttaccagtggagtcttgactaggagtcatccaggttcttggcagtttgaacaaagaattggacaaaacacacacaaagcaatgaaagaatgcagcaacggaagtacagatttattgacgtgaaagtacactccacagaatgagagtggacttgggcaagcagctcaggagcagtggttacagaattttctggggtttaaataccatctagaggtttcccattggttacttggttacatcctacataaatgaggtagtgggmcatgaccagtctgattagtcgcctttcatgatcagtcagagactgaagtggttacaaagttacacccctatgcaaatgaagactaggcctgtgaccagcctgattggtggtgggaggggacaaatcagaggtactttccatttttcatctgataccggaaggggtgtgttgtaaagggagtagcctctgatacttttgttacatgggcttggaaagttggggttttccttatgatttagttctaggaagtcagtgtgaattggccttagggtccctgcctcctggcgctattctcctgcctcagtagagatgagatctgaacataagatgggacttgtgggacatccataagacttcagcttttattctgagcaagatagggtgcaatctgagggctctaagctgggaggtgacattagctgactagatagctgtgggtagtgtgaacactatattgtctggctagttgggaagtggctcaaatatcatattgaataaatcgcaataaaatgctaaagttggagctgtaactgaggaaaatggtggttagaaaagagaaatgaaaaacaaataaacccgtgacaagacttttctattacttgtaagaaagtggaagtggaggagtgggggatactgtcttgtaataaaaacttagtcttatttctaaaaagtaattgttcaactagaagcaacaaaactaatcatagggaatctgttttagtaggtaatgcagtatgtcaaccatttttagagtatctcaaaattttcaacattggcaaaatacccaaagctggcattacagcttggattcttcccagtggaaaaccaagttggacacaaagttctgaagaggaaaggagtctgagaaatagaaagaactgagatgcgtgtatttcctgaaccttttttccccctgtccttaatgatgttgtggttaaaacacttttgtgggtttattgagactgataaatacgctcatttacatctcattaatgtcaaattgatgtggctgaatagcatagtttggtagtctctaatgtgtgagacttcatgacttaagtaaacttttctattactctgaattagtgtcaccaagggcataggttttttaaagaaatgcttgtagagactttaaaataatgaaaaatattcaacacacctggctaagagtgattgtattacattcctgtttctttagataaaggtctgtcagcacatccattacaggcacatcttttcaggttgaaacttggcatagcagttctaaagaggaaagagattcaaacaaaatgtgaacaaaatgtttcttttgcttgaagaagacattcccttcataccctgatgcagctacatcccataaaactttgagaatcttattttcgttttgtttttggtaaaataagaagcgcctttgaaaaacagtttatctttggacacgaaggtaaagaaaaaccttttgatgtttggcaacagatttgcttaagaacaaaaatgatttaaaggactttttgaaaagagttagtgttgtctatttttattttctcagacagaccataatcacaatgactattgaaacaccgatacccttaagggctaaatttatcccgcctgtccctggaacaaaacaagaatatccacaaacatgacaccctctttggcagaatagacactaagtgcatatttgttgagaattgagaagatgcataagtcagagaaaakaaattatatttaaaaaggctttacaaatttttagtttttgaggtaatatatacaagtggaacacaactcaaaaagagtatgtagtgaaatgtaagtttccttcttcctccttgctctaagccaccactgggttaccctccacagagacaagcactgttatcagtgtcttatgtgtcatttaagagagcatattcttttttctttttagttaattggtagctttacattttattctgcaccttgctttgttctcctgacatttcattttggaggctgttcaatatatgtatgtagagagctacttctactgcattctttttaattagcttcatgttctaattggtacgttacatgtaccaatacacatagatgtaccatgatttacttagtctatacataaacatttaaactattcctaacttttcctattacaaacagtgtaacacaacatcctcgtgcacagatcattttgtgtgagtgtatctgcaggataatttctagaagaggaatatttatgttaaaagtatatgcatgtatgtagactcttctccatagaaattgtacacgcccagcagcaatatggaagtgtgcctatttctccattccctttccatcacaatgtatatcaaaaacttagtaatgtgatggaggggaacagcactctgttttagtttgtgtttttatcatgagtaatgttgagcatctttttataagtttaagaatcatttgtattttctatgaactgtttatatattttcttgcttttagaaaatattattgatccttttcttattgatatgtgaaaactcttttttaaaataagtgttttctcaacacacactagtgcatttttggtgtatgtaagttccaattggctttttatcataccaaaaatgtttattttttcctatttttatagattaataataattgtacatacttatggagtatgtgtgatattttgatacatgcatacaatgtgtaacaatcaaattgggatatttaggatatctattacctcaaacatttatcatttctttgctttgggaacatttcaattcttttagcaattttgaaataataaattattattactatgtcaccttactatgctgtccaacactaggacttattccttctacgtttctgtatataaccaatctctcttcatccctcccactgcctcacacccttcccagtttctggtaaccatcattctactctctatctccatgagataaacttttttagctaccacatgtaagtaagagcgtgcaatattttttctttatgtgaatttattcctgggttttctattctattccattggtctatgtgcctgacttatttcacttaacataacgacctccatttccatccatgttgctgcaaatgacagtatatcattcttttttatggctgagtagtattccattgtgtatatatatgccacattttctttatccagtcttctgttgatagacacttgggatgattgcatatcttggttattgtgaatagtgctacaataaacatgaaaatgtaggtatcccttcgatatactgatttctttgttttgtatttgcttttttaaaagtaatttttatttcaatagtttttggggtgcagttggtgtttggctacatggataggctgtttagtggtgatttctgagattttggtgtacccatcacccaagtagtgttcactgtacccaatatgaagtcttttatccctcatcccctttccaaccttccctactgagtccccaaagtccagtatatcattcttatgcctttgcatcctcatagcttagctcccacttataaatgaggacatacaatactggttttccattcctgagttattttacttagaataatggcctccagctccatctaacttgctgcaaagacctgattttgttcatttttatggctgagtagtattccatggtctgtatctaccacattttctttatttacttgttgtttgatgggcactttggttggttccatatctttgcaattgcaaattgtgctgctgtaaaaatgcatatgcatgtgtctttttcctacgtgacttcttttcctcttggtagatattcagtagcgggattgctggatcaaatggtagttctactttttgttctttaaggaatctccatactgttttccacagtggttgtaccagtttacattcccaccaacagttctaaaaatgttcccttttcaccacatacacaccaacatttattgttctttgaatttttaattatggtcattcttgcaggagtaaggtggtatctcattgtggttttgatttgcatttccctgatcattagtgatgttgagcatctttgcatgtgtttggtggctgtttgtatgtcttcttttgaaaattgtctatatgtcctttgtgcactttttgatgggatttggattttttttgatggtttgtttgagttccttttagattctgtatattagtcctttgtcagatgcatagtttgtgaatattttctcccattctgtgggttgtctgtttgctctgctgattatttcttttgctgtgcagaagctttttagtttaattgggtcccatttatttatttttgtttttgttacatttgcttttgcagtcttattcatgaattctttgcctaagccaatgtctagaataagttttccaatgttatcttctagaatatttatggtttcaggtcttaggtttaagtttttgatccatttgaggtgatttttatataatgtgagaaatgaggatccagtttcattcttctacatgtgacttgccagttttctcagcaccatttgttgaatagggtgccctttcctcaatttatgtttttgtatgctttgttgcggatcagcacttacttaatatattkggctttctttctgggttctctattctgttccgtcggtctacatgcctatttttatacccctaccctgctgttttagtaactatagccttgtaggataatttgaagttgggtaatgggatgcttccagatttgttctttttgcttatcttgcgttagctgtgaggccccttttttggttccatgtgaattttaggattattttttctaattctgtgaagaatgatgatggtattttgatgggaattgcattgaatccgtatattgctttgggcagtatggtcgttttcacaatattggttccacctatccatgagcatgggatgtgtttttatttgtttgtgtcatctatgatttctttcatcagtgttttgcagttttccttgtagagatcttttacctctttggttgatatactgatttcctttcctttggataaacacccaatagtgggattgctggagtgtatagtagttatatttttagctttttgagaaacctccatgatgtgtttcatcatggctgcactaatttagattcccaccaacagtatataagcgttcccttttctttgcatccttgccagcatttgttattttatgtccttttgaaaatagccattccaactagggtgagctatcttttatttgcatttccttcatgattagtgatgcaaagcattttttcatatacatgttttccacttgtgtatcttattttaagaaatgtctcttcagaccctttgcccactttttaatgggattatttgggctttttttttttttttttttagctgttgagttgtttgatttcctgttatgttctggatattagttccttgttggataaatagtccgcaaatattttctctcatactgcaggttgtctcttcactctgttgattgttttctttgttctgcagaagatgtttagtttactgtgaccccgtttgtctatttttgtttttgttgcctgtttttgaagtcttagccataaaaatctaatgtcctgaattgcttctcctatgtattcttctagtagttttatacttttgggtcttatgttttagtatttaatccgttttgagtttatttttgtatatgtagtaggggtctactctcattcttctgcatggatattcagttttcccatttgttgaagaactgaatgctttttctatgtctactgagatgattcatatggtctttgtccctcattctgttgatgtgatgtatcatatttattgttggtgttgaacaatccttgcatccctgggataaattccacttgattgtggtgtattgtctttttaatgtgttgttggatttggttagctagtattttgttgagaatttttgcatctgtgttcatcagggatattggcttttagttttctttttattttttagtgtgtccttgtcttgttttgatttcagggtaattttggcctcatagaatgaattaggaataattccctcttctccaatttttttgaatagtttgagaagaatttttgttagttcttcttcatgagtttagtagaattcagcagtaaagccatctgctcctggtcttttcttaacttgagacattttattaatgattattactaatttttattctgctcaggctttctgtttcttcctggctcattcttkgtaggttttatgtgaccaggagttatccattttctctaagtttttccatttgttaaaatatagctgtttataatagtctccagtgattctttgtatttctgtggtaccagttgcaatgtctcctttttttttttgtttctgattttatttacttgaatcttttctttctttttcttggttactatagctagcagtttgtcaattttacttatattttcaaaaaccaacttttcatttcatcgatcctttgtactttttcaagtcttgatttcctttagttttgttctaatgttattacttctttccttctgttaatattaggtttgatttgttcttgcttttctagttccctgaaatacatcattaagttgtttatttgaaatctttctacttttttgaggtaagcatttattgctataaacttccctcttggcactgcttttgctgtatcgaataggttctggtatgttgtattcacatcttcatttgtttccagaaatattttaatttccttctttatttcctcattgatgcaatagtcattcaggggcatgtggtttaaccttcatatatttgtacagtttccaaagttcctcttgttactgatatatagttttagttcattgttgaaattcccaactgatatggtttggctgtgtccccacccaaatctcatcttgaattcacacgtgttgtgggagggactcagtgggaggtaattgaatcatgggggcttgtctttctcatgctattctcatgatagtgaataagtctcatgggatcttatggttttaaaaacaggagtttccctacacaagctctttgcctgctgccatccatgtaagacatgacttgctcctccttcctttccaccattattatgaggcctcccagccctgtgtaactgtaagtccattaaacctctttattttgtaaattttccagtcttgggtatatccttatcagcagcgtgaaaacagactaattacagtaaattggtaccaggagtggggtgctgctgaaaagataccccaaaatgtggaagtggctttgggactgggtaacatgcagaggttggaacagtttagagggctcagaagaagataggaaagtgtgggaaagtgtggaactccctagagacttgttgaatagccttgaccaaaatgctgataatgatatggacaatgaaatccagactgaggtggtcttggatggagatgaggaacttgttgggaactgaagcaaaggttatgttttagaaaagagactggtggcattttgcccctgcccgagagatctgtggaactttgaacttgaaagagatgatttagggtatctagtagaagaaatttctaagcagcaaaacattcaagaagtgacttcagtgctgttaaaggcattcagttttaaaagggaaacagagcataaaagtttggaaattttgcagcctgacaatgcaatagaaaagataatctcattttctgaggagaaattcaagctggctgtagaaatttacataaataatgaggatcctaatgttaatccccaaaacaatggagaaaatgactccagggcaggtcagaagtcttcatggtagcccctcccatcacaggaccagaggcctaggaggaaaagatgttttttttggccaggcccaggtccctctgctctgtgcagcctagggacttggtaccctgcatttcagcagctccagccatggctaaaaggggccaaggtacagcttgggctgttgcttcgcagggtgaaagccccaagccttggcatcttccacatagtgttgagtctgtaggtacacagaagtcaagaactgaggtttgggaacctcttcctagatttcagaggatgtatagaaatgcctggctrcacaggcagaagtttgctacaggggtgaggctgtcayagagaacttctgccayggcagtgtggaaaaaaatgtggggttggaacccaayacagaaaccctacttcagcattgtctagtttagctgtgagaagaggaccaccatcctccagactgatagatccactgatagcttgcaccatgcacctggaaaagctgcagacactcaatgccagcccatgaaagcagccaggaggggggctataccctgcaaagccacagaggcagagctgcccaaggccatgggagcccacttcttacatcagcatgacctggatgtgagacatggagtcaaagggcaccattttggaatgccctgctggatttcggacttgcatggggcctgcagcttctttgttttggccaatgtctcccatttggaatgactgtatttacccaatgcttgtacccccattgtatctaggaagtaactaacttgcttttgattttacaggctcataggtgaaaaggacttgccttcactaagatgaaactttggactatggaattttgggtaaatgctgaaatgagttaagattttgggggactgttgggaaggcatgatttattttgaaatatgaggacatgagatttgggaggggccagcgcagaatgatatggtytggctgtgttccccacccaaatctcatgttgaattctcatgtgttgtggrggggacccagtgggaggtaattgaatcaygagagtggatttttcttgtgctattcttgtgatagtaagtctcacttactcactcgtgatagtgagtaagatctgatggttttwaaaagagaagtttccctatacaagctctctctcttggcctgctgccatccacgtaaaacgtgacttgcttctccttgccttctgccatgatggtgaggcctcccagccatgtggaactgtaaggccattaagcatctttcttttgtaagttgcctagtcttgggtatgtctttatcagcagcatgaaaatgggctaatacaccaactattgttgtactggagtctgtctctccctttatatctgataatatttgttttatatatctaggtgctctgctgttgggtgcwtgtatgtttggaattgttatattctctttctgaattgatcccttcatcattatataatgactttctttgtctctttttacaggttttaacttaaagtctgttttatctgatataactatcactattcctgcttgcttttggtttcatttgcatggaatatatttttccatccctttactttcattctatatgtgtccttacagatgagatgagtttcttggagacagcataaaattgggtcatgctttttatccattcagcttgattatatcttttaagtgaagactttaatctgtttacattcaaggttattattgataaatgaggaaatattcctgtcaytttgtaatatgatttttggttgttttatatatcatttgtctctttcttccttttttattttttatcattgtggtttagtggttttctttagcggtaatgtttcacttctttktctttctcatttgtgtatcttacttttatactttcatgtgtttttatkatggtagagattatccatttgctttcagatgtaggattccgttaagtatttcctgcagggctgatctagtggtgatgaattccctgtttttgattgtctgggaaatactttatttctttcatttctgaaggacagatttgctaggtatggtattcttagatggcagggttttttcttttggcactttgaatatatcattccattctcttctggactgtaattttttgctgagaaatttactgttagtcctaatcagacttgtatatgataatccccttgtatatgacttggcactttttctgtttttagaattctctctttgtctttggcttttggcagtttgcttataatgtaatttagagaagacctttttggattatgtctatttgtgagtttttgtgcttcttgtacctggatgcctaaatctcttgcaagatttgggaagtttttaagtattattctgttaaacaggttttctatgttgttatctatctcttgcccttctggaactgccagaattagaatttttttctttttatggtgtcccatatattatctaggcttccttcattcttttaaatccattttttctatttttttcttttctcttttgtctgactgagttattaaaaaaaaaacctgtcttcatgttcagcagttcttttctgtgcttggtatactctattgtagaagctcttgattgtattttttatttcatttattgaattcatcagttccaggcctttggttttgttctctttggatatctgtctctggtatttatcattcagctcatgaattatttttgatttctctgtattatttatctgtgttttcttgtatctcactgtgtttctgtaatattattctctggaattcttttttaggcattttataaatttcctttactttgggatctcttactggataattattgtgtttcttttgaagtgtcatgtttctttgcttttttgtgttttttgtatccttacattgatttcagtgcatctgacataacaattgcttctgattttatgcattggctttcatggagaaagactttttcctgtagataatctatagtgttggttgggtaaagtgctttggttttgattctggttgggcacggtagtatagtctgcatgatttctttggctgtaattagcatcagtgttttctctgagttcctcagtggcttagactgcagttgttaatggatgttgtggtgaggctttgctggagatgggcatgccatgcaggctggtccttgggtaccagtggtgttggtgaggcatgcctgtcctcaagtccctgatggtggatgcaggtgttagctgtggcaggtacggttaggactgatccttagacccccacacagtatgctcgggtgcaagcaatcatggtggtgggtgggatcggcttgtctttaggccccagatgatgtacttgggtgccatcagtggtggcagtggatagggtagccctgtcttcaggcccctggatggaacatgtgggtgccagtggcagcaagagggatgggttgatttccaggttcttggattatgtgcacagataccagcagcagggaaagtgagcctgtcctcaggccccctgatagtgtggggaggtacgagcaacagcaggtggagcagattgatttaagagttagctcagtgttggccagacttggtggctcacgcctgtctcccagcactttgggaggctgaggtgggtgtatcacgaggtctggagttcgagaccagcctggtcaacatggtaaaactccatctctactaaaaaaaaaaatacaaaaattagccaggcatggtggcgcttgcctgtagtcctagctacttgggaggctgaggcaggagaatcacttgaacctgggaggcggaggttgcagtgagctgagctcgtgccactgcattccagcctggggtgatagagtgaaactccatctcaaaaacaaacaaacaacaaaaaaacaaaaaacaacaaaaaaacaaaaaacaaaaaaacagagttagctcagtgttttatgatttataaatattttcttaattttctaggcatttgtgttttgattttttgttatgaaatactttttatttctatttttattagtcaaatttatcaattttaatgggttctgagttttttgacagaattagaaaatctttattgctctgagatcttttttataaaccatctcattttttaatggtactttaagggttcttatgtttaaatctttaatctgtctcagatttattttggtgtaaggtgtgttatatatatctagcttaatttttcttcrattagttatcaakrtttttttgtttttatatcactttttgaagttcattttttccgatgggattcaaatatacttatsacattaaaattttctaactatatttgtgtctatttctgggttctctgttctgtttcattgatctatttttctgtttacaaaccagcaactcaccattttaaataatagctttacaayaggtttttatatcttgcattgctaatcccgatcatttgtgttctttttcagaatgtttcttgttattcttatttttcctgtgaacttcagaatcaaatcaatttcttttgtttcaaatagtgttaattgtgtgtgtgtgaatatgtgtgaacatattaaatttatagaataagtcaggtagaactgacatctttaacatttagagttttcttatccatcaatatccctcacttttccatttrtttaattcttgtgggtccatcagtaacattaaaagttttattcacatatttcttgttatacatttttctagttactctataattttggttgctacttttaatgcaatctattcttactttggatctcctatttgcrttgttygtatgtatgaaaagtagtggtgtcacaatattatttttgtattcattcacttaactgaattctgtcattatttatagttttccagttgattctcttgtgctgtccaggtaaataatcatatagtttccaaataatgatattttagttttatctyttawaattttacctgcattttactgtctagttatgttattcaggacctccaaaaaattaatggtggtcatagtagacactcttgtcttcaacttattgttaataagaatactaataatagagttttcattaagcatgacatgctggcttttgagatgcaacagagatattttgtcatattaagagaggaaacccttttttcttrgtatagtacatgataaggrtttttgtcaaaaataacgttgaattttatcaaaagccttttcataatttattgagatggtattttagttttctctttttattattaacatggtaaattatattaatagatttattgttatacattattcttttatttggtgcataaacaccacttagtaatggtatattatactttaatgtgatcctggattctatttgcaaatactcacttagggtcttttttcatgatattcacaagtgagtttaggctatatttttattttttttctgtgctttttattgtggatttatatgttataaatatacatttgaagattttctttttttttcctatgctctacaacactttgaatggcattaaagttaggtgtttcttaaaaatttgtcagtattccgctagtgaaaccaactatgtgttgaactattttgttgggagtaaattgacaatttgtcctccttttaaaacmgatagtgatatgttagattttcaaatttatctgggatgtgatttcttagaaaagcatcttaattctcaaatttactcacactgaattgatcaaactggtgttataggagtcttttaattttttttgtttctgggatcttcctcattgtttcttgttctttgtatttgtattttctatccttataattaaaaatgttytggcgagttaaaggttttgtttcgtgttatttctcctcctccacccatgaaacatctgttgggtttacttattctttcacattccatttttcttttcttttcttttcttttctttctcttctcttctcttctcttcttttctttttttctttttctttttctttttttgagacagagtcttgctttgtcacccaggctggagtgcaatggtgcaatcttagctcatcacaacctccgcctcatagattaaagtgattctcctgcctcagtctcctgagtagctgggattacagacgcacaccaccactcctggctaatttttgtatttttagtagagatggggtttcaccatattgaccaggctggtcttgaacttcgcctcatgatctgcctgcctcggcctcccaaagtgctgggattacaggtgtgagccactgcacctggccacatgccatttttctaattcattatttcactttttatgtttattaatttctttttttctattttcctgtttttcattttattctaacttcttgartgcttatattatctctttcattctttcttgkttattaatatttcagctatatcacctagataattgtatattgttctttcttcgattgttatttcccagatatcctataatttcagttttgattttatatttgatgcaaaacttaacagaattttaaaatatcctgatagtagattattttcattttctgggtttgttatttttaagttttattacattatgagcacagatgtatacattgtttttcctttttgaaaactgtcaaagtttttttttgtttgcaaatgggcagttttgtgaatgttccatggaaacttggaaagaaggtgtagtctctatttttagagtaatgtatatcacttaattttatttaggttttccatattctgaaaaaaatttttttttgcttattctgtcatgtcctgagagaaaagaaagtttcctattgctgagattttattttctaatttaagacttctgttttctgtaggtttttctttattgatattgcttctgtattactgggtaattagatagtcataacatttaatctacattttgtattgtgccctttagcattacaaggtgtttatcttttttcattgaacatatactatgctgcattaaaacccatctgatattaataccatgaacgttattttctttttacttgctcttgcctgttgtaatctttgcctttccttttattttcaacccttcttggttacttattgatttgtcgtattcttgtgtgcagcagatatttggattttgctttgaggcccacctcatttttcttttaatgagtatgtttaggccatgtgtagttgtagaaataagtgtttacttttaattctgtcattatatcttatcacactttgttcacagtatggactatttctgctttgtggggcgtgtgtgtattttctgatttggaagatttgtaattttatgctaccagttactttataattatatctttatgtgactctctatttcctactattagcatagatgaacttggcaatttccattttcttccttctactcctactgcaaaattgacggtactatatttcttcatgtatgcctctttatatttcaatgtactgtaattctgttgcttgacttaccagttttaaatgatctcttttgattgctagtatatcaattagaatattttcattgataagtaactgaaaagccatctagtggttgcttaatcaattaagacaattgctaccttaataataatgttaataagtccagaagtaggatagttctagtatctcaacaatgtttttagaatccagtttttccatatttttcttgaccattctcagcatgtaggctcttaacctcattgttgtttcttcttggttacatttataggcatgaatttatcctatagcagcataagagacagagaaaaatgctgtttatcttctcaaatttcttcataagaactgagaaacaaatgtctgctcatgactcattggacagaattgaatcacatgttcatgctaaaaccagccaaygttaagagaaatagatttcccaagactagcttatgctaatcacaaatcattctgtggagctggggagaacctcctagttctacaatacagaagcagaaaaggataaatttgtgtaggtctccagtggtgtctgctacctctgtctctataaaatgaagaaatcagcagaaatatactgccaccaattttcttgcycccttgctgtgtcaagttttgttaattacacattgttacatgtcaaggcttctaacctattcattctatcctgtaaccataatgtatttgttttggtcttcgttmtagagaattcagtacaactattagtcattttgccagagatttatcatgcatttcttgattgactgaagttaatgcactagcaatttcttccagaaatggaaaaagggaagaagggaaccaaattctgtggattattgcatgttaaaaaaagtttgtcagcagtcattgtacttcagcaacagttcgattggatataaaattttttcttatttccttgaggacttttctctagatgggaaaaattatgtattgaaacctgttccttccattgttttgattacactttttggggacactagttgtacatrtgcttgatttccattttctctctcttcctggccttttggctaacatcaagtgtaattgatttccattttctgtatatatccttttttctataatcattaaaaaattttacttttgctataatcctttttaacttggttattyacattttattctgatcactttttaaatttgtgtccttcataattcttactttgttttcagcagcatttactctgtttggattgtctccaatatgaccttcatttctctgatggttttatttttctctcctgtttatgagctctgccagtccaatcatcatctccttgtattgcctygccttattttacttgggctcttgtatacttagtttgcatttttaatttatagaggtatgtgcttatttttttgtttatatcattatatttggtcacaatttttatctgttctgtggcaatattttttggatgccactttcctctgttccctattttctccttttgtggctcttatgcaagttattccttttaaaaaataatcatctctaactgaggcacattttttctggatcagctacctgtaaaaggtttgtgtgagaggggcaccccattgtgttctaggctaataacaattgtccttatgatttaatgagtatttttttwaatttagcttttactctcttccccattgccttgccttcagacagatttctgaaaatatagcttatacatgtgatttgttattcagtctcagttacttgctttctttagtgccaagttgtgtccaggaaatctattgccaagttatgcaactactatcattattcctaacaagggattgttagtttttctgttaggatgtgatgcttactttggaagattgttttctgctgtagccatatgtagtttcttttgacatcttcttgcaactccgtttgagctgtgatacaaagtttacatgcccagtgcaggggaaatgatgtgtgtctgccrcttttgagtgctatgattgttcacttctttagattctcatagtctgtcctgataattgcaggaattagaaaaggctggcctagagtcctttcctcacctatgactttagggccacattatggcttccttttcccatttcatgaaaatatgactacatctatggtcttttatgaaaaacaaagtaaaatgccctgctagcaactggcaacccaaatccaagaggtaaccagattttctttaggaatataagtttttccaaggcaatatccatgtgtgagacatctttggaagaataaatgtacagaarttggttgtattagtttcctagggctgctttaacaatttaccataaaaccagtggcttaaaagaacagatatttattctttcacagttctgaaaagctgaagttctaaatgaaggtaacagcagggatgctgttccttcagaggttctaggggaagaattcttccttgcctcttccaggttctagtggctccagatgtttcttggcttgttgctgcataactctaatctctgcctcagtctttatatggctttcttccttatgttctgtcttctcttctgtctcttataaggatacttatcattgaatttagggcccatccaggatgatctcatctcaagatctttaacttaattatatctgtaaagtccctttttttgaataaggttatactcatcaaaagtactaggggttaggacatggatgtatattttgggggaccattactcaacccactccactagtgtttctgtgtcatctctcttcatacatttaacagttatatatatagcaatgtctttgtgagtaacactgttctgggggtttcagagtattgactatcttttccttaaaatgtttataatttacttgaggactcaagatctacatttggacaataatataagttaaaacaaaaaataaagcggagtcattttggtaactggtgtgagaattccattgctgggaaatatgttcttgatatgatactttgataagcttgggtagaagttagcctccaaagcccagctagtcctcaggtttctttgatgctggtatgagaagtggcttttcggtagaggcaagcctaatggggatttccatgtaaaatgctgttctgtgcactctgacccttccttattactccaaaatatgtccaaaaccatataaataacagtgaaaataggttgagtgtatttcttttggaaatcactgaacaccctgggcattatcaaaacatacaattacatataattaaataagacaataatactattaataagtcatacagttctggaaaacagtaaggtctctctggttggagttgtctctggaaaatgaatcttgagttgaatgttaaaattgggtggaatatgattgagaaagggtattctagaaaggagaatgatattggtaagtgcaggagtgtacctaagacaagcttgagacaccaagtgagtggtctgatcctgctgaattacagtaggctttcagtagaagtgcaagattgtaccttgcttgtaggtgtgtaatagaactattgtgaataaagttgtggttcataataattattgaaccctagggcattaagcaaacataggcagtggtcaggtagttacagcaggccttgggtgagacccagtgctatgctggcttcaggtctgacccagcacagtcccagtgttggtgactgcagggttgcttgtgccacccctctcccagctccaggcagctcagcatagacagactctgtttgtttgagagaaagtaaggaaacagagcaagagtcttcctggtaatccagagaattcttccggatcttatccaagaccatgaaggcgataactctacaagtccacaggagccacagttttactaagctttaggtgtcccctaatgcagatacagctgcaatgaccaaaaacttagaccacaacacccaagtcctttcaaatatttgaaaagccttcctaagaaggacaggtacaaataagtccaggctgcaaagacaacaataaatattcaattcttcaacagccagagaccaatgaacattcacaaggatcaagaccgtccagaaaacataatctcaccaaatgaactcaataaggtgccagggaccaattctggagatacagagataggtgacctttcagaaaattcaaaatagctgtgttgaggaaactcaaagaaattcattgataaggaattcagaatcctatcagataaacttaacaaagagattgaaataattaaaaagaatcaagcagaaattctggagtccaaaaaggcaattgacactctgaagaatgcattagagtatcttaacagcaagaatagatcaagcagaagaaagaattagtgagcttgaagacaggcattttgaaaatacgcaaagtagacaaaagaagaaagaataaaaaagattgaagcatgcctacaggatctagaaaatggcctcagaagtgcaaatccaagagttattagccttagaaaggaggaagggtagggaggggggagagagggagagagagagagtagggtagaaagttcattgaaagagataataacagagaactttccaaacctagagaaagatatcaatattcaagtacaagaaggttatagaacaccaagatttaacccaaagaagactacctcaaggcatttaatagtcaatctcccaaaggtcaagtataaagaaaggatcctaaaagcaagaaaaaagaaacaaataacatacaatggatctccaatacatctggcagcagacttcagtgaaaactttacaggccaggagagagtggcatgacatattaaaagtgccaaaagaaaaaatcttttaccatggaatagtatatccagcaaaaatattctttgatcatgaaggagacataaagacttttccagaccaaaaaaaaggctgagggatttcatcaacatcagacctgtcctacaagaaatgttaaagggaattcttcaatcagaaagaaaaggatgttaatgaggaataagaaatcatctgaaggcaaaggactcagtggttatagtaagtacacagaaaaaaatggaatattataacactgtaattgtggtttgtaaattacccatatcttaagtagaaagatgaaaacatgaggtgatgaaaaataataaactgcaactcttcaagatgtaggcaatacaataagatataaatagaacaataaaaagttaagaagcagggagacgaagtaaaagtgtagagttctctttttgcttgcttgttagtttgttaatgcagtgttaagtcaccagtttaaaataatgggttataagatggtatttgcaagcctcatggtaacctcaaatcaagaaacataaacaaatacactaaaattaaaaagcaaaaaattaaaacatagcaccagataaaatgaccttcacaaaaaggaagacagaaaggaaagaagggaggaaggaagagaagaccacaaaacaaccagaaaacaaataataaaatggcaggcataagaccttacttatcagtaataacgtttaatgtaaatggacagaactctccaatcaaaggacatggagtaactgaatggtttaaaaaaaaaaaagacccaattatctgttacctgctggaaacacaataaagaaatatcagacttaatctgcacagtagatcaaatggacctaatagaaatttacagaacattttatccaatggctggataagacacattcttctcctcagcatatggctcattcataaggatagactatatgttaggccacaagacaagtcttaaaacctttgaaagaacagaaattatgtcaaatatcttctctgactacagtggaataaaactagaagtcaataacaagaggaactttggaaacaacaaacacacagaagttaaacaatgtgctcctgaatgaccagtgggtcattgaaaaaattaggaaattaaaaaaaaattgaagcaaataataatggaaacacaacataccaaaacctataggatacagtgaaagcagtactaagaggaaatttatgtgtataagcagctacataaaaaagaggaaaaacttcaaataaacaaactaatggtgtatcttaaagaactagaaaagcagttttttccaattctgtgaagaaagtcattggtagcttgatgaggatggcattgaatctgtaaattactactttacagtgcatatggaaccaaaaaagagcccgcattgccaagtcaatcctgagccaaaagaacaaagctggaggcatcacactacctgacttcaaactatactacaaggctacagtaaccaaaacagcatggtactggtaccaaaacagagatatagatcaatggaacagaacagagccctcagaaataatgccacatatctacaactatctgatctttgacaaacctgagaaaaacaagcaatggggaaaggattccctatttaatatatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgagagaaaattttcgcaacctactcttctgacaaagggctaacatccagaatctacaatgaactcaaacaaatttacaagaaaaaaacaaacaaccccatcaaaaagtgggcaaaggacatgaacagacacttctcaaaggaagacatttatgcagccaaaaaacacatgaaaaaatgctcatcatcactggccatcagagaaatgcaaattaaaaccacaatgagataccatttcacaccagttagaatggcgatcattaaaaagtcagggaacaacaggtgctggagaggatgtggagaaataggaacacttttacactgttgatgggactgtaaactagttcaaccattgtggaagtcagtgtggcgattcctcagggatctagaactagaaatatcatttgacccagccatcccattactgggtatatacccaaaggactataaatcatgctgctataaagacacatgcacacgtatgtttattgtggcattattcacaatagcaaagacttggaaccaacccaaatgtccaacaatgatagactggattaagaaaatgtggcacatatacatcatggaatactatgcagccataaaaaatgatgagtttatgtcctttgtagggacatggatgaaattggaaatcatcattctcagtaaactatcgcaagaacaaaaaaccaaacaccgcatattctcactcataggtgggaattgaacaatgagaacacatggacacaggaaggggaacatcacactctggggactgttgtggggtggggggagtggggagggatagcattgggagatatacctaatggtagatgacgagttagtgggtgcagtgcaccagcatggcacatgtgtacgtatgtaactaacctgcacattgtgcacatgtaccctaaaacttgaagtataataataataaattaaaaaaaaagaactagaaaagcaagagcaaactgaacccaaaattagtagaagaaaataaataataaagatcagagcagaaataaataaaattaaaattaaaaaatagtacaaaagatcaatgaagtgaaaagttggttttgtgaaaagataaacaaaatttacaaactttagtcaggctaagaaaaaaagagagactacccaaataaataaaataagagatgaaaaggagacattacaaccaataccacagaaattcaaaggatcattagaggctgtgatgagcaaatatgtgccaataaacttgaaaacctaggagaaatggatctcattctagatacaaacaaccacaagattgaactatggaggaatccaaaacttaatcagatcaataacaagtaacgagatggaagccataatggaaagtctcccagcaaaccaaagcctgggacttgatggttccatggctgaattctaacaaatgtttaaggaaaaactaataccagtgctactcaaactagtccaaaaaatagaggaggaaagaatacttccaaactggccttctatgagaccaatattaccctgatacaaaaaccaaacaatgacacattgaaagacaaaaacaaaaaattacaggccaatctccctaatgaacactgatgccaaaattcttaacaaaacattagcaaactaaattcaatgatacactaaaaagattcatcatgaccaaggggaatttatcccagggatgcaagtatcctcaacatatgcaaaccaattcatgtgatacatcatataaacagattgaaaaacaaaaaatcatatggttatttcaactgatgctgaaaatgtatttgataaaattcagcatcccttcatgataaaaactctgaaaaactggatatagaatgaacatagttcaatgtaataaaagccatatatgacagatctatagctagtatcttactgatgaggaaaatctgaaagccttttctctaagatctagaacatgacaaggatgcccaccttcactactgttattcaacagtcctagcaagagcaattagacaagagaaagaaataaagggcatccagattggaatggaagaagtcaaattatctttgtttggaaatgatgtgatcttatatttggaaaaacctgaagactccaccaaaaaagtatgagaactgttcaacaaattcagtaaggtggcaggatacaaaatcaacatataaaaatgagtagtatttctatatgccaacaacaaacaatctaaaaagaaatttaaaaagtaatcccacttacagtagctacaaataaaattaaatacctaggaattaaccaaacaagtgaaagatctctacaatgaaaatgataaaatgctgatgaaggaaattgaagaggacacaaaaaatggaaagatattccatgtccatggattggaagaatcaatactgttaaaatttccatactgtccaaagcaatctgcagaattaatgcaatccctatcatgataccaatgactttcttcacagaaatagaaaaaacaatcctaaaattaatatggaaccactaaaggcccagaatagccaaagctatcctgaacaaaaggaaaaaaatgaggaatcacattatctgacttcaaattatactactgagccatagtaaccaaaacagtatggcactggcataaaaacagttagaccaatggaacaaaatagagaacctagaaataaatctatacatctatggtgaatttatttttagcagaggaaccaagaacatatattggggaaagaacagtctcttcaataagtggtgctgggaaaactggatgtccatatgcaaaagaatgaaactagacccccatctttcatgatatacaaaaatcaaatcaaaatggattaaagacttaaatctaagacctaaaaccatgaaactactataagaaaatattgggtgaaactctctaggacattggactgggcaaatatttcttcagtaataccccacaagcacaggcaaccaccgcaaaaattgacagatggaatcacagtaagtcaaaatgcttgtgcatagcaaaggatacaacaaagtgaagagacaatccacagaatgggagaaaatatttggaaactatccatctgacaagggattaatagccataatatgtaagcagctcaaacagctctataggaaaaaatataataatattatgaaaaatgggcaaaagatgaatagatatttctcaaaagaaggcaaacaagtgttgcaaaggtgctcaacatcactgatcatcacaatatgcaaataaaaactacagtgagatatcatctcaccccagttacaatggcttttatccaaatgacaggcaataacaaatgctggcaaggatgtggagaaaagggaacccttgtacactattggtgggaatgtaaattagtacaaccactatggacaacagtttggagttttctcaaaaacctaaaaatagagctaccataagatccagcaatcccactgccagctatatacccaaaaggaaggaactcagtatattgaagagatatctatgctcccatgtttgttgcagcagtttttcacaataagcaatatttgggagcaaactaagtgtccatcaacagatgaatggataaagaaaatgtggtacatgtacacaatggagtactattcaaccacaaaaagaatgagatcctctcatttgcaacatggatggaagtggaggtcatttatgttgagtgaaacaagccaggtacagaaagacaaacatcacatatttccacttatttgtgggagttaaaaagtaagacaattgaattcatggacatagagagtgggatgaaggttaccagaggctgagaaaggtagtagggggctggtgggaagtgagaatggttaattgctacaaaaatatgtttagaaagcatgaataagacctagcatttgatcgtacaacagggtgactatagtcaataataatttaattatacatttaaaaataactaaaagagtataattggattacttgttacacaaaggataaatgcttgaggtgatagatactccacttaccctgaagtgattatacacattgtatgcctttatcaaaatattttatgtaacgcatatatatatatacctactatgtacccacaaaaattaaaactaaaatcccaaaataatataaaccacagtgtcatatttgtgcttcactgcattcaaacaaattttgaaacatatggtactgagggcccaagctgaggacaaagagacatcaagcacacctattctaaagtgaactataaataactggggtcagacacctcccccagagatcagtgagaggtggccaaactgtccttatcactctaaactgtcacccaaggcctttcctatcatttcccaattgataaaagaagatgtggggtagagaggagaaagaagatgacattgttacatttgtgagtttcttgccaaatgttgtgtttccctccctttcccgtgggggcttcctgcctacttcaaagccctgtgaaaagtggactactagacaagagcctgggagtgtcaacaggagactggcttctcactcctggctagatgttgcatgaggtgaggcagcagaggcttagcttggtgaggttgttagcatgaagtgaagtatggtgaaggaagaaaaggacctaccatgggtccttgatgtgtgggggcatgtatgtacttggaaattgatgccttctgcttgcgtggctgcactactctgccaaggctgatagacaatggaccgcaggtaagatgtctaagaagaagacagagaaaatcccccagctcacttagaaggtctggaggaggattttcatggttcctatggcttgtcagaataagtctagcaggtagaatgcaaggcatgagtttgggaactgatcaagtggcatctagttatgagataccccatttggtgagagggttgagtgcgtggaccagtgactgagacacaaaatggagatgcagttgtctcttgttttgagggcattctcagtcatgtatagtgctggcttgaagcagaacatctctccaagtaaactgcatgcaccttctgggtagatagcaccacattggtaaagaccaccagcatcagaaagaaccagacctagctagaagggaactcgaaacagctgcccacttcttccagacagccagtctcatatgtcaacctctgccacatctgaaatttctctcccactgctctaatgcgtgggtggacttacagcctgraagctggaggagggaggaggtacagaggacacagagaacatctctttccttcctgaaggatggagggagaaraactttccccctgtctgctccaggcctgacctgaagcttggctggccccagggagagcaaagaagagctttatactagctatgaaactggaatttaaaatatatttgagtcttaaatactggaattagactcttctaataactgaaagtgattggaattttgtggaatattcccagatgttactaagggatagtgaaatatgattcaatgtaggacagctgtcagcagggattgggaaaatgaaaccattttaagtttattttacatcaaatacagactgtacaataacctggttatatacaatatagtggaaagaaaatagattaagtcagactgacttgggtttgaatccttgctcagcaacttactttccacatgatttttggcaaattactttcaatagttttcttaactgtgaaatggggataggcagtaacatcattcttccaaggatttgggagaagattaaatgaaataaattctaggaagcgtctagtgtgatgcctgagacatatagacctctgaaatggggattgattattacagctggagacaaatctggtaaatcaaggactaatggctgatgtagctatcaaatgtaatttgaagtagttagatgggtgggatctgatgagtatttgatgttttctaaatcccaaactatctttttcaatgaagtcaatgcattttcaaagcatttttctgcttaatttggaakattaaatgtatctaactggaagcgcatactagaaaagcatgagaaagggcttcttgtcctgatcagaaagatgaggaggctccgaagagatctgaggtaggacttctgccagcctcaaaatgtgccacacacatttaactgggaagatgctctgaataacatactcttggccaygtgaatgcgttccttggcagccctggccctgcaaagtttggcaggaggggattttcgggttgccagctaaagccctgacactcagagcaggcctcagtgtctctgttcccaaccctgtccccatccctaactgaaggaacttttgtttgtgcaatagctgttgtatctcactcatcccttctactaattggctctgaccctaactttccatattctccagcttggagatgcctgtgggaggtttgctttgagaaggccccagctttggcattgtcagtttttcatctggctcctmatctatttcactttgtctcaagcttcccttctttggtgacccactaaaaactgaagttgtgctggcaagatggtgctttgttgtcatggaaagaggctgtttgcagaactgcggggttaacaagaaggcttctttggcctgtggacggttggtttgtctttggcagtagccagttggagtacagcagggaggcatgttcattccagaagccgtctagtcttcagttgaaggaagtgccatcttaattttgaagtgagagcaacttacatctagagcaaactctttgaaggagggggatcttccaatatcccgtgtgggcctcccgaaggcccgaggcatagacaacaaggaagcaaggaagatgaggaagaaaaggggtgggtagagaaagggagaataagagagagaaaggtgaacgaaagctacagctgctgaatcctcttctgtatccatcacatgtttttactgaaagtttaagataatatcccattgccttatgtttatttgtttattttgatagctaacacttaaatagtgcttactacctaccaggtgctgcattaacactatatatattaagtcttttaagcttcaccacaaactcatgaggtaggcgatggtactatgtttatttcaagatggtaaactgagacatggagccattaagtaacttttctaagatcacacagctagtaagtggtagagccaggtttcaaatgcaggatttatattttctcttccctttccttcctgtccctccctcccctttctccttctgtaaacaagtgtcttctttgaggtgtatttagtgtcacatattttgcatttttgtgctttttttgggggggttgtgattttgctgtttaaaatggcccccaagtgtagtgctgaagtgttgtctagtgcttctacatgcaggaagattgtgatgtgccttatagaaaaaatgtgtgtgttagataaccttcattcaggctttagttgcagttctgttggttgtgagtacaatgttaatgaatcaatagatagatattaaatatgatatttaaaagaagcatacataaaacaaggttatgtcttcataagttgatgaaagtgttatgaccagaggctcacaagaacctaactctgtatttcccaagaagccatgattcaataatctctaattcagtgtttgtgacaactttatagaacataactccatgaataatgagactttgccatattttttttggcaaagattataataaatatgtcttgccacctaagtttagcttgatgcacagtcttctaagctatgtggccatttgctaagaaataccactatatatgttttgtttcttcagttcataaaatctcatgcacaatatcttatgtggtgcctgagaaatagtcagtgctccataaatgcttattgaatgaatgattaaatgaatgaaaaaagtaacactcaaaatttacaagataatctagtctagtactttacattttaagaaatacatgaatggacctggaactaatgtgtgtgtgtktttttctttttaagtaagccatataacctatgaggcaagcaagttgttctaattgccttctggttgattacatactatttgttgagtactagctactgggattttcaaaatggaattttgcatagtttatttccctcaatcctacctaataagattaaggtccatctgttttgtataagagtccactgtttacttatcaagagtgctttgataaacgaagaggttatcagccacttgtatgggtatcctatactctgtttggctatagtgaggttaaaaggtcaagaatctgtaaggggattcttatccatgaggatattatgtatgcctagggaccatggaagtgaagttttgtttcatttattcatctattcaacaaatattttgaagacgtgctggtgatataatttggaatacaaaaatatgatgtccctgagattgttctttggcatcttggaaaatagtcctatgtagaaagcaacatccttcatactttcagttcttaagtattcatcaagcacctattatgtcccaggcactggggatatagcagtaagacaaagcccctaccctttgaaacttatattccttcaggaagaccaagcactgaacaacccatttgaggtaatactctcccctttggcccggattctgattcagctgctctttatttattatctccatattatgtgaaattatcttgcctttttgctcatttgcttattgtctgtctcccctcatgacaaatgtagctctaaaagagcagaaacttcgtctttcctattgctgaatgtccatcactgagaatagtgtttgatccaacagtagatgcttaataaatgttcgttcttatttaattatagttatggtaatgctaggaagtgtatttctggagattttgaattagtatggacaatcaggaatactcctttaaggaaatatggattgagttgaactttgaaggagtaagcagcaactaaatggagcaaagagtatatattctaggcagagggatcaggtcaaagaatggaacattagaatgtgtgatataaaattgatatatctggagttcaagagtaggagagtatattaggtgagtctagagaggtaggagagggcaggatagtcagggattaggaggctatatagggatttggagttttatcctaagagcattgggaagttattaaagaactacaaacaggaaatcaatctgttgttctgtggatgggagagagactactgagtggatagtgcaaccattcatggtcttgaagattaggtgttcagtctgggaaatctttgattcaaagtacctgtgaaacatccatttggaggtattaagtagacaattggctatacatatttttgggttcagagaaggaggtctgaaatgaatacactcatttgagtgacaacactgtgaatggtgtttgaagtcaagaggactgatgaaattgtctagggggagagtgtagagtaacaaaaacagagggcttcattcaggctaatctttgaggaacttcctcttttaaagatgataaagaagggtgaacaggaaagaatcttaaaagcagaaaagtttaaactaaactatctatgcttatttatatggcctttctgagtggttttattgtcaattgcccaagcatatctctctaataagactctatttaatttaccatattttaatcacttattttcttgtctttttcttctattgtccttgagagtagagattttgttctttaaaatcatgcttgaaaccctagtgcctagcatgcttccagcttaataggcatgaaatatatctgttattgagtgggaatacagagctttcttaggaaagatgagcaagagcggaaagcagatttttcctcacagcctcttctatgtgggacaccataaacattttattttaagccttttgtctataactgtgaaatggtgatttaggtatcaggaagcagatgggaaactttttgaggggtagaggcatttaaattctgcatctgtggtttctttgcatggatttgctcctacccctagacctgtggctgctaaaagttatttccagaagctgttgcagccaagagtctggtgtctacttcatcactttggaggttggcctgcctaggtctcccaatagtccctttccttctattccctctctcttgactatctgtttcccatttcctctaactttatcccaattcctctttgtccaaagaatcccagggcatgtttcataattataggcattattttactcaggatttattaacattttgtacagttatcacctttccccatttttccattatgaaatacatttttttatctcatataatttttacctttgataatgaagtgtgtatattctctttgataatggatctaatgataatgtgaccagtgtgtgaagatcagtgggccttcctctcctcccagttactccacattctggctaggtgcctctgctactaatagcttagcctgctgttcccatgtttgaggattgattctttttcctaggctgaggcaaacagttgtaatgttaaaggcttgctgacagcctgtctttgttgcctggaccgtgttttaatacgtgatctttgctgcctgaattttcttttttctagactacttgatttttcttgacctgtggaattttatgattacttgatttgtgaatttatctcaagcccctggttttgaaccaatgactctattattttaagccaggtgtattgtttttttagcctgtgtctattatactgtgtgttgcttcttatattccctatatctaagtaacttggctgactgggcattttgttaactttggggaggaaaagcatcaacatgacctgcatagggctggagaagagtgcagttagcccttgagggttgggggtgaatgtgttaagggtattaagggtggggagatactgctaagttggaraaaaactttcagcgaatttcactgatttcaaatcaagctgaatttgaagttcttgtctacatgagtgaacaatttttaaaacatttgaaggcatgcatttaaagtgacagcttaatgttaaaatgggaagttatgattcataagcagtagtaaaattttgaataacatgactttattcattgacagtaactgctttacattttccggtttcattatatcagtactgtgaataaaatccagaaaagttatagaggaggaaatgactttgagtttttattcaatagtcattacttacgtctttccacatttttttgcaaattttaagtttcagtaatgatcttgctattcaaattttctatttcttacaaccataatcttctagaatagccacaaaggtaggagtaagctgaagtaaaaagcctgtaggtcagtgtaaatgcctttcataaagcccacagcttgattcagtaaaacccagattgacgtctcttttcttatgataggcccagaatttatttgatttagttatatctatgacattttatttattttctcctggcaacatatagtttccacttttgatctaggggaaaaaaaggaggcttatagctgtaaaaatagccctgtacaaagtaatagaccctaaagtataactgtgcagagacaatgaagaaacagatcactgttgcttagtaggaatttctgcaatgacagaagtttttctatgcactgcccaatacagtggtcactagccacaaggagctgatgagcactggaaatgtggctattgaacctaagatactgaaatttaattttaatttcaatttaactaacttagtcacatgtggataggagctactacactggcctagtgcaagtatctacttcaagcttgtccaacctgtggcccaggacagctttgaatgcccacacaaattcgttaactttcttaaaacattatgagattttttttttcctaactcatcagctatccttagtgttagcatattttatgtgtggcccaagacaattcttcttccagtgtggcccagggaagccgaaagttgaggcacccctgatctagatcattgtattaactttctactggtattacaaaaaaattaccatggacttactggcttaaacaacacaatttcattttaatgaatgaatgaatgaatgaatgaatgatttttttttttggcttaggacaacacagatttattattttgtagttctgggagtcagaagtccaaaatgggttttacttggcaaaaaataaagtgccagtagagctgcattccttctggaggctctaggggagaatctgtgtccttgccccttccagcttctgaatgctgtctatgtttttggcttgtggctctttcctccatatttaaaggcagcaatgaccagtcaagtattgtcatattgtgtcactctkacactcaagttagaaatctagcactgttctcactgggctaaaatcaaggtgccctcagggctgctttattttctggaggatttaggagagagtccattttcttttcctttctagcatttaatggctgcccatattccttagttcatggcccccttcctccatcttccaagccatcaatgttgcatctctctgtccccttcttctatagttccatcttcctttgcctctcttcttctgcctctcccttacacttataaggattcttgtgattacactgagcacaccttgataatccaagatagtctccttattttaaagtcagctgactagcaatcttaaatcccttttgctatagaacctaatatatccgtaggttccaagaattaagactggatatttttgtgtgggccattattctgcctaccacagcttctaaatttggagccatttaatgaaaagacaaggtaagccatatgtgtgtgtgtgtgtgrrtatatatatatatatatatacattgtttgttgggcctatacctatatttcatccaacacagtatagggtctcaaaataatttaagaacaatagaaacttaattttaaaagaggactgatatgatatctgctccaatcttctatcccttgtagttttattctcttctataatagaatctctagtttattaattttctgtcattagtttcctgtgaaggatactccctacttaacaacaaaatcagctgcattgttgtatagctatggttgttctagatcatcctatcacctagcctttacaatcaccacagagtagcacgttggtttctgacttttggaacaatgttaacctgctttttcrcagagttacgtatctcaataaatggaattactacctacatagttgtctcggcaaaatcttgggaattcttctttatcacccaccattcaccactgttgaatattcttaatatataactcctaaaatatctttcagatctgtctacttcttttaagtattttacttttcagttttagaatttaatttttttatagtttcaatttatttgctgagattctcatttgtttatgaatcaagaccatgttttctttttctgtcattgttctttatgtatgttcattttttagtttttaaatttatctatatttaactcatttccatagcttttgaggtacaagtggttttgtttacatgaataaattgtacagtagtaaagcctacgattctagtgtacctgtccctggacattgtacccaatatgtggtttttttaatccctcacccctctcccaccctctccgcttctgagtctccaaaatccattataccaagctgtatgcctttgcatacctacagcttagctcccacttataagtgagatcatacagtatttggttttctattcctgagttactttacttggaataatggcctccagctctgtccatgttgcttcaaagtacattagttcattcctttttatggctgagttgtattccatggtgtataaataccacattttctttatccgcttatctgttgatgaacacttaggttggttttatacctttacaattttgaaccgtgctgcgataaacatatgcatgcaagtgtctttttgatataatgacttcttttcctttgggtagatacctagtagtgggattgctgggtatctactttactgcatactcatttattctgagtacacataaatgtggttgtgtattaacttgtgaatgcaaaaccatctctgcatccttgggataaaacccacttgatcatggtgaattatctttttgatgtgctgttggattcgatttgctagtactttgttgaggatttttgcattaatgttcatcaggaatattggtctgtagttttctttttttgttctgttctttcccggtttgggtatcatggtgacactggcttcatagaatgagttagggaggattccttctttctcaatcttttggaatagtttcagtagaattggtaccaatttttcttagaatgtctgatggatttcccctatgaatctctctggccctgggctttttcttttgttgttggcaatttttaaaaattactgattcgatgttactgcttgttatttgtttattcagggtttctatttcttacttattcaagctaggagggttgtatatttctaagaacttatccatttcctctagattttctagtttatgtgcatagaagtgttcatagtagtctcgaaattttttttgtatttccgtgctattggttgtaatgtctccatttttatttctaattgagcttatttgaatcttctctcttctgttttgtttatatttttaaagaaccaactttttggtttattggttttttggtttcaatttcatttagttatgttctgatctttgttatttcttttcttctgctagctttgggtttggtttgttcttgtttctctagttccttcagatgtgacattaggttattaatttgtaatctttcaggctatttgatgcaagcatttagacctataattttcctcttagcactgctcttgctgtattctgaggttttgaaaccttgtgtcactattattattcattttgaatcatttttatatttccattttgatttcattgctaccgcaaaaatcattcaggagctgattgcttaatttccatgtatttgtgtagttttgagggttccatttgaagttgatttctagttttattccattgtggtctgagaagatacttgatttgatttcagttttaaaaaacttaatgagatttgttttgtggcatgtcatatggtctatcttggagaatgttccatgtgttaatgagaagaatgtatattctgcaattcttgggtagaatattctgtaaatattattaggtcaattttttttatagtgtagattaagtccgrtgtttctttgttgactttctgcctctatgatctgtctagtgctgtcagtggagcattgaagttccccactattattgtgttgctatctatctgttttcttaggtctagtggtaactgttttatgaatgtgggagckccagagttaggtgcacatatatttaggattataatgtcttcttgtgaccttttttgccccccctttttttcttactattattgctttagtctgttttatctgacatcagaatagctactcctgcttgcatttagcttccatttgcatggattaactttttccacccctttaccttgagtttattagaacccttacatttaaggtgatctcttgaagacagcagatatttggctgtgatttttttaaaatccattctgccaatctgtatcttttaagtggagcgtttagacaatttacattcaatgttaatactgagatgtgtgtactgttcagtcatcatgttgatgttgcccagatgctttgctttctccactgtgcggttgttttataggtctgtattagtctgttctcacactgctaataaagacatacctgtgactgggtagtttataaaggaaagaggtttaattgactcacagttcagcatggctggggaggcctcaggaagcttacagtcatgggagaaggaaaagaaaacatgtccttcctcacatggtggcaacaaggagaagtgctgaggataatagggaaaaacaccttataaaaccatcagatctggtaagaactgactcactatcataagaacagcagcatgggggtaactgcccccatgattcaattacttcccactgggtccctcccatgacacatagggattatgggaactataactcgggatttgtgtggagacacagccaaaccatatcattctgcctctagcccctcccaaatctcatgtccacatatttcaaaacacaatcatgccatcctaacagtcccccaaagtcttaactcattccaacattaacccaaaagtccaagtccaaagtctcatctgacaaggcaagtcccttctgcctattagcctgtaaaattgaaagcaagttaattacttactagatacaatggggatacagacattgggtaaatacaactattccagatgggagaaattgaccaaaacaaaggggatacaacccctttcaagtctgaaatctaatagggcagtcattaaaccttaaagttacaaaatgatctcctttgactccatgtctcacatccaggtcatgctgatgcagaaggtggacatccatggtcttgggcatctccacccctgtgactttgcagggtacagcccctctcccagctgctttcacagctggtgatgagtgtctgtggttttctaggcgcatggtgtaagctgttggtgaatctagcattctggtatctggaggacagtggccctcttctcacagctccactaggcagtgctccagtggggcctctgtgtgggggctatgacaccacatttcccttccacatcaccctagcagaggttctccatgagggctccattcaagcagcaaacgtctgcctggatatccaggtgtttccatacatcctctgaaatctaggcagagcttcccaaaccccagttcttgacttctgtgcacccgcaggcccaacaccacatgtaagccaccagggctttgtgcttgcactctctgaagcaacagcctgagctgtacttagcctccttttagccatagctggagctgaagcagctgggatgcagggcatcatgtcttgaggctgcatagagcatgggggccctgtacatggcccacagaatcatttttccctcctaggcctctgggcttgtaatagtaggggctgccatgaaggtctctgacatgccctggagacatttttcccgttgtcttgatggttgacatttggccccttgttacttttgcaagtttctgcagctggcttgaatttctcccacaaatttttttttctattgcatcattaggctgtaaattttccaaacttttatgctctgcttcctcttgatcgctttgccccttaggagttttttctgccaagtacgctagatcatctctctcaagttcaaagttacacagatctctggggcaggggcaaaatgccaccagtctctttgtgtaccaagagccaccattactccagttcccaacaagttcttcatctccatstgagaccacctcagcctgcacttcattgtttatatcagcattttggtcaaagccattcaacaagtcctaaaatattccaaacttctccacatcttcctgtcttctaagccctccaaatctctaggaagttttaaacttttccacattttcctgtcttcttctgagctctcaaaactgttccaacctctgcctgttacctagttccaaagtcgcttccacattttcaggtatctttacagcagcgccccattcccgttaccaatttactgtattagtccattcttgtgctgctaataaagacatacccaagactgggtaatttataaaggaaagagatttaattgagtcacagttcagtgtggctggggaggcctcaggaaactgacagtaagcaaacacatccttcttcacatggtgccagcaagaagtgcagagtgaagtggggaaaacctccctagaaaaccatcagatcttgtgagaactcactcactatcatgagaatagaagcatgggggtaactgcccccatgattcaaatacctcccactgggttccttccacagtgcatggggattatgggaactacaactcaagatgagatttggatggggacacagccaaaccataccaaggtccttgagttttatgctttcaagaggtctattatggagcatattgacctattgtttcaagatttagaactccttttatcatttgttgtagggctggtgtggtagtgacaaactccttcagaatttggttgtttgaaaaagactatttctccttaatttatgaaacttagttttgctggatacaaaattcttggttgatagttattctttttaagaggctaaagcggacaccaactccttctggcttgtaaggtttctgctgagaagtctcctattagtctgataggttttcctttataagttttctgatactgttgtctcactgctcttagaattctttccttcatgtctacttctgaagcctgttggccatatgccttggtcatgcccttttttcagtgactctcttaggagttctttgagattcttgtatttggatacctaaatctctagcaaggccaaggaacttttccgcaattattccatcaaataagttttccaaactttttgctttctcttctccctcaggaacaccagtgattcttaggtttggccattttacataatcccatatttcctagagactttgttcatttcttttaattcttttttatttctatttttgtctgattgggttaattcaaaagccttgtcttcaagctctaaaattcttctacttggtctattctactttttaaactttcctctgcattttgtaattccccaaatgtgtctttaatttccagaagttttgattggttttcctttaaaatatctatttctttagagaatttttcattcacatcctgattttttaaataaaaaaattatgttggtttttatctttctcttatatctcctcaagtagcttaataatcaaccttttgattttttttatctggtatttcaaagattacttcttggtttggattcattgctggagagctactgtgaccttttgggggttgttatakaaccctgtttcgtatttccagaatcattttctggtttcttctcttttggatagataattttttctaattattcttgaatktatttttgattctactgtgttttcttttttttccctcttgatgatgcgactttagtatttacagtttattctagcctaatgaagctcttggtgctttcaggggtgaagactctgtatgaaattcgttgattatagatagtctttgtattatggctttctcagatgttgattgtagtagcaatgtgttcagtgtgtgagcaggttcatagtctcttgtggggttgaaatggcagaggtctcttgaagcttatcttattccccagtgatgtgcacattttaatttatttttttccccagtattttacttactgggttgaagaattcaggcttcaggccagtaggggaggtgtctgtgggtaaaaaaccagtgtggccaaagcaggtgggtaaatgcaatacccagtggtgggcagaggtcctagccttgatagaggaggctgggggagctctcagtgaaacacagtgagttctctgcaggggaaatttaggcagccacattagcttcccagccaggccagcaggaaagcaatctacctcccagtcatactcctgacccagtgttctagctattcacatcagacaggtgcctctttccatctccaagaatgttgattctctaagtagatagggattgtgactctactccttgtgcaagcctgaacctggagggcactcctcctgtgaggaaggagttactctgaaccatttcagaaaggctgtctataggtgtacccacacgaagctcccatgaaagaatccccagctgtatctgcaatggtggatgagggggagaagaagtccccttctccaagacccttcatgagtaccagggctgcccaagtattggatagagctgcagactttccctgtggagtgcagcacttcacttttgcctctgctgaaagaaacttcccacaagcagaaagttctgggactcaagacctgccatctggattcttttgtcccatggggtgctcccttgatgtggtgcagtccccctttctgcaggaataggagtccctgagggccagattactgtgaatgatgctgctcctcttagtttagccacccagtggggctgtcacactccaagctggtgctagggaatgtctgcaagggttccagtgatgtgaactgtcctcaagtctctgagcagcaggtaccagcactagctctgatgcaggtggcaggggagtgacatagactctgtgagatcctttgggtatacatagccttagtgtgttggctttctcaaatgttggctgtagtagtaatgaactggtcatgtggacagaccaggaccttctcattagctagggtgatgcaggcaatggtgaaagctgaggtcatgcacaagttttctctggcctgggcgctgtgtcattttaactgcagatggtgtaatggactgtgttggttggcttctagtaggtggtggcacttgcaaaagagtgccagctgtggtggtagcagtggattttttgttgttgttgtttccatgagcaaatatacagatttattttttatttatttttaaattttaaatttttattttaatagattttaagggaacaggtggtgttttgttacatggatatgttctttagtggtgatatctgagattttggtgcatccatcacccaagcagtatacactactacactgaatgtgtattcttatttctcatcccacttccaccctttccttggagttcccaaagtccactatatcactcttaggcctttgcatcctcatagctttgctcccacttatgagtgagaacgtacgatgtttgcttttttattcctgagttacttaacttagaataatgatctccagctaggtgcagtggctcatgcttgtaatcctagcactttgggaggctgagatgggcagatcacctgaggtcaggagtttgagaccagcctggccaacatggtgaaaccccgtctctactaaaaatacaacattagctgggtgtgttggcgtgggcctgtaatcccagctacttgggaggctgagggaaaagaattgcttgaacctgggaggcagaagttgcagtgagctgagatcacaccattgtagtccagcctgggcaaaaaagagcaaaactccgtcacacacacacacatacacacacacacacgcaagaataataatcttcaattccatccatgttgctgtgaatgtcattattccgttcctttttatggctgagcagtattccatgatataaatatatatatatatatatatatatatatatatatatatatatatatatatatacgtatatatacacacacacacacaccacattttctttatccactcattgattaatgggcgttggggctgttacatatttttgcaattgtgagttgtgctgccataaacatgtgtgtgcatgtatctttttcatataatgacttctttttctttgggtagatagccagtaatgggattgctagatcaaatggtagatctacttttagttctttaaggaatctccacactgttttccatagtggttttactagtttacattcccaccagcagtgtaaaattgctcctttttcaccacatccatgccaacatctattattggcacatagccactggtctatgtgcctatttttataccagtaccgtgctgttttggtgactatggccttatagtatagtctgaagctgggtaatttgatgcctcaagaacaatatgatttattcttttcgcttagccttgctttggctatgtaggctcttttttggtcccatataaattttaggatttttttttctagttttgtgaagaatgatgatagtatttttctttgctttatgttacccaggggaggtactcagacaatggattgggacatagagctccccaaaagttccatcatttgtgttaagctactaggacacatggaggggcaaagccaagtcgtgggcgctgggtcaggcaagtatgtgttctggctctccacgtgtgggcacaagcagtggctccagaggggattgtagggcagttctctagctgctggggtaatgttccagggaggagcacaactgcctctgttgtacagaagagtcttcatggggagtggggagtagcaggtgacagtaagccctacttagctcctatgcacttggcaaggctgttttcacacttgcagtgttccactagcagcagctagctagtttccaggcagtctgcatcaggactcaaaacttccccaggccataagctttctccatggagacagaaaccactgtgcccaggccatgcccctcccagcctgccctagaagcaggggcacactgcttctgtgcttgtggcttcagcccacttcccactcacccctcagttctggccaagggagttcatccgtacttgagattatattgtgaatcttaactgggggcttctcccaacctgttgtgtccggaattggtgggttcttggtctcactgacttcaagaatgaagccgcggaccctcrcagtgagtgttacagctcttaaggtggtgtgtctggagttttttccttctgatgttcggagtttcttccttctggtgggttcgtggtctcactggctcaggagtgaagctgcagaccttcgcggtgagtgttacagctcttaaggcagcgcgtctggagttgttcgttccccccagtgggcttgtggtctcgctggcttcaggagtgaagctgcagaccttcgtggtgagtgttacagctcataaaagcagtgtggacccaaagagtgagcagtggcaagatttattgcaaagagcgaaagaacaaagcttccacagcgtggaaggggacccaagtgggttgccactgctggctcgggcagcctgcttttattctcttatctggccccacccacatcctgctgattggtagagccgagtggtctgttttgacagggcgctgattggtgcgtttacaatccctgagctagacacaaaggttctccatgtccccactagattaactagatacagagtgtcaatacaaaggttctccaaggccccaccagagtagctagatacagagtgtcaattggtgcattcacaaaccctgagctagacacgggtgctgattggtgtgtttacaaaccttgagctagatacagagtgccgattgctgtatttacaatccctgagctagacataaaggttctccatgtccccaccagactcagaagcccagctggcttcacccagtagatcccgcaccggggctgcaggtggagctgcctgccagtcctgtgctgtgcgctcgcactcctcagcccttgggtggtcgataggactgggtgccgtggagcaaggggtggcactcattggggaggctcaggccacacaggagcccatggagggggtgggaggctcaggcatggcrggctgcaggtcccgagccctgccccgcaggaaggcagctaaggcttggtgagaaatcgagcgcagcgctggtgggctggcacttttgggggaccaagtacaccctccgcagccactggcctgggtgctaagttcctcattgcccagggctggcaggrctggccggctgctccaagtgcgggcccgccaagcccacgcccacccggaactccagctgttccgcaagcaccgcacgcagtcccggttgccactcgcgcctctccctccacacctccctgcaagctgagggagtgggctctggccttggccagcccagaaaggggctcccacagtgcagcggtgggctgaagggctcctcaagtgccgccaaagtgggagcccaggcagaggaggcactgagagcgagtgagggctgtgaagactgccaacatgctgtcacctctcactgtgaccactgcctgtgtcagctggcagacttctgtgaggtccctcccctgtgaggtaggatcaggaatggcttccctctatctctcctggagactgggaatgcacacaaagcatgtctcaatgttactctttctcatatactccctactgctccctataacagctccagtgctgtatagggttaaggccttcccctgtgcttgggttgccaggttccccagtaggagtgtatatcctggaggtagtttatccctctctcacattcaggggacttacggttttctgcctggctcatggtgtaggctgaagcctgccacttcattcaaagggtctgtggtttcttttagttttcctgttaagttcctgtattgcttcttggagaaaagttcacagtgtgaatctctgtgcactattttgtctttccaaatggaagaagcatgccaccaataactccaatctgccatcttggaaaaaaatgtacatatatcaagacgatattttcatttcattctttgaacatattttctcttaattccttgaacatatttaaaatagctgtctgaaagtcttctgtaaatccaacacttgcggcatcttgggattggtttctattgattacttttttaaaaaaaactgtggatcacgtgttccttttttctttgtggatctagtcatttttttattgtatgagggacattgtagacaatatattgcagacactcaaatctgttatttttctctgaagagtttcatgtgtgtgtgttttgtttgtttagaaggcagtagaattattggctgatcacattgaacttagataggcatggttttatgctttgctggaatggttctgtggaaagctctaggtgctgcctaagcccctataaattactaggacttaacttacaaattacttcctctgaagatcttgtcaagacttagttytaggcttttcttggactagtttagtctgtattcatagggcagtgtttctctatcttttttttcattactataaaagagatttttaagacatttttttcccagttttgctcccccctcctccatgaagttttaataccacagatataactctatatctgtttatgtactgtggttctttgaagaggtacaaagcattgtaatatctaagattctttttgctccccgcctccctgccaagaactaattttcatccgttggggatgatattccccttgttgcgaatgcattttctatggtgtggtcctaaggtaaagcctttctgatatctctgctggatgctccaaagattaataaggtgttcatgggttttttttttttcttccctggctgtgccagaatgccagtatcttccaacaatgctcaaaatctcatacatcttttatgtttttaatcctatagcagccactctataagctttgggtagtgctgtcctgcccacgtacagcccatctctcagcaatgtacttgcagggggctcctacacggactttgaggaccccatgttgcatggtttcttcctctctggtgccctgccctgcatgttttaacttttagcactttgaattctgccttcttatctcagtaagactgctgtcctctgcttggactctagctcactttactgtggttgggagttgtcctggcacaaagagatgggaaattgggattactttgtgagtttttattctctcagagattgcagtcttacactgcccccttcccaatgcctgaaaatagttgcctgttttgcccagttttatggttctgtggtcatttatggagggacagtacacctataccaataactacagtttctctgacttcttttggaagcagaagtcctccttctactactttcaattctcatctgcacctagtacaggtgataagcattctatcagaattaggacaataatyttctaacaggtcttctgatctccttactttcagcctccatactacctccagagtgaactttttgaaacacaaaaacacaaatctcctgtcattctcctgtttggaacccttattaggcactcctttatccttaggataaagttcagtcctttaaagtagctcacaggtccccctctatgatctttcttccagctctctctccagccttggctttcactctcgaccttgaacctttgtgcatgtcatactacttttttcagtttgtcatatgtgcagtggttttacttgcctccttgcctttgcacatttatttttctttttccggaattcctactctgtctccccactttacttggctaactcttgctaatcctttaggttgcagcacagatttaacttcttctggtagtcctataccaggatagaggccctgttttatgtttcatacactaccctggtgtcattattaacagttctttttttcttttccttacttccacaagaaataagctctataaaggcagggattttatttgtcttgtccagtgctatatccatagtgcttagtacaatgcatggttcacaagtaggtattccattaatatttatttattgaatgaataaatagagatagtgtttattccctttttcatatgattgctctttaaatatataggataactcttgtgggttccttatgtctttactttttgaggctacatattcagagatcataaaggaaaggtttaaatatctatagcaggagttggcaaactatggccctgggaccagatctggcctgctctctgcttttgtaaataaggttttattgaaatataaccataccagttttttttttcacatattatctatctatggctgcttttgaactaccatggcagaattgcgtagttaggatagagacatatgacctaaaatatttactttctagtcctttacagagaaagtttgctgaccactggtctacatgaagtttcctatgcatcctcaatttatttaaatgaagaagcataggaaagtatgctagagtatatgttgtaagtgatatactaggctagtctgaggtcagcaactaaccttaaaatcttagtggcttaacacaacacagatttatttctctctcatgcaaatttctttgatgcttggacaattttccagtgtactcctctcygtatagtgacttagagatccaggcagcttccattttgtgttccatcaaatcatctattttcttgatttccctggcgcaggaagaggaagctagagggcctgcaattcttgggactgaaagtgacacatagagcttcttctcatagctcattggccagaagtagtcatatggccctgcttagtgaaagttggttggaaagtaaggaaagacatataaatatttaatgagcgatgagcatctctgccatagaaagattgccttaaaatgattaaatgcttgttttttggggaaagttttcaacttaacattttcagcttcagttatcttgaacatgcaatccttccaagtaacacattataattatgtttttattttacagataccataccccgaatagtaaaatattatcaaaagtaaataggacaaggatttttttcttaaaaaattgggtctactggtttttaaaaattggattttatttaaaaaaattcactgacayaattttctaagaatatatcaattaagcaaattaaataaaatacagtaatggttgaaatggcctgaaggatctccctgacacaaggggatccttttataaacacttacatggagactgaaaatttatcctgctaatggagtattgttatttagagtggtggtttttcactactccctccacccctttggtttgttttatgtgatagaaccctcttaggagagagcccaatttataaaacatacaaaaaggagctattgtgtctgaagaaggcttgcgttggattctgtctactcaatctctcttttattacccccatctctccctccctaaatgagtacctttttagtatccttgaggactgaaaaacactgctttaagcatctataggacataatttcgagctgtagaaccacagattttagaactcaaagggaatttagagaccatgtactctaatttwactatgatttagtagatgttggttagcaactgtggagctgcaggacaacaaccaacttgtgtgcctgattttctaaaaaactaggggcatctcaaacaaaactaactctaaagtgattatttattcccaagagacctcttatattaggggaagactaccaatttacatcaaactagattccgaagggcattttcaggatctgtacttttcattttaatataatataatttttaatatataagtacccaagaacctaccctaaacaaaatctgggatcttgacagtaatctgtctttatacctcaccaacctatctctctgcctacccctatttgaactaatcatcattctggaccctatgtttctatttgcttgcttttctttttatatagttttattgcatctgtatgcattctctctctctctctccctgcccccttgctgtttttaactaaaaaataggggattgtgttgtttataatcttttgaagtacatttttaaaattcagtattatactgctcagaatcatccatattgttgcatattatagtcattcataccttytgactgctctgtaatattcaatgtgtgaatataacagcttgctatggcttgaatatttgttctttccaaaactcatattgaaatttaatccccaatgtggtggtatttagaggtggggcctttaggaggtgatttgcagtagtatttctgtgcataacattcaagctgagagccaagtcaagaatgcagtcccatttagagtagacacacacacacacacacacacacacacacacccctaggaatacatctaacaaaggaggtgaaagatctctataaggagaaccacaaaacactgctgaaagaaatcatagataacataagcatatgaaaaagcattccatgctcatgaattggaagaatcaatatctttaaaatgtccacactggccccaagaaacttatggattcaacattattcctatcaaactaccagtgtcatttctcacagaattagataaaaacaattctaaaattcatatggaaccagaaaggagcctgaataaacaaagcaatcttaagtaaaaagaatgaagctagargcatcacattatccaacttgtttatactataargtagtggtacaaaaacagacacatacaccaatgaaacagaatagagatcccagaaataaagctgcacaactacaaccatctgatctttgagaaagtcaacagaaataaacaacggggaaagaacttcctattcgataagtggtgctgagataactggttagccatatgcagagaatgaaactggatccctgcctttcaccacatacaaaaattaaccaaaaatggattaaagacttaaatataaggcctcaaactgtaaaagtcttagaagaaaacctaggatgtaccattctggacattggctttggcaaataatttttggctaagtcctcaaaaacaattgcaacaaaaacaaaaattgacaagtggtacctagttaaactaaagagcttctgcatagccaaagaaactatcaacagattaaatagacaacctacagaaagggagaaagtattcataaactatgtatccaacaaaagtctaatatccagactctataaggaacttaagcaattcaacaaaccaaaaactaataacctcattaaaacgtgggcaaaggacrtgaacagacacttatcaaaagaagacagacaagtagccaataaacatatgaaagaaatgctcaacatcattaatcatcagagaaatgcaaatcaaaagcacgatgaaataccatctcacactagtcagaattgccattattaaaagacaaaaaataacagatgctggtgaggctgaggagaaaagggaatgcttatatgctggtggtggaaatgtaaattggttcagccactgtggaaagcagtttggaaatttcccaagaaacttaaaacagaactgccattcaacccarcaatcccattatttggtatatacccaaaagaaaataaatcattttaccaaaaaagacacatgcactcatatgtttaccatagcactattcacaatagcaaagacatggaatcaacctaggtgcccatcattggtggattgtataaagaaaatgtggtacataaacatcatggaatactacacagccataaaaaataaataatgaaattgtgttatttggagcaacatggatgcagctggaggccattatcctaagtgaattgacacaggaacagaaaaccaaataccacatgttctcacttataagtaggaactaaccatttggtacacatggacataaagatgggaaaaatagacactggggactagtaaagtgggtagagaggcagggggtcaaggggtgaaaaattacctgttgggtactctgctcactacctggataatgggatcattcgtaccccaaacccatgtaacaaacccacacatatgccctctgaatctaaaataaaagaagaaattatagaaaaagaagtgattgggtcatgagggttctgtgctcattatggattaattcattcatgaattaatggattaatggtataacagattgattgcttatcatgcatattagtctattcttgcattgctataaagaaataactgaaactgggtaatttataaagaaaagaggtttaatttgctcatggttctgaaggctctacaggaggcatgatgctaatatctgcttggcttctgaggaggcctcaggaaacatacaatcatagtggaaggcaaacagcgagcaggcatcttacatggcaggaacaggagcaagagggcgaggggtaggtgctacacactcttaaatgacccrtgagaactcactcactatcttaaggacagtgccaagagggatagtgctaaaccattcacgagaaatccacctccataatccaatcacctcccaccaggccccacctccaacaatagcgattacaactgaacatgagattgggtgtggacatagatccaaaccacatcatcatgggagtgggactggtggctttttgagaagagaaagggagacctgagcaaacacttttgacctccttaccaagtgatgccctttgctgccttgggactatgcagagagtccacaccagatgtgacctcttgactttggacttctcagcctccagaactataagaaatacatttattttctttataaattacccagtttcaggttttctgttataagcatcagcaaatggactagtacatagtttattcatcctcttttctgttgatgggaaattgggttatttctaggttattgctgttgagtacagtgatggctatgaacattcttgtgcatatctctttttgtacatgtgcaagaggttcttttgggtatacacttagtgactaaattactgggtcatagagtatgtgagttttccactttagggagtaataccaaatcattttctagccctttagccaatatataatggaagcaacagcattttttttcttttcttatgaaagagcaagcagctatttagtcctgtccctacagttcccatttcgttttcactgggacctgcattaaaacacatctgagggtgtctcactttgaaaacaggtgtgttcaatcatctactttcaccttaggtcatcctcagtctagttagcagtccttgctcctgacataaggtataaaaacactctcaggaccacttcaggttttatctcatctcactgctatgttctgtggcagtaccaccttgattttcctagctgctttagtccttatggttcttttacatctcacctagctttctggctttaaaatccctagcttgcacctacatgttgaggaaagataactcttaggcctccctgacttccagattccggattttttttctcacctttgacagctgagagctccttaaacgatgggtgacacattcaaatgcttatataggccagggtgggagcactaatgagtgactcaggattccaggattaatataacactatcaggagcagtgggactgtggtggcctgatgatgggggtagcttctccttatggggttgctcccaggacttctgatttttccagagaaaaatagttatctagatttttaactgaaatctcttgacctttgagtgtcaacaatagatttaatatttagaaacactatgcaggccaaatgaaatatttctgacctggattcaacccataggtcgcccgttggtgaactttgcctcaaactttggcttatctgccttttgctttggccattgcctcacctgcctgttcctgccaaggtgtgcccctctctctggaggagacctcattgtgacatctctcaggtttaccttgacttccaagtgacctgatactgacagcaggcagggcaatgtctgattacttaccctttcctttctctcactgcttgccttaaatgcttctatcaaattctggttcttggaggcctgacttgttttgataatttttagaagagaaatgttatatggaatgatatttttttaacttgaaaaaagtatgacaagaggccaggattttattatttaatggctctcaaacttatttgcagttttagggcttctctgcttgatcttgctctggtgttgatcaggtggccctgacttcactggatgctggatttgtccctactcttgtcctaatggattggtgaactaaaacagcagttttttgatttaggaaaataaggtctttgactttcccccgtcttagaaacggtcacaatattttgatttgagattctaggcttttgagcatttgagaatatccttctcaaaacagaaaacctttgctttctttgcaattatttggcacattctaagggtggatatggtcagtatccagttgggaaataaagaaagtgcttcataaatcacacaactttttctgttgctgagtcagtatcagacacagatattttctgagtcaagcctgctgttctgtcaggtgggagattatgggtaaggtctgagattgagtggagttcgttagagcaagatgctaatgagcacagggtcatgggtttgatccccatacaagtcgattagcttaaaccataaagggactcctggctcatccatcctggcaaatatgtggtcacaggcctaaggaagactaggttagagagtgagaaaaatccttcatcatcaagaggaaaaaaaacaaacaaacctcaaagcccatgtcctattggatgtagtaagtgatatcatctgtggttgtagtcagtgcctatattacttatatgtagggagaagatttgcatcccattaaatctcccaaaatatgtaatatagcatgcatgaggttaaataaccaatgggaactatagtgacatccaaaaactctcgcaagagaagtcttatagctaactgagatggggtggaacctccatggccatggtggaactctgtgactgtgctgaagacctcttgtgcaattaattccttgttgggcatgaagccatgcacatataccctaagacaatgctgtcttctcctggaggatggataaaagggcagagaggattgtgtgagggcctaggattgtagccacttgtcctatggctgtcttattcactctgtatatttgcacaccctggtttcacattatctgagtgttttcctatggaaagaggttttcctatcttcattataagaaggacagtattttctagccatacccatttttcaaggatgatctatttaaaaattatttttcccaatgaaaaatttcaaatgaagtaatcagaatagaataatgaatgtccatatacacatcatctggatttaacaattgtcaacattttgccatatttgcttcattattttgtgtttttttgctagtgttatctcacctttacatatttttcttaaaaatgacaattttctgcataactgtaatactattatcactcccattaaaattaactatataatttcttaatrtcctgtagtactgcaaattcaaattgctcaattgtccccaaattgtcttttgcagccagtttgttcagtcaggatctaatcaaggatagtgaatttcttatgtgtgtgtgtttgtgtgtgtgtgtatgggcatgtgacatggagctgtggaagagacaagccagttggtctgtacaatgtctcatcttttggatttgtctgagttttcaggatgagttttgaagatttgtatttagtgttgaaaatgggcttgggtctggagattggcagtggccaggacaccctgtacagggaggaccttcgaaaatgagggaggtaaacacaaaggcagtaggaatgttccatatttttgtgtcttgcttcccagcagggctgacagacacaaactcatgtgaacacacagggacatagacctttataaaagaactgggtaatgtttttctctttgccaggccatagatagcacagaacttgaggatatgataatcctattggctgtatattttgaatagtgtatcctgaataaacaagataaaaccaagaggcagaaaaatgaatagaaattaaagctatgagaaagtcatagaaaattcttagtggtctgacattttgagtttgttcttctttggttaagttcactcatctctcttgggagtagagagaacccatatttgggataaacaactgcagaggaccaagagtcttgggagaagctgatgacaggcattcagaggtaagacttgggaagaaaatagccacagaaggaaagtacagggaggcaaacagtgggaggggccagctcatctcttttctccttccccccaaagactgctggttgtcagtgggcctataaaatcttttatgatcttaaaggtattttggaagactaagtcaatctttagcattcttaacctggagcaggggttctgaaacttgaactggcacattggcatcacctgggaactctaaaacacactgatgtctgggtaccaccctcagaaattctgatagaatttgtctcaggtgtggccagggcaacgggctttttaaaagactttccaagtaattctaatgagtatctaagtttgaggaccactgatctagatcaattaacchtacatacatayatatatatatatatatatatatryatttttttttaaaaagatacatttaacacctccccccacccaataaaccttatggaaacccaatgcataaaaaagattaaagtggaggtgctttacataaggtgctcttgaaacctggctgagtaggcaccatttgctacacccactccccgtttctttcaaaccctctcatcttcctacagcagtgtcttcaaagaattagggtctgaagagtaggactatttgaaaaataactggtccagagtttaaagggttttaaccatctacatctagaactctggctctttcaattaacttattaactgtatgactttgkacaactataaactctctgaacctcagttctcttatatcttaattagagatgatacctatctcacaggttgtaatgaagactaaagttggatatatgctagtgtactgtcagtagagattagttccttcagtagttcaggctttcctccaggctactgcaagctttcaggtctgtcctgggatgggactgatggtttggtttaatctgggaacttcagttaccttcatattatactcatatggtagggtgtacacagattccctttactcatgaggggtctaaaattcctgattgacttgcagcatcataggaataaatggaggtgggatgggggtggagtttgttcactgctgaatgctaagggagaagccaggagcttccatgaaatgactcaggaaatgctctataattcagataaactgttaatcaatggggagggaaccaggcaaagtccattttaaaatgaaaaaggtattaagatccataataggcatagtggaagggctgggggtgttgaggtgggaaggagttctctatggaccagaggagcaggttcatgactgagggaggagttattgattttttttgtaaacaatagatttttaagcaggaatgaagaaacatgaacatattcttccctatttttttgttccaatatggttaaacaaaactcccagataatatagaaaccttgcttattccccttatgaatatyttaccagtattgctaagaagtgaaattgattgatattaatttaacttcctcctcttcccacccagacattagtaaatagtgaaatggttgtaagtgttcagggagatgacaaaagagaagtctgaggcttgaggaattacgaagtcagatgatctgtaattgaataatattgagtagaatacacaaatcaaaagtggtgtaaaatctattacaggaaaaactcatttgagtctggccctgtcacagtcattgaactagtgattcaagtctgaacatggccagcagtggtatttcctgtttatctttcacaaagctggcaacaatttccacattatgttctctgcacatctccaacctctacggaatgaaaaatgcattttagtttcctcagcattcacaatgtagaaccttccagagaagctttcttttctttctggcatctggataaatggaggaatagcacgaagcggtaggtgcttaggccaattaagatgtttggtgggctcagtggggatgacccttagtctttaaaacatttttttgtaattatcttattcacatattattatccaaaataccatgactgtggttttggttgctactgcactttaatatagtagatgtatttttactttctatttttctttttttttctttaaagatttccattcttaatagatgagaaaaaaaattcctaagaagtaaaatgttaaagatgcttatttgggatcataggatctcttttagcaatttgcaatctgaagcggagaccacacaatttctggccacattgggatactgtctatactgctgcctctttctcacattatcttcctgctatctgacatacctatgctcacatccaggtactgaacaggggccctacatggctctgaggtaatcagagttcacttgtccacaacttgccattgaaaggctatgccctttagaatttcgtattctgaagaaaatttctattttttttaaatgtttcaatgttagtgagttgcctgaggaaagaatgtgataaaggtagttctaatcaaggtatatgtgagagactaattaatggtaggactcaatgttttatcctgatatgagtatactcatttcaaaaggagtctcctgtaaactccagctaaacaaacacaaaggcattttcaggatttcaggtatacatttgatggctggggcagagtggtgtatagagtttttcatgtagaccctcctcaaatctcaacacatgacttctatttcaaatctattttaaagaccagaactatttaaattttaccctaacatgactaaatttactttcctttatacctccacattgccaggacatttaaaagcctcttccaatcctaccaaagataagacactgatgacatctcatctcctgcctaacttgtgactattctcagtattggtgaagaggtgaaatttgtagatgaggkattttaatccttcactttgtatttgatacatgactttatgtattatggtgctgatttttcagcacatctttattttcccttttccagttttaacaatgaacttttccaatctatcgttacttagtgaagacggttaatagtgaatacatggttcaggtatttcttttaacagccctgcaaatagaaatacagtgtaagtcccatatatgattatatattttcctataatcacattaagaaaagaaacaggtaaagtaaaattttaataatacatttaatccaatatgtcagaaacattatcattttaacatgtaatcgtgtaaataatgaggtatctcatttttttcctgaaaaaaaatctttgaaatctgggatttctttgaaatctaggaggtattttacaattacagcctatctcaatttgcaggccatattgaagtgctcaatagctgagtgtggctaccatattcacagccttagaaaattttgagtaagatgaatataagctgtgaacccgtacttagtttcagttagactatcttctttatgaaaatgtttaaatctaaactaatttttctccccacatatgcttctctgctagtgttctccaattcagtagttggccctgacatgcctgtcatatgtggttttaaaggcagaacatggtagacctctaagaggcattaattacagtgcgcacagctgtatgtagcagtatgggctcaataacactacttagttgtccatgccagaaaaagagttatttgagacacatcatcttcctcatttctacactccatcttccaaaattgtctttcactaagtcctttcagttccacctccagagtacatctgggaccggatcacattactccatctctacaatcttctctttaagtaggctgctacctcctagatggctgcaatagcctctaacaggcttcccacatcctctttggatattctccagtccattctccatgttgcaacctgttttgtgaaaggcaaatctgagcatgccacactcccacttaaaatcctctgacaggctgggcgcggtgggtcacgcctgtaatcccagcactttgggaggcccaggcggacggatcacaaggtcaggagatcgagaccatcctggctaaaacggtgaaactccrtctctactaaaaatacaaaaaattagctgggcgtggtggcaggcgcatggagtcccagctactcgggaggctgaggcaggggaatggcatgaagctgggaggcggaggttgcagtgagccgagatcgccccactgcactccagcctggatgacagagcgagactccatctcaaaaataaaataaaataaaataaaataaataaaataaaataaaataaaataaaaaaataaaatatcctctgacaacttcccaggcttttatacttgagtccaaaatcctatggtgacctacaaggtctttgtgatctggctctatttatctactactccttccttctttattttgctatgctactckctcttcctgtgtgaggattttcacatactctcttacttttatctgcagtgcttgtttgcatgctctctctctttctctctctttctgtttctctctctctgcctggctaacctctttttgctgttctgcttaaatgtgactttttcaggaacaccttctctaacttccttgacttttgggccccatcctgtatgtttttatatcaaacaggaccactatgtttttttcaggacacttatcacaattttatctatatgattatttgtgtaattttagtatattatctgtctccactgatgtaagcttcatacaaatagagaaccaaatctcccttgtttattccttttatgtctgtagtactagcctagggcctggcatatattaagccttcaataacttccagctgaatctgcgaatgcatgtgctcagcccattgtctgtagcagcttggtagttttaagaggcttctcaagcttgcagaaacccttgtgggtatgactaagtgttccagcttctgtttcattgtgaagattttagaagtgtagcctttaagaggcatactacaatccttccaaaaacaaagaaagtctgaaaataaatttgggagaggatgtggaacaaagtaatttctacactaataggaaaaatgcaaattggtgtaacttctttggactgtgtccccaaacaaaagctgggtcatgtcaactggctgttattctgtcttcttggttattgggtgtttctttgtgggggtattccttctagtgggtcataacatatgccataaaaatccacattgtggccacttccatagacccatctgcagacaggcctttaytcagatcttcttgtcccagatctttcaatctttcttctttcaggtgcctgcccaattagccagggtattcttcactgtttattaatccttatatcttctaacagcaagtcacttcttgtccacacaaagaggatgatttagtatactgccttcgtccattgggaagattttcccctcttcgctgtctttcgaggccatccctaagggagggttgttatgcaacagcagtccatttttgggtcacaccgagatactgagctgattcatttatgagctagttttccctctttcagctggccattagggactcaacacagggctacaggtatcgtttgaagagaaatggatgatatgggtttgacagtcatgcaatttgcttgtgccccctggccctgcctttgtccaatcctggaagtatcatttccatcttatgatggagtactaccagacctgcctaatcatatgaattattgcatttgttagaactcagcttaatgtggttatttcttattgtagggtaacttgaggttctatggtcagatgctcagtctctactagggctcagtagtattccaagagctgctgtttgaatgttatatagttcctggctgaagatggcatgctttgttttagaatcctggggaactgcttatgttatgattctactatttctttctataaaatccacatggtgtcttttcaaaccacagaaaccccaagaaccaaaagttttgccgtatcatattgcataagtcatagggtcacttttatgacaacctgaacctgctggagagccctttggtgttttgagctccactcacagctggtaaatgtgtattgttgcctaacctatgtaaatgggtactgcttctgatcttcttactgatagggatggaaaagaatgcatttgccagataaatggctgcatactacatgtcatatattgtgttaatctgctgtaatgaagctatcatatctggcccagcaattgcaactgtggctactacttggttattatagaatgttgtagattttatttctttaataattaatggacattagagattttctaaatctttaatttctaaattagagattttctgaatctctctgagcccatattggtagttcatactttcctaggaatatgtctatttcacctaaggaatttagtaaatttctcttattacctttttaatatctgctacatctgtagttgtgtccctttttgattcataatattatttgtgccstctttctgtatttctcattcacttttgccagaggtatgccaattttattagtttttgcaaagaaccaatatttggctctgttgtttccttctagtctatctttgctttctgttttattaatttcttcctcttgtctttatcttctcaatttttatattattcctatttgctcttttcttaacttttctaagttgaaggttgtattagtcagggttctcttagagggacagaactaataagatacacacacacacacacacacacamaaaaaaaaactaataggatatatatatgtatatatacacatacaaaactaataggatatatatatatatatatacacacacwcacacagaactaataggagatatatatatatatgagtttattaagtattaacttacatgattacaaggtcccacaataggctgtctgcaaggggaggagaaaggagaccctgtccaagtcccaaaactgaagaacttgtagtccattgtttgagggcaggaagcatccagctcgagaaaaagatgtaggctgggagactaggcatgtctcacctttttcacgtttttctgcctgctttatatttgctggaagctcattagatagtgcccaccagattaagggtggatctgccttccccagcccactgactcaaatgttaatcacttttggcaacacccacacagacacactcaggattaatactttgtatccctcagtccaatcaagttgacactcattattaaccatcacagaggtttagcacattaatttttcaccctttcttgtttcttattataagtatttaaggctataaatcttcttttactttggatttaaaaattatgtatatttaagttgtaaatggctctaaatctgtctctatctgcatctcacaattcttgatttgtagttcttttgttatctttcagttgtatgtattttctattttttagtattttctaatttttattcttctatagcccatgagtaatttagaagtatgtttttgaattttctaatgtgtaattttgtttgatagttcgttttgctgctgattgttaatttaacttttttgtcagatattgcaatgtatgagatatagattctctgaaatttgtcaatatctattttatggcctgaaatgtggttaatttttataaaccgtgtgtgcttgaaaagaatgtgtattctcaagttgttggatgcattgtttcatagacacacattaaattaaccttgtgctgttcaaatttttatatcattattgatttgttgctgtttgacatatcagttagtgaggaggtatgttaaaatcttccatttatgtggatttgtccatttctctgtagtccagatattttttgccttatactttgaaatgtgttattaagtgcatatatatgtaaattgtttttttttccaggtagttattcatttttattttttatttttttattttttatttatttatttttattatactttaagttttagggtacatgtgcacaatgtgcaggttagttacatatgtatacatgtgccatgctggtgcactgcacccacaaacttgtcatctagcattaggtatatctcccaatgctatccctccccactccccccaacccacaacagtccccagagtgtgatgttccccttcctgtgtccatgtgttcttattgttcaattcccacctatgagtgagaatatgcagtgtttggttttttgttcttgtgatagtttactgagaatgatgatttccaatttcatccgtgtccctacaaaggacatgaactcaccattttttatggctgcatagtattccatggtgtatatgtgccacattttcttaatccagtctatcattgttggacatttgggttggttccaagtctttgctattgtgaataatgccgcaataaacataggtgtgcatgtgtctttatagcagcatgatttatagtcctttgggtatatacccagtaatgggatggctgggtcaaatggtatttctagttctagatccctgaggaatcgccacactgacttccacaatggttgaactagtctacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcctttgagaagtgtctgttcatgtcctttgcccactttttgatggggttgtttgtttttttcttgtaaatttgtttgagttcattgtagattctggatattagccctttgtcagatgagtaggtygtgaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatgtattaaatagggaatcctttccccattgcttgtttttctcaggtttgtcaaagatcagatagttgtagatatgtggcattatttctgagggctctgttctgttccattgatctatatctctgttttggtaccagtaccatgctgttttggttactgtagcctagtagtatagtttgaagtcaggtagtgtgatgcctccagctttgttcttttggctcaggattgacttgatgatgcgggctcttttttggttccatatgaactttaaagtagttttttccaattctgtgaagaaagtcattggtagcttcatggggatggcattgaatctataaattaccttgggcagtatggccattttcatgatattgattcttcctacccatgagcatggaatgttcttccatttgtttgtatcctcttttatttccttgagcagtggtttgtagttctccttgaagaggtccttcacatcccttgtaagttggattcctaggtattttattctttttaaagcaattgtgaatgggagttcactcatgatttggctctctgtttgtctgttgttggtgtataagaatgcttgtgatttttgtaccttgattttttatcctgagactttgctgaagttgcttatcagcttaaggaggttttgggctgagaagatggggttttctagatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttatgccagttttcaaagggaatgcttccagtttttgcccattcagtatgatattggctgtgggtttgtcatagatagctcttattattttgagatacgtcccatcaatacctaatttattgagagtttttagcatgaagggttgttgaattttgtcaaaggccttttatgcatctattgagataatcatgtggtttttgtctttggttctgtttatatgctggattacatttatagatttatgtatattgaaccagtcttgcatcccagggatgaagcccacttgatcatggtggataagctttttgaggtgctgctggattcggtttgctagtattttattgaggatttttgcatcaatgttcatcaaggatattggtctaaaattctcttttttggttgtgtctctgcccatctttggtatcaggatgatgtcaggatgatgctggcctcataaaatgagttaggaaggattccctctttttctattgattggaatagtttcagaaggaatggtaccagttcctccttgtacctctggtagaattcggctgtgaatccatctggtcctggactctttttcgttggtaagctattgattattgccacaatttcagctcctgttattggtctattcagagattcagcttcttcctggtttagtcttgggaaggtgtatgtgtcaaggaatttatacatttcttctagattttctagtttatttgcatagaggtgtttgtagtattctctgatggtagtttgcatttctgtgggatgggtggtgatatcccctttaacattttttattgcgtctgtttgattcttctctctttttttctttattagtcttgctagcggtctatcaattttgttgatcctttcaaaaaactagctcccggattcgttaattttttgaagggttttttgtgtctctatttccttcagttctgctctgattttagttatttcttgccttctgctagcttttgaatgtgtttgttgttgcttttctaattcttttaattgtgatgttagggtgtcaattttggatctttcctgctttctcttgtgggcgtttagtgctataaatttccctctacacactgctttggatgcgtcccagagattctggtatgttgtgtctttgttctcgttggtttcaaacaacatctttatttctgccttcatttcgttatgtacccagtagtcattcaggagcaggttgttcagttttcatgtagttgagcggttttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtctcattgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgttgaattgatccctttaccattaagtaatgtccttctttgtctcttttgatctttgttggtttaaagtctgttttattagagactaggattgcaacccctgcctttttttgttttccatttgcttggtagatctttctccatccttttattttgagcctatgtgtgtctctgtccatgagatgggtttcctgaatacagcacactgatgggtcttgactctttatccaatttgccagtctgtgtcttttaattggagcatttagtgcatttacatttaaagttaatattgttatgtgtgagtttgatcctgtcattatgatgttagctggttattttgctccttagttgatgcagtttcttcctagtctcgatggtctttacattttggcatgattttgcagtggctggtaccggttgttcctttccatatttagcacttccttcaggagctcttttagggcaggcctggtggtgacaaaatctctcagcatttgcttgtctgtaaagtattttatttctccttaacttatgaagcttagtttggctggatatgaaattctgggttgaaaattcttttctttaagaatgttgaatattggccctcactctcttctggcttgtagagtttctgccgagagatctgctgttagtctgatgggcttccctttgagggtaacccgacctttctctctggctgcccttaacattttttccttcatttcaactttggtgaatttgacaattatgtgtcttggtgttgctcttctcgaggagtatctttgtggtgttctctgtatttcctgattctgaatgttggcctgccttgctagattggggaagttctcctggataatatcctgcagagtgttttccaacttggttccattctcccggtcactttcaggcacaccaatcagacgtagatttggtcttttcacrtagtcccatatttcttggaggctttgctcgtttctttttattcttttttctctaaacttcccttctcgcttcatttcattcatttcatcttccatcgttgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccatagcttggagtaatttgatcatctgaagccttcttctctcagctcgtcaaagtcattctccatccagctttgttccgttgctggtgaggaactgcattcctttggaggaggagaggcactctgctttttagagtttccagtttttctgttctgttttttccccatctttgtggttttatctacttttggtctttgatgatggtgatgtacagatgggtttttggtgtggatgtcctttctgtttcttagttttctttctaacggacaggaccctcagctgcaggtctgttggaataccctgccatgtgaggtgtcagtgtgcccctgctggggggtgcctcccagttaggctgctcaggggtcaggggtcagggacccacttgcggaggcagtctgcccattctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcctggctcctttgtttacccaagcaagcctgggcaatggcgggcgcccctcccccagcctcactgccaccttgcagtttgatctcagactgctgtgctagcaatcagcaagactctgtgggtgtaggaccctctgagccaggtgcgggatataatctcctggttcgccgttttttaagccagtcggaaaagcgcagtattagggtgggagtgacccgattttccagatgccgtctgtcaccactttctttgactaggaaagggaactccctgaccccttgtgcttcccgagtgaggcaatgcctcgccctgcttctgctctcgcacagtgcgcgcacccactgacctgtgcccactgtctggcactccctaatgagatgaacccggtacctgagatggaaatgcagaaatcacctgtcttctgcgtcggtcatgctgggagctgtagaccggaggtgttcctattcggccatcttggctcctcctcctagttattccatatgtaaattgttatatcttcttgatgaattgagatttttatgtagtcatctttttttatcaataatccttttgccttgaagtctattttgtctcatactaataaaactgtaccagtttttaaattagtgttttcttgatttttctataaatttgacattaaatttttgttttattttaaatttttgtatgttaagctttagatggtgtctcttgcaataacttagagttgtattttctttttaatccagtctgacaatatttgtcttttaaccaggtaatctaggcagtttacattgatcatgattaatattatatttggattcatttctatcatcttataatggtttggactgaagtgttgatctggattgttgcacatcccttggttgaaagatgttacagccactgaatcacccaatcactgatccacatcctattattttgaactatccctatggcccccaatagcatagtgacttagggttaaatggcagtgtaaaaggatacaggaggctgggtgcagtggctcacgcctgtaatcccagcactttgggaagccaacgtgggtagatcacaaggtcaggagttcgagactagcctgaccaacatggtgaaatcccgtctctactaaaaatacaaaaattagctgggcatggtggctcatgcctgtaatcccagctactcaggaggctgagacaggagaatcacttgaacccaggaggtggaggttgccgtgagctgagatcacaccattgcactccagcctgggcgacagagcaagactccatctcaaaaaaaaaaatgtatacgggaactggagatggtaagtgggctgaagagcagtttcaggaaagaagttcatcatcatcctatatttaaaggactatgatatgtgtataaaagagggattaaaacatgagcagcaaatgacagaactagagcaaatgagtggaataataccttattccttgagcagctgttatgtgccaggaaaattgctaaatacttttcacatatagcttaattcatacaacaaaccactgagggaagggctcatcatccttatttcataggtgagaaaaatgaggctcagagagattaaagaagatacttgaagtcaaacaactagtaactggcagaattgggaatcatactcaattttgtatgactctaaaacccttgttctttttactgaattacatcacagagaggtgaactggtaaataccaaatgaaggaagaatactttttataattaaaattcataaaaaagtaatgaactatcatttgaaatggtaagcatccsatcactgggcatttctaaacagaggtaatgtggtcatgtgtcaggactgttatagtgagagttttactttgagtgggaagttgtactttagaacagacgcttggattagatggtcattaattatggtctatttcagtttccatgaggttattgaaactgtgccagagcttaacaaatgcatgattttcaaaactctccctaccttctgaaactagccgcaatgtgaacttgtcctttcttcacttagcctccttaactcactgcagtgttatgtgatgtgtacaggtggggactttaataaaaccctatttgatgatgacttgatgaaagtctatttggcctgtttagataggagaaaaacaagtcatgtgtataagtgcagtgtaaggttctttaatttgaaatactggagccaagcaatgcaaaagctgagagactccatttaatagcatgttaatatattaaaacccttaataataaattcatagcacttaaaatacawatatttctacaatgtaatattattttacagatggtatttagtaaatagccagtatttactgggaagtggggaattcattgtcctttgtgccttgctttgttgacacattctaccatgtgaaggccaagagcccgtaagaatagaaaaacctttctgtcagcagcagcctcatcaagctggtccctctgtagactctgctctgtccacttattttctttatccttactgctaatccatcaagtaaccatttcgccttcttttaaagcccagccacaagcattatttcttcccggagctttcattgacctgtgcctctccctgcactgtacctctcgaggtatccagtagtggcagttgaagtatatgaagaaggattttatacattatttacttttgttctgagtagttcttttaaaccttgtgaaagcaatttcacaagtgtttcctatagtattgctctgatgtggataggaaagacctcattatagcctttggacatgaagaaactgagacatcaggaggctgagaattgccaaatagtggtagagttttagcatctttcagctccacagctctactagccaaatgtgcgttccaaaatatttcccacaggtttctgactcttggattttaagtagtatgttatggctggtacctgggatttggtgtatttaaaatttgtttgggccagtcgcagtggctcacgcctgtaatcccagcactttgggaggctgaggcgggtggatcacctgaggttgggagttcgagaccagcctggccaacatgttgaaacsctgtctctactaaaaatacaaaaattagccaggcatggtggtgcacacctgtaattccagctactctggaggccaaggcaggagaatcgcttgaacccaggaggtggaggttgcagtgagcagagatcctctcactgcactccagcctgggtgacagagcgaatctttgtctcaaaaaaaaaaaaaaaaaacactgtttgactcattatttgaatgggccaagcaagggctgaccaatgcatagagagaagtatggttattgaatccctactagaatgtgaacaaattttgagaaaggcctaccattgaggtgagtgtgctgtaacctgagcacgtgagaccaaaaaaacacctgagaaaaatttttgctttcaaaattcatccatgtgactctatagattggatattctggtttcatccatttagccccaaactgacagagggttgtcttgggcagtcagagatgtgtagtgtaaagattattgggcactacttaggagccaaaggttctaattatggagcgtcttaagattagattcatcttttttactttcctggcctcagctctctcttatggcaagtgaggggtttgcaatgaggtcagtggttctcagaccatagcctttggagtacatggaccagaatcgccaggttatttgttaaaagttgagatgctggactccatctaggcctactgaattggaatctctggagtggcacttgtttatctgccttttgacaagctgaccaaatatgcacactaaagtttgagtacctctggatgatgtagattytaaggttccttccagctctatgatactttgaatgagaaagacaaagacagacagcaattacggatttcatttcaggtttctttactattctttaatgtcagagcctttagtgattttaaatttgccagaaatcacctaattagcatgtgatgacaatatactattttcattttttatgtctgcctcccccagcttattatcagcattgtttctatttcttttgtgcattactacagtaatcatcaatctcttcttattcacttccatcctttgtatcatcatcagagatttttggtgttgtttttgtccataaaacaacaaacacaaaaaatgtccctcacatgattaataagttgcttttttttctggcaataaaaacccttaatttctcagcatggcttactagacctttccaagtattatttatctttgtagttttatctcccaaatttttacccacatccagccaggaatcctttaattctcaaactagtttaggtagctgattacctagagtcatcttgtttctttctttcttattaaatatgaaatagctttatagttaacttcattgtacgatctggtacaattttattcatagaaaatattactatatgataacattttagaccgtaagcatttattaataataaaaaaaaaccaagcactggatttagtttggctctctctgagttttttacctaatatattttctatcttttttaactgtttgctacctctttctgttagaaaagtgaagaaaaataccaaagaaatatttttgtaagaataacttaaaattaagastattccacatatcaatttaaaaacaaaatttcaacagattgctacagattgcttttatatggtttaaataataaattactttgattccatttatggagcactggtgttttttgtgaacgctgttaggtaacaggacctgtgtccctgtggttctctttctggaatgcctttctgaagcttctcctcttaaagaattcctgctcatttttcaagacccagtagatttgtcaccaattgcaaagccttttctgaccctcatagaaataactatcaactctctcctctatattttccagatttcttggtatgttcatctctacttaaaaaactaatatctaacatcattataataataatgattattctgtttatctcctctcttcctctcttgcctctatgggtcctggcacaaagtttatgttccataattgatgttaaatgaatgtcttgttttgactaaratatttgttccttaagaaccttatccgtcttacctttattctgtaggaccaagaacacaagatcttatgtgtacccatttagcgatgacagactgaccaagtgatctggcttttctccacgctctgggaaatagtttaactctgtcaaagagcagtcaagaaaagttcatatattgagagtgatgtgatgatggctgtttgaaaagcttggaactacctttttagatcaaataggcttggttctgtctcaaatctggattagggccaatactttgataacccagtcagcaaagatcagaagtcaagaattcacaatctttcatcgtgctctgaaatcatttgtcaataaacaacaaagaccttctagggctggatattagagagggaagtagccgagagcttggaaggggagcttttctatcagctgaggactctggatgggaaaaaggcttagttcaggtctggtaaagaatttgagaataagcgaaattcaaggacacagtagtcaagaaagtgtttagtactgggtgttggctcggatgtgaggaaaaaggcactttacactgttagtgaggacagaagtagaaattggtacagcctttctggagtgcagttctgcaaggtgtattaaaaatgttaaaggtgtttatactttttttcccaccaattctacttctaagaatttttcctaatgacatactctaataagtataccaggatttttgtataaagaaatttatttagaacaactataaaggtcccaaaatagggaactgattaaacaaattgattaatctatacaaggtaatatcacacaggcattcaaataatgatgtagagatatatttatagaaaaggaaaggggtatatgatgtattatcagatttaagaatctatttatgaaataataggtagattatgattattttttgtaaaacagatatatacatgtatatatatattttatatatacacacacatatgctacacaatttatggaagttgtcaatgagagattttttttagtttaccttgatgttacaaattttctacagataatatataatactcaaattataaagaaataattttttcaaactatatttttcaaaatatttcaaaaatttcaaaaataattatttttcaaaataattttgaaaaagttatttcttatagaagggataattctttcagattggtattctccaggttgactgaatagtgcttggaacagagtacatgtgtgatatgtattagcaaatttaatgactgagtgaataggcaaatgactttactccaaacttggtagtgtaggttttattggtgagaattttctaaattttatccattcatcttccactggaactgcatctgtaggatagctgatttttgattcctgagatcttttctttttttttttttcctggttttcacttttttttttctctcttcaacttttattttaagttctgggttactagtgcaggatgtacagatttgttacgtaggtaaacatgtgccatggtggtttgctgcacagatcaacccatcacctaggtataaagctcagcatccattagcttttcttcctgatgctcttcctcccctgaaccgctctcccaataggccccaatatgtgttgtttcccccagtgtgtccatgtgctctcatcattcagctcccacttataagtgagaacatgtggtgtttggttttctgttcctggattagtttgctgaggataatggcttccagctccatccatgtccctgcacaggacatgatcttattcctttttatggttgcatagtattccattatgtatatgtaccacattttctttatccagtctatcctggatggtcatttgggttgattccatgtctttgctgttgtgaatagtgctgcaatgaacatatatgtgcatgtatctttataatggaatgatttatattcctttggttatatacccagtaatgggattgccggatcaaatggcatttctgcttctagatctttgaggaatttccacactgtcttccacaattgttgaactaatttacactcccaccaacagtgtaacagcattcctttttcttcacaaacttgccagcatcagttgtttcttgacttttcaatgaaccaccattctgattgcataagatggtatttcactgtggttttgatttgcatttctctaatgaccagtgatgaaaagctttttttaatatacttgttggttgcatgaatgtcttcttttgagaagtgtctgttcatgtcccttgcccactttttaatggggttgtttaattttttcttgtaaatttgtttaagttctttgtagattctagatattagacctctctcagattattagattgcaaacattttctcccattctgtaggttgtctgttcactctgatgatagtttcttttgctgtgcagaagctctttagtttaattagatcccatttgtcaagttttgcttttgttgcaattgcttttggtgttttcataattaaatctttgcccatgcctctgtcctgaatggtattgcctagattttgttctaggttttttatagttttgggttttacatttacatctttaatccatcttgagttaatttttgtataaggtataagtaaggggtccagtttcaattttctgcatatggctagccagttctcccagcaccatttattataaagagaatcctttccacattgtttgtttttgtcaggtttgttgaagatgagatgtttgtaggtgtgtggtcttatttttgagttctctattctgttccattctatgtgtctgttttttgtaccactaccatgctgttttggttactttagacttgtagtatagttttaaggtgggtagcatgatggctccaactttgttctttttgcttaggattgtcttgactattcagcctctttgttccatacaagctttaaaattttttgttctaattctgtgaagaatgtcggtagtttaatggaaatagcattgaatctttaaattagtttgggcagtatgaccattttgatgatattgattcctcctatccatgagcatggaatgtttctccatttgtttgtgtcctctctgatttatttgatcagtggtttgtaattctccttggaggggtccttcacttcccttgttagctgtattcctaggcattttattctttttgtaggaattgtgaatgggagttcattcatgatttggctctgcttgcctgttgttggtgtatagtaatgctagtgatttttgcatattgattttgtatcctgagcctttgctgaagtttcttatcagcttaagatgcttttgggctgagacgatggggttttctagatataagatcatgtcatctgcaaacaaagataatttgacttcctctcctcctatttcagtaatctttatttctttctcttgcctgattgccctggccagaacttccaacactatgttgaacaggagtggtgagagagggcatccttgtcttgtaccagttttcaaggggaatgctttcagcttttgcccactcagtgtgatattgcctgtrggtttgtcatatatggctctgattatatcatgatatgaggttacatcccttccttggtatgagtttgtgccccttcctgtgtctgagtgttgacgatatatttctgactggtcattagttgtttttgttcatttcattaagggttttgagagtcaggttccattaaccagtgtcattccaccattttattctgtgacttcttttggtgctattacatttaraaaattcttcctctctaaaatgtggtaaatatttacctacttagcttttaaaatatattttcatttaattctaaaatgtatttgaaattaatttttatatgatgtgaagtgagaccacaagttgatatttttcttttgaaatacataaccagttttacacaaaccgtttatagagtagtccattttttccatattggtttatgatgtatgttctgtcacatattaagttataatgtgtacaaggctctatttcaggcctgtttgttttgttgtgttaattcgtctgttgattcttataccaccattacactattttgtatgtgttataaaaggcagtttaatattgagtttgggtacatttccactgattttacttttttaaacagttgaactattttcacacacaatatttgccaaatgcaatgcttgacattatatcaaaaatataaattaattttggaataattaacatgttttattatgtagtctacctctccgggagcatattttatctttccatttgtttaagttttcttctatcttgcatccctcaaggttttacttaagaaatttatagtttgtaagtattatgtattgacctttccctcattacattttctaattattgttagtatatagaaaattgaatcttgaatatgtattttataattagtgattttcttgagtattattattgattttggttctttttgtatcttttagaaaagcaatcataccttctgcaaataattataacttctattctcttttgaaatagttgtatcttgtttcttttcttgcatgttagtatgatcttggacatccttaccttcctcctgattttaatgagagcagctttaataatttgcagctaagaggtaactggcctaaaagaaattaggaaatacacttagcttcctagtgaggcttaaaaatcagaaaaaaaaacagtgttgaattttatcaaatgatcttttgttctttttttaaaataattatgtcctcttatttgacctagtgatgcaatgtgttatattaatatatttctaatattaaacaatccttgcatttctgaggtaatccctacttgattatgctgggttattgttttaatatactttgacttaattttccagatttgttatttagaattttcacaactgtattcataaataaaacttgtttggaagaacatttcttgaaatgcattctaagaaggaatgttatgaggaagaaatggttccgtggtcaaatacacttgagaaaggcagattaaaacattttaacaaatttctttgctttaggtttctcagagactttaatatgctaatacatgctgtaatctctgagggagtgcttttcaagcacactcacaatagattccattcccccctcagaaagtgacactaatttccacagaaccctctttggaatattaatcattgtcatattttgttatgagggttatgtcaacgtcataaagtgagttaggatagcttttcctactttaacctaccctggaatggattatataatgcgggtctcataagtttcttgaaaacgtgaaaggcctaraaccagttttgcaaattatcccttaataacatttgctaaattttccatggctattcagctttcttataatattgaatcaatgttattaattcatatttctagaaaatggttcactttattgaaatttttaaatttgttaaaacgtgattgtgagtggaattctcttttaattcttaaaatatgtttcatttacctgttggtaaatacaatgaaatgaaatgatctgtgccaaatacttgaaacagtgcatggcacatggtaaatggtaaatgttttatttcctccccctttttcttattctgtwtctttctttttcaaaaaatttagatttgtcagaactttgttgatttaaaaactttgtttcccagataataacctcttctgcttatcttttaatctacttatctcttccatctatttatttgattgtttaaaaattcatcactgttcaccctagatttatattttattcttcctgcttttttatagtttttttctttcttttctagctagcttcttgaattgattgaataattcttttaaaacaaaattcttgattagtaatgaaaatattcaagtctatcaatttgatttaaaaatagttctgtattttgtggtcctttatgcacattgtacaaaactcaaagcatacaaaagggcttacagataatagtgaattttcttcattctcctgccttagtcttcttgttcctcaccaggaggtaaccacaattatgatgttcttgtgtttccttccagaggtattctaagtggatttggctattgagtacagctttgtcagaactatatatatttttatttaattattactttcattattttaaaatagaatttgctattaatttaaatttctcacttgatacaataattaggagggtcaaattaaaatacttattcataggacattttttgttattaatttctagttttgctgcattgtgattaaagaatgtagtctataatttctgctactttgaaagtcctgaggttaatcatgtgaacaattacaaggtcaaatcttataaatattttatgaaatattttaaaatttataatcttcaaagggcacaaagtatataattaattcaaaataatttttatttattgtggtttacttgatctattacagacagcaataaatttatttccttctcaaatcgaaattttgttgttttatttatccttataataacttaaaaatttgtatgccataatattttgcataaattatgattatgataaattatgatgctatgagaataaacacaagcataaaagcaaactctggcttgtaaattttattaaataaataagtcctgaaagtaacacctatgccaggatataaacattcaattagtgcagcaggatatcaaattagaagtaaaatttttgttcagactccccatttctaatctcacatttcagtcataattacttttgaatgctttgtatttcttctaatagttacctccataactctaaataatgtgtttagatctttcattcttaattagtaactatagactttatctattgattcttcgatatgaaagagtaaggctcaagttatttatactaccctaagctttccttttcaaattcttcccaattgtaatttttttcttagatgaataacttttgtaatttttaaaaatacttaagcttcaacttcttgattcatcaactttaaacattttttggactcttggttattttttgactcttggggaatgaatttcccaatttagcattctctatgtcttcctttctctactgtctgactcctgttagctatgttatcactttatgtggggaatgtttagagcattctgttctctaattctaattaaattttctatactttgtaggttaattctgaaagtcaaatactggtggaattttaatataatagttatataaatattcatttcatgtttgaggaatattgggtatgtagagaaagcaatgcaactcaacacctacgcccctttaaggagaattttctaaaggtcaagattaaatggattttctctttctattttaatatttcatccattattcagactattgtcatgatttaacttgtttcatatttggaccattcttgggaaatgttttgggtttaattgccttttttcttgaraaaagaaacacatatctttttaccatattgccaatatcttgcaattgtttaatgctttagtaagtatcactctatttctaggtctgtttcaaagctgtcaccctgatatttctctttattccacttctagattagtttcactatttcttagatyctgtgtactcccttttaagaacatttctttttcctccccttcaggacatttattcaagtgattttttttccataaagggtgcatgggaggtaaacttcctgggtccttgtttttctgaaaatgtatttatttttccctaatccttgactgatagttttggtaggtacagaattctagatttaaaatgatttccagctgagcgtggtgactcatggcgtaataccagcactttgggaggctgaggtggtagatcacttgagatcaggagtttgagaccagactggccaccatggtgaaaccccgtctgtgctagaaatacaaaaatacttagctgggcgtcgtggcgcatgcctctaatccaagctacttgggaggctgaggcacaagaatcacttgaacctgggaggcagaggttgcagtgagccgagatcacgccactgtactccagcatgggcaacagagcaagactccatctcaatgataataataataataataataataataataataataataataatttcttattagtaatttgaaggcattgcttctttgtctttcagcattgactgttcctaataaaaagcctgaggccaagtttattctctttactttctaggtaacctgaagtgctctatcacaaattatattttcttcagtttcattctgttcttcattattgtcaatatgcttttaaactcttgattttgttttgggtttccttatattttcatattttagccaattatttttttcagcttgttctctatttattgtgttctgaccttgtttcatagagatgatgaccttttacatatttatgaagacagcaaaactggtttaaattttcactgagaaaactctttttagaagtttctctttctttgaggttttagagagttatctattttttctgttgttgaagtatctttttttccataatcccattgttggctctttttctactttttcattcttgaattgtgtgagatttatccaggctttgtctttattaacaaaaataataggtgaattattttttgcttcacttgccgttcacacattttgcccagatttaaactaaaattttaatttgatggttttttcaaatgtctaacgggctttcatctgtcatggatttaggtgaattaatacaactcttgcattttttaaactgtaaggttacatgtaatttgaagttgtttgaatagtgtaaaacattaattagttttttctaaataactgtgcttccactcatgctgattattttgctaagttaagagatctgaggtcttttagcaaaagtaaaataagtagagctcatagaatgggaagactggtttgtgtaggagcccatgactgcagtaaagaaagttcccataagactgattgctgctcactatatttctcaccactgtagcccctgtcttctgaaacatggtgtaaactctatgggtaatcaacatcttttcttatatttttttgagaccagaatggaaggaagcacccattttatgtggttgtaaaaataaaatatgtgatgtatggtctaaaactacacctgccaacctattactgatgatacattaaatggaatttttatactcatagtaattctgatctttggctttctgtactttgccagtcaatgaaggtgtgtgcatgtgtgcatgtacatatgcgtgcatgattttttcataatgggagatgggggaggccctatcatacataatagcctgctgcctgctgccatgttaagaagtccaaccattagtctgttttgataagctaggcatctcaagtagccctattgatttttctttagttcttcttcttttttgttttctgttcatttttgtgtttttaatttatcctaggcagttgaattaaattgtcttccacttaattcatctcagcttccctcccagtctttttatgtccaaagtccttcaccagtcttcctattgcctccagattgtgagccaatttcttgaaggtggagccaagtctcactctttatatctccgtataatacatgtttcatacatacctactgataagctgatcagcttaatgatggggatagaagtgagctcctactcctgttttttccgtcaaaggtaaaccctggaaaaggacaaagttcgagtaatattttctacggagagcttggaactcagacgtcttctatggagttctcatcttcttgctcccttgccttttggtgagggaaagaatatgccacctgtcttgtctcctgggaccatgccaataagtgtgctgccccaggggctctgcaggatgggtttgttctcctgctcaccttgctccatccctgccctacctttcatctgctttcaggaggctcaaattgttttcttgtttccttctttccctttcccccaaacctccagtaaagaagagattttggtattaagaaaatgggctgttgaattccaaaatcagaaatagaccacataaatatgtatgaagcattaaaacccttcttcgaagtgtgatttcctggctaatggatgcttctgggatgattattatatatatttttgtactcaattaagccctattcagaccaacttatkttttggtgaacttaaggaccttatgattagcatccattagcatttccattacatctatattgtaataataccatctaaaatttctatgctgtatctctcacagagtgcttttatgccattattttatttgatactcccaacaacaccatgaagaatgttgagattctcttaacatttttgttttatagatgaggagactgaggtgcagaacatttaagcgacttgtccaaagtcatgcagtgagtaagggagtggaatgctgactaggagccatgtcctcagctagtatggcaagggcatgctccctatcactgctagtaatagcaaatgatcactaccactgagtatttgcatcatgccagctactatattargctctctgtatatattttctcatttaatactcctcataaccctgcaaagtaggaattgttattattccccccgttacatagaggggaactgcaatttagagaggttacgtaacttggtccaagtcacacagctagtcctagtatacctaggactatactgcagttggaacccaggtttccctgatttcaggcctcagccctagccacgtgggtccctcatggttttactggactgagctatgaagatattcaacatagcatagctcataaaggctgttccagttctcatgattccctgagctgtgattacgagctctccttgtgactcctatggctctggggcatattgccagaggtaaaattgggagctgtatggatcagaaaggcagagaaagtgaagggactaatatttactgaatgcttactatatgcccagtggccattaaaacccatatcacaggaaccttgtaagtctggtattatcatttccactttatggaggaggaaacacaggttcagagaggtaaagaaacgtatgcaagattgtaagtggaagagtcaggatttttagtcaggtctgtcagacyttatagcccatgttttctcctctatgcctaagtaggagtgggctcagtggtgatgttttaagggctaatgttgatgttttaagggctaatgagaaggagcagtatttctaaagggcttaaggaggattataaggaacagagatgaatttagaccctggtggttataatgcattataatcagtactctggagccctataaaggaactcataagagaacccaaagagaagaaaaactgtggcaagttttaggctacattgcctagcttatatcacaatgccagcagccttcaactgcaatacrtaggaactgggacttaaaaaccagcagaaacacattggtaaacatcataatgacacgcatatttaggaaaatgatgtttttaatttcaaaatctatgcagccttgccttatatagtcagtgctaggaagttgtggtgtaccaggaaatgatttacattttagccttaggcaaaaatatggaacttgtaattatgtcagagagaggcaaaaccttccagattttacagctttaaagctgtaaaagtctcagttaggatgtgtgttgattaaactgtggtgtggctgagcattttgcctgaaacttcatagggaataagcatctgttaatgactttcaggtaaaaaccttccttctaaacctttaatgcagtattgtcaaaatgtggaagtggtgggtgacaagcattttcttgttccttctaaggccttcctgatccaaggtagttttgagcacaaacggctgtgctggttaagcttttggcttgtgggaagaaagccgcacatcaactcctgatacgcacgagctagcctgaactctgtgatgaccatcagatgcagataaactgccagacagagaagctgtcttgtagatgtgactttgctgccttcaagagcagggctttctgcacctatgctctaagcgcccttagtgttcctctcccagtggtcctggattgatttctctaatggggagcctcctctgtagggtctacaaggtgactggtggattgattgccctactccacgtaatgtgagtaggcgattgtaaaggggaggctgaagagcttgcctgttttctttgttattcttcttactgagagaggtggactagagtggtagttcaaagatctggctctgcagtcacagatctgggtaccaatcaaggttctgtccctgattttctgtgtgaccttgagcacatcatttatcatctctaagcctctttctcatcttttaatgctttattcacaatacctggttcacaggattgttgtgggaattaaatgagataatgtgatattaagtccttaggacttttaaagttgacatagtattataactgttacctccgctaatagcgtcaaaccttgggtctaatcagggctcaktctctttactatttgtgtgaccttcctaaccattttgccattctgtctcccttctgaacatagcaaatataactagcttgctttggccttcaaattaatagaattcatcagccacagatctctgtgagccacttgctctgtaacagggaaggagtatgtgtgtctggcatgggagcttgccaagaatatttgctcaatagctatgctattataccatcacgtgctgctgtggctttataggaagtatatcctggatggttattacatatttagctggaatttagtttcctagggaaataaaagtttcatattttaagaatagacaattattttgaacaagtggtttatgtccacagaaagttcatgttcttatcttttatgtttgaatgaaggcactgtgtatgaggtgtccctgaacattggaagtctaaagagcatggatttggatgtcaaaactgggtccagattgaagttatgayatggaccacctgtgagagccttaatttcttcctgtgtgaatgtaaataatacctacctcatgggattaaaagagaaaataatataagaaagcatatatcatattatgtaacacatagtagcctctcaataaaagttactggttactattttgggcagatccaaacattatgttaataaatttcaatggctcccacattttattctttggggtggcacattctgtagagatatcttaggggctacagagggacagtgatggagggactaaggaaatagtatccaggctctctgccccacttcccaagaagctctgcttatgtctgttttatatctagggcatctgagattgttttacgggggagaaagaaggctttataagtgctttcagttcaatttattaatttttccctcaatgaaccgtagttttagtgttgtatctaagaaatctttgtatatcccaaggtcacaaaggttttcttctagaagtttttatgatttagagttttaaatttaggcgtatgatcaattttttagtccatttttgtttatggtaagaggtgtggtgtattagtttgctaggactgccataaagcatcacagattaagtggcttaaaaaatagaaatatattttttcacaattcttgaggctggaagtctgagatctaggtgtaagcagggttggtttcttctgaggcctctcttcttgccttatagatggccatcttctccttatgtcttcatgtggtctcttctctctgcctgtccctgtccaactttcctcttcttataaagacatcagccatattgggttaggacctacccaaatgaactcattttaacttaattacttctttaaagactatttccaaatgcagtcatattctgaggtactggaagtcaggactttaacatatgaatttggggggtacataactgagcttataattcatggatgaaagtgtttttttcccatatggatattcaattgtactagtgtggtttgctgcaaagaacctcctttttcactgaattgcctttgtacctttctcaagaaacagctgtccatataaatatgggttgatttctgcactccctgtttcgttccactgaactatttgtctatctttgctctaatatcatactgtctggattacttccattttataatatgttttagaattgacaaactggacttcctcaaaatgaaacatttctgctcttcaaaagacactgttaagggaatgaaaggacaagtcacagacagggagaatatatatatatacacatacacatctgcaaaaagtagagctgatatgggactactcatatccagaatatataaaaaactctaagatataaataataagaaggtaacctaataaaaaaggacaaaagatttgaacagatacttcaccaaaaaagatatgtgactagcaaataagcacatgaaaatatactcaacattattagtcattagagaaatgtaaaataaaaccacaatgagacaccaatacacacatattaggaatataaaaagactgaccatatcaagtgttggtgaacatacagaggaactagaactctcatatacttttggtgggaatgtaaactggtacaaccactttgaaaaacaacttggcagtttaaaaaagttaaacatacacttacatggtccagccattctattactagaaatgaaagcatatgcccatataaagagtacaaataaatgttttacttgttatagccctccttgttataggagttttacttgttatagccccaaactggaagcaacccaaatctccatcaataagtgattggataaatgaactgtgttatatctatattattcagcaataaaaaagaatgaactattagtgaatgctaccacatgagtgattgcaaaataaatatgctggatgatagaagccaggtataagacgcaaacatgctaaatgattccatttgtatcaaactctaaaacatgcaaactaatgtacaataacagaaaacagatcagtgccagtggtagaagggtaggaggaaaggaacaccaaggagcctgaagaaccttctgggagtgttccttataatacgttcattatcttaacatatattcattcagttaaggaacacatgttcattattttaactgtgataatggtcttatggatgtaaacatatgtcaaaacttattaaattatatatgttaaatatgtgcagtctattatatgttaattatatttcagtacagctgctaaaaaagtgataaaaaacatttgggccaaatatgaaaaacccaagactaaagtgaaaaattacaagactgttactgatcaatgttcaggcctattaaaatttcccctatcccaatggcacttgggcaactacttttcttgtatactttaggaagtawctaattcagacaggggactaagaagagactcttcacagtgcttgctgatagccccaaaatgcagcatgaaaccacccaaatgccaagacaaattgagaaaggttgacctttaaaatatgtagagttcagtacctttgaattaaattgcatgttcagctttggttctagttgctagaggctacttttttcaagtccacaattggctcccccaactgcgtttgaaattcagtaaaaccagcctttgcacctgcctttgttaaaatctgtacctaaattgtttggaacaagaaagaatagtaactagaagcagatttactgcagtctggacttagttgtttgggtgacctctttttgctggttttctgggttgattagactttgctaattgacagagtgtttggcgcaatagcccaggcagagccattctgctctggacttggatttggtacaagtattcctggtggtcaagtcatgtattttctagtttggaaacagacgttggaacaggactgctggagcaggtttgcaggattctatggtggagaaactataatgactttcaaaaacatgggccaaggtaatttggctgtcttttcattcccatctctaaaagaaagaacccaccaaagttcagagcatcttaaacattttgaagttgtgacagtgaatgtgaataattggtgtctgtgggactctaagggtagaaagcagggcttactagtgcttcttcttatttaacagagaagagcctggaaaaaaaaaaacctatagtcagacataaacatttcagccttatttattttcaaccagggaatagctaataccacgatgctgtaaagttcttgcatttaaatgtcctatttcacaggtccaaacccatgttccacatagtagtattataatagcaccatggagactatccagtaggatcctgaaagtcttcttacccactcttttccattttgctaagcacctggttaaattaaaattccaaacagtattattcagagacagcatggaacagcggattcttaattctggcccccccattcatcaagcacacataggccaggcaatgcatttagcactggagatactgaagtaagggattgcctctgccttcaatgaacctttggtctagagatggagactgagaaataaacaggaaattctaagcagagtgctgtgtacgatggagaaagtcctaaacagagtaatattgggacctgtaggaggccctcccactccaaaccatgagggtcaggcaaggcttcccaaaaggtaagagttacctcctcaaagaagcgggggaaattgtctcttactactctatgacaatgagcaaatcactcaaattctctgactctstcttttggaaraaataacatttactggttgcttttgaggattgaatcagatgagatatagaaaagcccttagcccagtgcttgmtaggggaaagatcaatattggttttcatctttcctttcttttttcctcccctcctacctccatcaggtggggagtgtgacttccggagcacactacacagaggagacttttggagggtttttagttgtcatctctgtcacttggtgtttatcttcctgcttctagttcattagggcctttttcttctgatgctggcttgggctgtgtttatgtctttcatgtgcttctgtgacacttcatcaggggaagtggctggccctctgagcaactgctggaggcgttgggaagatgggaatcaaatgcagcctctgtaggtgggtgtggaacagaacagcagtgtggccctgtgcatgtgtcaggggcaggcagcagccatcatctgtcctcatgtcctgcctgtggggtctgatgagaaaagaatgagttagtaatgaagtagagaggagagagagctgagtgctaagtggagaataaaatcatcttcaagtataactcaggtttactctggagctgtgtatcctgcaaatagtacagtattcccactcttggccaggcactaacagctgtggaagcaaatggtgtaactgcctttagggggcgttctgactggccagcaggcattactgatgcagggaagcaatgcagaaaactccacggcaagctgggcacactttgctctctgttgctctgtgtgtcctttggtttatttttctgtgtactctcccctcctaagaagactgtgctctttccaaacccaaatcaccttcttatgttgcaaatccacctaaccgtcagaattttttcctgcacagctgtcacaacaaacttcccctcatctgctactaaatgtatcagacactgttgtgcagtctgtgagctgccgactcattatccgagggctttccaatagaatctgatgttatccaaagcttctcatctgtttcaaagggaacaatttcctgcgttctctggagggaaatcaaacgcactacgtttaggaagtaggacggtccttcacagatttagtagatcgcaaggcaattatgggctgattattcccaacttagtgtttcctcacctcatttcccataacagcgactagagtgacctgaagatgggctttttgtctttccagtgagacatcgggaaataaatcacaaaaatcaagataagttgtggtacctttgatttccctctgtcctcttcccaagccgtttttggcactccctagaggaaaccagttctcctctcctcttttacttctgcagtgggcacttgggctccaagtatcttttttttttttttaagttcatcttcatcatcctttaaattaaacacctactcccctgataaatatgatgctctttttaacaattagtctttggatatagaagttgctgatgaggaaaaatccctttcagctggttacctatgcttttttttttttttttttttttttttgagacggactctcactccgttgcccaggctggagtgcaatggtgcgatatcagctcactgctgccgatgcttcccagattcaagcgattctcctgcctcagcttcccaagtagctgggattacaggcatgcgccaccatgctcggctaatttatggtatttttagtagagacagggtttcacatgttggccaggctggtctcgaacccctaacctcagatgatccacccacctcggccttccaaagtcctgggatttcaggtgtgagccaccgtgcccggccccatgcttctttatactagttctttcctcccttctcacctccagcctgggatgtrgtctccactatggtctttattccatactccaaatttgtctctttccaagtatcttcctaattcctttttttaaagttacctttttaatttcctgccgtgaaacatctgctgtatcatcttgcttccgccacttcctagaaaacttgttttatgaatgttctttctcctcagtataattttcctggctgtgccctgatgtagtgctacaatagttttattttacattgactgattaagcactttgaataattgttttagctccattatggcaaatctatttggcttaacacttttttttttttttgcaacctttgattaatgcctgaccattgggacagaaaggaattggcgcattaatttccccttgacgccacggagagctgctctttttcctgtgcaagagcctgaagcaacagatgctctgtgttcgtattgcaggggagagcacacactgttgcaaataagtatgtgtgtgttcccggtcagtgtttgctaatggtgctgtgtggcagccatttcatagcagagagcaaatgttaggatttagggaaaattgtaccagcatatcagattttaaaacggaatggtgaatttttgttgagttaacagtgtgtagctagacgatgttttctttctaagctcatgaaacttaacagctgtttagtgaagcagtattttcatatatgcctgtttgacaggtttaatagcaaattttgcagtaagtgacttgctgaacaggacttctggcttgggctgtaacaagaactgtatttgcagcaagattcattgagggtctttgtgctttagtgtttacgggaaggggaagcctggctaaagtgaggaaaactgaaaggcataatccaaaggaaattactaatatctctaccagagtattcctcagaacttgttattaactagtttagaggaagataacatggggaaaacatgctgtttagcaataaaaacacatgagtacaatcagcttactgtaacccattattgctgcatagtaattaaatctatatatctccaactttatagttttctgcagcagaatctctgaaagacttctgcacttcatctgattcaaggaagcctatattctctcccctgtctctggaaaggctactgtgccttgtaatagctttttaatattgccagatcgaagacaaatgcttcactggttttactgggagaaataaagcacttcctattacacttataggggggatccaagtcttgggaaactagcactttatgaggttagaatcccttttcctttcttcccatttttgagttctctcagatcgtaggacctcagaatcactcattcctagggctacccactttgtatttggctcctaagtgcatttttcaggatttatctgtgcttttattgattgcatgtgcttagttatacctgctgattgtgggtgtgtgcatgtatgacagaatcacagatcatagacccctgttctccagggcagccaccctcatggtcagcccagcatcctcagctaacaaaaggaccaagagctgtcttacatcctctttggatttccgcatagattttgcaagccgtaaatacaaaatttgtctagagttcatagttggttctgtttactggatttttttttttytttttttttttgagacagggtctggctctgttgcccatggtggaatgcagtggtgcaatattgactctgtgcagccttcgcctcctgggctcaaacaattctcacacctcagcctccagagtagtggggactacagacacgtgccaccatgcctgcctaatttttgcatttttgtggggggtgggtagagatggggtttcaccactgtttcttaagcagcatgtaagggagcttcatatttgtttgtctcagtcccatcatgatgtaggtcaaaagcaagttacattcagctagctgtatgacaaagatgcctccttttgaacagtaagaatttaggctttgttgttttatacactcaggcaacttgaaaaggataaaagaaaggtggagaaaagaatagtaaagtgagctcaattaattttctaagaaggcaawctaaaaacttctcacatgtaaacagtaagatgtcagggacacaaaatgagttagcccgtgttgctgggatgaggagggatagcagagaaatggccatatgatgtctgagagtgtggccagtgggaggagaggggtctactggtggacttctctcagcaggttgtcacctccacactttctcatccagagctcctgggattccctctaggaaggaatcattataccatttgccctgctcccatcatctcactaacctgctatcactgtagtaactccaagaaccagtgagacaagaaagagggatgtcatgagctgcctctgcacaactgttgaattcaattttctttcttcaagactccttcccccatgtttctctaatgcccacactttattcaggatgttgtgttcagtagcagagacatttgaaatgaagcttccttatcatggcttttaggaaaaataatggcaaaactattggatacaggtgaattctagtccaatatggtaggagaggtgagcctggaattgccctttttacatatcctgcagtctgattctaataaaagtagacacagttctggtacactactatgtggttatttccagaaatataaatgagtgttattttatatatatatattatatatatatawaatatataatatgtacatatatagtattgaaccgacagtaggtacttatgccttctaaaaatgtagtagtaagtgaacataggcaggcaatataggaggtgatacctgaattagttttgaaaggctctagcacagccaccaggcatacaattagggaggagaagtggatgtacattctataccgaagaatagttccctccttataacccaaagaacagtgctgaatacatcttacatgctttgtaaataggtactgtcttgagctgttgtaacaaagagaacatattggagaagaggaggctggaggcagggagatcagttaggagattattgtggtagttcaggttgaagcaatatatatatattatatatatataaatatatatatttatatattttaatgtttataaatatataaatatataaaacattatattttaatgtttaaacttttaaaaaatcagataggtaggacttcctttttcttttttaaataataactatggaagtgcagaaataatagagattctattgtgctctttacctggcttccccattggaacatctctacaactctagtagaatgtcaaaaccaggaaattgccattggtacaatctatagactttatttaggtttcaggagctgtttctaggtgggactttctaaggattgcaaaccccatggctttttctttttaagcaggtagaattgagggtgcagtggaagcaaaggctcatgtctggtctcttcctttctttctgtattgccctcctatcccccatcatgtgaaaaatagatactagaaaactcatatcaaaaagtacagtctggatgcttactttgcagggtagtatgttaggtgcccaggaggacatgaatgactataagaagaaatggttctgtaatttggaatcgtttgtttatacagaaagattcagctcaagacagtacctatttacaaagcatgtaagatgtattcagcactgttctttgggttataaagagggaactattattcggtgtagaatgtacatccacttctcctccctaattttatgcctggtggctgtgctagagcctttcaaaactaattcaggtatcacctcctatattgcctgcctatgttcacttactactacatttttagcaggcatgagtacctactaactgtcggttcaatactagatcccaggggttcaaacatggattctacacattctctacccacaatgagttcacagtttagtggaagagagagacatttaaggaggaaaatgcagtagagtgttatcagaggtataagtagaggtatgagtagggtatatcttgaatgctgtggggtttgaacaaaggaggaaaaaatgaatttctttagaagagagataactgttgtaacaaagagaacatattggagaagaggaggctggaggcagggagatcagttaggagattattgtggtagttcaggttgaagaaagataactgaaaccaaggtggagaggaagacctaggggaagggatgggtttgggggctacttaggagctaaatttaagagcacttactgattaactgactatagagttgaaaagagtgaggtgtccaaaatggtcccagatgatggggtggtggaagtgccatgcaccaagagggagagtctgggagaagatcagactctggaagaaaactcttgacggggtatggatgtattgagtttggggtgtctgtgggatgtccaaactgagagagctcactcagttatagatgagctcaaatgatatatggtgccttgatgtgaatgactttgccagttaaagtatgtagtaggacaagaagatcaaggagaagccttaggaatcactaaaatttaaaggacagatgggggaagggaccctgcaggagagattaagaaggagagcagagtgagaggaagaagagtgtttggaaaacgagaggcagtcaacaatataaaatgttttagatgtcagatatgatagaaattgaaatgttttcattggagttagggacaaaggacattcttattgacctgtgtgagttcaatttcagctggctggttgcaggagacagcaaaacagtagatcaagtagtgatttttaactatgaaacaattaagagtttggtataaggcaatttagttaagtgctaacatggagtgtaaagaaaagtgtaattgatattaattatttaagaaaatccataatagaatgttagagcagaaatgccaccccatttttaaatataaagagagatttcaagtaaattgttcaaggtcatgcatctaaagaggaacagccaggaccaggtcccaggtctgtttactccctttataaaagaaaattctggatagactagtttaaaggagcaaatgaatgtctgttgcaggaaaagtgattgttaaaatgatgaatcagagctgtatacttctattgtgaaatataactacttgtttgatgaatttattcatgtattctataaatattaatagatattgtgctatttgtttaatatgcaaagacaaataaacaattagttgtagagaacatgcttggtgaattttataaaagtaaaatattatcgccattaagtgatatagtctagcagggtgacagacacaaaaatggtatcatacaatgtgcaattgaaaaggcaggaaatagttttgcctaggagttggagactagtgagctgaatcttgcatcatgattgtgatttctccaaatggagaaaggattaaagggaactttcaacaaagggaacagtatgaacaaaatcagaccagtataaagaaagtctataacttcacagactgttaaacagcctggtggggatacgatataaaggtagggaaataacaaagaattattttgaagactagaaaagtattagtttgtttgtgctgctataacaaaatacctgagactgagtaatttacaaagaacagaaatttgttttctcacagttctgcagtctgggaagtttaagatcaaggcaccagcattcggtgtctgatgagggctgctttcagcctctaggatggcaccctgtggctgcatcctttggaggggatgaatcctacatcctcacacatggaagggacagaagagcaagagagtgcttccttcaacttctagcctttttataaggctgttaatcccaggcatgaggacaaagccctcatgacttaattatctcccaaaggccacacctcttaatactgttgcaggggattacatttcaacatgggccaggtatgatggctcagacctctaatcacagcactttgggaggccgaggtgggcagatcacctgaggtcaggagttcaagaccagccttgccaacatggtaaaatcccatctctactaaaaatagaaaaattagccgggcacagtggtgcatgcctgtaatcccagctactcaggagactgagacaggggaattgcttgaacccaggaggcagagattgcagtgacccaagactgtgccattgcactccagcctgggtgacagagcgagactcagtctcaaaaaaaaaaaaaaagtttcaacatgaattttggaggggacaccatctcaaaccatagcaaaattcataaccataatactgaacagtaaatagtggggaaacagatgttttaagccaaggtgtcctttgatctgggcttaagataaatctggtggcaatgtggaagatgagttggaaagggacctctgtttaaggcagtgagatgtgtgcagaaatgtgtcacatgagtgataatgaggttgtgagctagggaagtgatggtaagagtgaagaggagggaagttagtcaagaaagaatttgaaggcagaattacaggcagggtttggcaagtgttcacctgttcttcctgagggaaaaagaagaatccgaaaaaaccccacagtcatttctaacttattgactagggtggggaataaagggagagcaagtttggaaaggaagattctgagtttggtgttggatatttagaatttcaagtactttgggaaatctaggttaaccatacatgagatcctaaacacagcatagtcataggtcttgcttatggtgttaagtagtgtaaacaatatatttaattatggatccccaagaagcacttaaaagtagtttataagttggaaatgtattcagatacacggcacagaaaatctgactaagtggctaaaagaaatagagtttatttttctcatatacaggaaagttggtgatgctggtattggttcaactgctcagtgatggcaagaccagttctctgggacttgccatcatggttataaatagctgatgcagctctagaaacataaccactttcttgtcaggtgcttctgtttgggtctgtttgggtagaactgggtcacgaggcctcctctggctggaaggttggctggaagagcgggaagaaaattgttgaattcacttaaatacatactttcccatcctattagacacaattcctctyttttaaaaacaaataatttgtaatgccttctttattatcctgaaataaacatcatagacaatctgcttgtgtacatttttaaataaatatattatcctaactgtaatataaaggaacaattaaaggaaaataatttataattatttcaaaatgtgaattctaaggcatgactgcactagaagacataatgaagaagtcagattcttgcacggtgaatgtgacagcaacatatgcaagtgatacaagggtatggtaatggtgtttccagtaccacaggcagcatattcatttgtgttttacttaaaagatgaccaattttgggtcaagttctgcacaaaacacagcatagtcttctcttgatatacaagatagttgtttcttgaaagagtcaacttgcatgaaaactgtgcaacaacaattttgtattcgtatacacaatagagttacattcaaggccaaggtaataggtttttcacatttggaaagctatttggaatgtaggagagttcttagtacacagattgtcccccacatagctgtctgtctagtgtcyccggcctctgccaactagttaccagtagaatctccataccatggtgacaagtaaaagtgctccccycacatattcaaaatggcccctaggggcagcatcatccatattaaaaacaactggcttagattaatgggactggacactttgtactccaaacaaaatggaggttggttagcaaggaaaagggggaatggatattgaatagggaattaagtgtctaccaatagtaggaactgggttttccttatgtttgtatcttttcccaaattcttgcagaattccttgcatatagtgagttctcaataagctttcttgaatgactgaataaataactggaatgtaagctatgggaaatggaaacccagtattatatgagctttgaataaaggcaaaaatcttccttaagatacttaaagggctaactaccgtaaatccaggaatattgtcagaagttgggaagtgaactttggtgtgccagtgtctgtgctaggatttagcacttctggactttctgtctgttacacattctagactgaagactgagggttaaatttatatcagtgaatcctgttcaggaatggagggtttaggggaaatatttaagttttcatgtaagtagtatagaagaaaaagtaactgtcacaataaaagatcaataaatctcaggctttaaatcttagtctctctatcttttagcacattctctttccactgtgttcttttccacttctgtttgtctrttcgctctggcatttttatcatagcctgagacattttcgaatgataatttttaggagaaatatttagaaacagaatcaaagggctttgttttgtttcctcgaaatataaacctattattagaatataattcmcagtatgagaaatgtaggttttgcttgagtttgcttccagatttaagtagaaaagaaagaaaatgacattataaagaattttatctctttttttgtgaaaaagataatctgtaactatggattgtgaagacaatatatgaaaagcaaatctttttcaaacagtgctccaaagttgcctttgaatatataacttctgaattcaaaagcatgatacagcatgggtttttaaaaaaatagttgtttaacattttgaagggtataacatttgataactccatactttgaattcaagtgaaggaacaataacttcaaccttttgtttataagaataaggaacactaaaaaatgttgtgtagtttaagtttagacatttcaaatagtcctataattgcttgagagagcagtagagtttttttttcaattagtttattagtatttcagggattttaaatggaagaaaatcttgagtgtctttgtaaatgaattgcatcttttataggcacagatgtttttcgcagcattattttcatccccatggctgctttacaatatgtggcctatggagaaaatgacaagtaggtagatgatgagtaggggaaaatggtggaaggtacagcagcaataggaaggaagtattccccaaggtttgcctgaaaacatctactttgtgaagctccaacatttatggagcaaaatgccctagagtgctgcaacaggagacacaacttaccacccctcatacggaaggatgggagggagaaatggaaggggaaagggaaggagggagaattcctgtgatcttcactacccgctgtctccttagcacagagaattcatccattgccacatcagcacaaggacaacatatgaagttcctcaaaatttccaaataagccattacttattacctatacggttattccctaaaagtttcacactgaagtaaacaagtgtttttggtcatttcatgccaacaaactgatggcccttgatcatcatcctttgaactgactccaggtctagaatgaattttcctatgtatggtgaccctaagtctgtgtcttagaaaatatatatatatatatatatatatatatatatatatattttttttttttttttttttttttttttttttttctggactcactgcaaactctgcctccctggttcacaccattctcctgcctcagccttccgagtagctgggactacaggcgccctccaccacgcccagctaattttttgtatttttagtagagacagggtttcaccgtgttagccaggatggtctcgatatcctgactttgtgatccgcatgccttggactcccaaagtgctgggattacaggagtgagccaccgtgcccggccaggaaagaactttttaaggttgcccttgaataccggtcttgattaagttttattctgtctatatatttcattattttaattttataatacatttctatttcttgcttagaatttataaattatatatcagattatgatttctgtgttttaaaaatacctattatatcttatgctggttttcttaagtggaatgtgatatattaatatcttgttccatttttgttacttctccaaatatagacgattagtaatattctactatttattaatgaaaaactaccttagttggcctaatgtaactatctaaaaacaataataataaaattctgtagtgctgttagagagatatatgattatgcattccagccaggaattacatcagtaatttttagattatattccagggaaaaccaggttttgggtcaactaacacctatttattgttcacttatgttgaaggttctaggtgatttctcatatagctcattgttttgtgccttcaatcttagtaaatcttctaaagtgctaccgatatactcagggaaaactaactttgttaaaagaatatcttttaaattaacctacttttaaaaataagcattattatgtttgtggaatttgaaaatacagtctagttaaggtatttagaataacactcagtttctgtttcaaagtgattatatcattttagtatcaaaattaatttaattgaccatataaggagacattaagtattattataaaaatggcatgttatggcaaagtgtggtggctcacgcctgtaatcccagcactttgggaggctgatgggggtggatcacaaggtcaggagatcgagatcagcctggccaatatggtgaaaagctgtctctactgaaaatacaaaaattagctgagcatggtgacaggcacctgtaatctcagcttctcgggaggcataggcaggagaattgcttgaaaccagaaggtggagattgcagtgagctgagattgtgccattgcactccagcctgaacaagagtaaaactccatctccaaaaaaaaaaaaaaaaaggcatgttatttattaatacgagtgacatacatgcaaaaggatgtctgacttaggcaatgttattttctggacatattttttaaatagactgtgacctaagttctggtggtccctctagaaagggtaccattccctcttctctgcctgctgagccatttcctaagactgtcttcagatgttatgtcttctctagagcttttcagcattccttttattcttttttttgttctcatggtactctatgcatgagaatgtttgagtatatatatattattacagttatttgcctcttagactgcatttgggtattcctctttgagtttctatttcgtgtaaatgcatatrgtttcctataaaaaacacaatttataatcctccaggaagtctgtgtaagtcagtcagtcaaattacctggttgattatagtttcaggtttatctgctgcctgggaatcaaaacacaggtcttgattaactttctataaagcaaggatatggactagggatcactaagctctcttwtatctctacaatggtgtcattatatgattctaatccatcactagaaatgtattgtgaaatagttaattaatgtttgcagaatgcttagagaacttttaatgagaagtagatatttgtggttagtgctaatgaatagatgtcttatgaaccttttttttgcaccaacaacacattggaaaaatgtactttcaagaataaattgcaatctggtgaaatttttytattagttaacaaaatttagcttttaaaaacaagtatcagtatagtggctttagtggctttagaaaccaggaccctatgcatataaatagttgtaataaaaagggaagcagcaacagtgtatagttttcataatttttcaaaatagtwtaaatatgatagcaactttttactcttacagcttagttgtgaaggaggcaaggccagtactcttatactctgggaagctaagacctagagagattaaatgctcatttatttcttaaataaaaatgtattgagtgcctgtatttgagtataacaattgaaggtgcagtggtgaataatttaccctacttgactttgatagtaagggagacaggtttataaacaaacakattagctgatagcatagttaattatggtagaaacacagaagatggtgcaaataactctggggtgttgtttagtgagcctttacagaaaaggtagtttttaaagcattttcattaaactgtaagtggaggcatttgccagatgaaggggaggaggtgaggagaagggtctttcaataaaagagaatgaacatatgtaaagacccagagttatgaaagagcctgtgcgtttgaagaacagcgtgaagttcaatgcagctagagcaatattgtccaatataaatatgaacacaaatgtgcaatttaaatttttctaatagccatagtacagagtaaaaagagacaggtaaaatcaataataacacattttatttaacccaatttatctgaaatatttatttatttttcaacttaagtcattaaaatcaaatcaggtgaatattttacacttacaaaacatttcaatttgtcttccttccttcctttcttttcttttctttctttctttttctttacttttttttttttttttagggactggatcttgctatattgcccaggctggtcttcctgcctcagtctcccaaagtgctgggattacaggcatgagccactgccctcagcctaagacatctcagtttggactcaacacatttcaagggctcaatatatagaagcttagcaatgcatgtatatgtatgtgtgtgtcggagagagaaagagagtgagaatgaaaatctgtgtgctctagagggggaggaggttagataaggttgaagtagttgttggagtcatatttttaaaggctctgcatgctggcttattttagaattttttcttataatttagtagtttatgattgtgcttctcatattatctgtggtgaaggaacaattttgaaaattttgcatttgttatagactaatgctttcgcaaaataataataaattagaaaggtgaaagtaaaaagacatacaaagagaagcaccattttttaatcattaaagttgacaagatgttgtcttagtctattttgtgctgctataacggaataccatggactggatagtttataactaacagaaattaattggtttacaattctasagcctagaaagtccaagattgaggggccacatctggtgagggccttttagctgcatcaaaactttgcaaaaggcatcacatagtggaagggcaagagagggagagagaaaaagcaagagggggtaaactcactcccatgataaataacccattccctcaataaaggcatttgtccattcacgagggcaaatccatcatgatctaaacatctcttaaaggtcctaccttccaagaccattacaaaggcaattaaatttcaacatgaatttggagggacaaaagttaaacccatagtattcctcctgtcatgtttttcttacatacaaaacacatttatttcatcccaatagctccaaagtcttaattccttccagcaccaactcaaaagtccgaagtcttgtctaaatcagatatgggtgagacataacacaattcattctgaggcaaattcccctctagctgtgagcctgtgaaattatacaagttatctatttccacaatacaatggtgggacaggtataggatagacattcccattccaaaatggataaataggcaaggaaggggtaactggttccaagtaagtccaaaacccaatggggacaacaacagtaaatcttaagcctcagaaataattttctttgactccatgctgccctgcttcctggacacactggggaaggggttgagcccccaaggacttggagagccctgcacctatggctttgctggaacgttggagtcttatgcttacagctctcctgggctggctttgtgtgctggtatctacagttcaggagtctcaggtgtggttctgcccctgcagcttcactagacattgctttagtggggactgtttgtggcagctctgctcctgcagcagatttctacctggatccccaggctgtctgatacattctttaaaatctaggtgaaggtagccatgcctccacagcttgtgaactctgtgtgcctgcagaattggcaccgtgtggataccaccaggacttactgcttgtgcactcaggagcagaggccttagctgcacatgtgcctgctcaagctatggctggagcagcttaagggcactgcaccagaatgtggggaacagacatttgggtaggtgaggtgcagggcagttaattctgaggtcccctgggtgcctctttggaaactttgccctcaagattctagcttgcctcagagatccctgaagtgcctttgcggtcattttcttattgtcttgatgaatagcacctggctctttactagccatacaaacctttctagcaaatggttgtgtggccacatcttttgtttgcactcctaagcacacatttttattctttacatggccaggctgtgaattttcataatttttatgttctatttccccttaaattatraatactgtctttaaattatttctttcccctcacattctattatatacatttaaaagaagccacacagctccttcagtattttgcttagaaatttcttccatcagatattctagtttatcactcttaaattctgccttctgttaaagccctcaggcatggacacactttagccaagttttttgccacttaataacamggatagcctttactacagtttccaatacgttgttcttcatttccatctgagacctcatcagaattgcctgtactgtccatatttctgtcagcattctggtcatgaatctctaagaagaatcactcaagtaatctctaagaagttcccgactttctctctggctcatctgctcttctgagccctttccagaacttcccttaatactgcattcattgtaatctaggcttttcctaggctgctcttccaaattcttccggcctctccccgttacccaatttcaaagctgcgttcacatttttcgggtatttgttataacaacccacctctctggtaccaatttttgtcttagttgtgtgagtgtgtgtgtgtgtgtgtgtgtgtgctgctttaacagaataccacagacggagtaatttataaagaatgaaaatttattagctcgtggttctgcaggctaaacagtccaagaatgaggggccacatctggtgagggtcttcttgccacatcataacatggcagaaggcatcgcacagaagaagggcaaagaggggatgagagagatcaaaggagacacaaaccccttcctrcaataaacattagtttattcataaaggtggagccctcatgtcctgaatacattttgaaagtccaaccttataataccgtcacaagcgcaattacatttcaacatgagttttgaaggggacaaacattcaaacaatagcagacatatagtttataaaaaagtgtctaaaccagtgctatccaatagaactttctgtcatgataggaatgttctgtctgtgctgcttaatataatagccactagccacacgtatctattgagtacttgaaatgtggctagtgtgactgagaaaataaatctttagtttaatttaattttagttaatttaaattgaagtgaccatatgagacaattgattactatattggacagcattgaatacatttactcataatctctgtatttacctattgtgcattagtaaaaaacagtttgtggactggtatggcccacaaacccatgctttgagtagcactgtttaaagcatggactctagagctagaaagcctttgtgtatctttggcaaactgcttaatckcttggtgcctcagtttcctcatttgtaaaataaaggtaataataaactaccttatagagttgttgtgaggattaaatgcattaatgagtgtagcatacttagtacaaggtctgacacacagcatgcactatataaatgcttcctgttattgttattattatttattatgtaggtggtggatatcaaacagttaattggtaacaaagcccagtctttttattaattctctgctttttgcagtagcttagactttttccttttaaaaacataccacagtttgtggcatctagtggcttccaataaataccttttgaacataagcataaagtacttttcaagcacagatgaagaagcaattattgttctgaggtggggggggggttggtaaaattatcaaaaacagatgacagctgagaaggcctcaatggaggagtctgacaggcaaagaggagagaacacacctggtggagggagmaaggacacccatttggattatactctatttaggagactatacagcaggtaacactgacttagccctatcactgctaccaccacttctttctctccttcccagctcttttcttgatttatccttttagcatattttaaacaggattaataggtaacacgtgattctacagttttaagggaggtcaatcgttgcctctttacttgttcattcctcagagtaacagtgcctgaatttgatggtggatgttgggcagtggttgggaagggaaggggaatgctgcttgaaaagcaatccctgggttatgggcagatagctgtgagattcttttcccctaaaacataatgtttcttatttatgtagattatcttaacaagaaaaccaactggaaaaaaaaatgaaattccttatcttcgcatttttcggtggtgttcaccttttatccctgtgctctgggaaagctatatgcaagaatggcatctctaagaggacttttgaagaartaaaagaagaaatagccagctgtggagatgttgctaaagcaatcatcaacctagctgtttatggtaaagcccagaacagatcctatgagcgattggcacttctggttgatactgttggacccagactgagtggctccaagaacctagaaaaagccatccaaattatgtaccaaaacctgcagcaagatgggctggagaaagttcacctggagccagtgagaatmccccactgggagaggggagaagaatcagctgtgatgctggagccaagaattcataagatagccatcctgggtcttggcagcarcattgggactcctccagaaggtattgtttgtcttttcagtttgatttgtattttataaaactaatgtcccttggtgtaattgagtacaatatgcatgattcatattataatttggataatttcctattccattggcttaatgagttctctaccctttttygtcctcccattttttacttctgtttcttttgtgaaagggaactgatcatgttggatcgctttttaaatgtagaatctgtagctactggtccatgatacttaccagccctatcactttgtaattgctatctagttaaacattagcatggttctatagataattgaaatatacataaacaggatacaaaaacgatgacttcttccaagtggcctcagtgtgaataattttttagaattaatgaaatagagaatagaactttgcactctgaattgatttaattatttttatagaactgaggcttctcctgcaaggaattatccaaggttgagttctacctttacttataagcaccctggatcagctttatcagataatatacagtaaatgcccagatcagggatgtatagccagtcatcagggagctatcagttagccttgaatatatccatgggctaatttccggtggcagaagaacgagtttctattcttttgacttttttgaatgccaagagaaaggcctagtgaagtacattgtcagtttaaaacattatttattgagatataattcacatactatgatgttcatgcatttagaatgtacaagcgatttttaatatattcacagagttgtgcagccaccacaatctaattatagaacatcttcatcaccacaaaaagaaactctgtgactattagctgtcattctccagtctacctatatcccagccctaggaaaccactaatctgctttctgtctttatggatttgcttattctgggcattttacatgaatggaataataaattatgtgatctttcatgaattctttttttcatgtagcatactgttttccaggttcatctatgttgtcacatgtttcagtatttcattctttttattgctcaataatattccattttatggatgtaccacatttttatttatccatgcatcagttgatggacattgagattgttttcaccttttagatattatgaatagtgctgctatgaacattcatgcacaagtttttcatgtgaacatttgttttcatttctcttgggcatataccaagaagtagaattgctgggtcatataccagctctatgtttaactttatgaggtattgccaaactgttttctgaagtggctgcacagttttatgtacccactgacaatgtattataatttttccatatgcttgccaacacttgttattatctgtcttcttggttatagctattctagtgggtgtggagtggtatctcattgtggttttgatttgcatttccctaatgacaagtgatgttgagcatccttccatgttcttactcgccatttgtttatcttctttggagaaatgtgtatccaaattcattgcccagtttttaatcggactatgagatttttattatagagttttaaaagcttttttaatgtattgtatatacaagtcccttttcatatatttgatttactaatgttctctcccattctgaggactgtcttttctttttttttgatggcaatatttgctacagaaatatttaatttttgattagtccaactaatttattttatttcttttgttgcctgtgcttttggtatcatatcaaaccattgcctacaccatggtcacaaacatttactactactactgtaatgtatctaggtatgtatatctttactctcatctcatattttcttctaagaattttatggctgccattcttacatttatatctgtgaattaattgtgttaatttttgtatatggtataagataaggcttcagctttcttcttttgaatgtggtcattcagttgtctcagcttcatttgttgaaaagactattctttctcctttaattcggtgcattacattaattgattttcaaatgttaaacaaaccttgcattactgggataaaccccacttgattacaatacataatcttttttatatggtgctgaattcagtttggtggtattttgcttaatattttgcatttacatccatagggatattggcttgtagtttcattttcttataatgtcttttttttttttttttttttttttttttttgtatcagagtaagactggcctcatgaaatcagtggcaaagtgtcacctcaccttccattctttggaagagattacaactgactgctattaattctttaaatttctggtagaattcaccagtgaagcaatctcattcacgcttttctttgtgggaagatttttaattattaattcagtttctttacttgtctaatcagattttcagtttcttcttgagtcagttttagtagtttgtgtcttttgagaaatgtatctgttttatctaagtcatgtaatttgttggtatacagttatttatagtatcttattataatttttttatgtttgtaaggatggggtctaaatcactgctgtcacttgcttttgggcagaacaactgtttagatttttctagcaacaaattctctgagcctttattcatctttatctctttgcttaaccttcagttttgaaagatagttttactagacatgagattcttagttgaggggtttgtttttcttttctttttttcttttctttctttcttttttttttattttcagcactttgaatacattatcgatcccattgccttctggactccattgtttctttttctttcttccttttttttttttgagatggagtttcactcttgttgcctaggctggagtgcaatggcacaatctcagctcactgcaacctccatttccccagttcaagtgattctcctgcctcagcctcccaagtagctgggattacaggtgcacaccaccatgcccagctaattttttgtatttttagtagagatgcagtttcaccattttggacaggcttgtctcaaactcctggattcaggtgatccacctgcctaggcttcccaaagtgatgggattacaggcttgagccaccatgcccggcctggactccattgttttgatgagatgtcagctgttacagttttggaggtttccttgtatgtgctgagtcatgtcttctttattgctttcaaggttttctttttcttttgatttttattattttgactctaatgtatctaggtatatatatctttattctcatcttacttggaggttgttgattttcttgcatgtgtagattgaagtttttcatcaaatttgagaagttttcagctatcattttcacaaattctttttcttcctttttttctttttcctctccttctggtacttccatttacagtgtgttggtgatttaatgatgtcccatatttctcttatgctctgctcatttttctttattctttattttctttgttcttcagattgtatgacctctatcaatctgtcatcaagcttactgattctttcttctattagcttaaagctactattgagcctctatactgaatttgtctttttagttactatacatttaaactccagaacttctctttggtctttttaaaaaataatttctgtgtctttattgatattttttatttgatgagatgttgtcatcatatctgcctttagttctttaagtatggtttcttttagttccttgaatatttcaataatagcttctttgaagtgtttgctatatcctacatctgggccccctaaaagacagtttctactgcctacttcttttttttcatgtgtatgggttgtactttattgtatctttttatgccatagttttaaaaacagaaaacctgaatatttaaaataataatttaaaataatattttatggcaactctggatgctgacttgtcttcctccctttcccccatccatttacctggtcattcatttgtttaatcgcttgactgtactaactctgtgatgtctatttctcctacactgttcagcttctgatgttcctgtttagattgtttttctgttttattttttgtttttcttttggctgggttccctatgagtcacccgtaggtctgcataagccacttattggtcaaaggttatgcttaggttcctttagacagttatatttttactctttgccatttgatgtttttatggcttggagtctgttattacaacttaagaagtttgttttttcccccaactttggccaaggccaaatgccttggaagttccttttctaatcacttctgagagggtgcggccttgagcatgcacacagccttccagattaccagaatgcaaataattttatttttaagcgtggcttaatagtattttctccagggtcagaatagcttattttttagccagtgtttgctcagaggttgtccttaaacaccttgagtgagtgagatttctgccctttgttgacggatctgtgtgcagcttgggaaatgttttcaagtctgacccatgtgttgttttgattgttcctgagtaggtatgacctaggacatgtgtgtagcttttcaacccccagggtttactgggatcccaggaaggcccttcttggttgtttctttccttggttctttctgttaaagctatggttgttctgccattttgcttgttgctagcagtatcgtgaagctaccagcacccccttaattgttcttcaccaagctctccattattttcagcaacacccttaagtagggaattctccgttctctgcactaaatgaagtcactaacatcaataagaactatggagctcttcatccttatggcttctctcttcccccaggagaacattcgtgctactgcaagggagctagatgcagtgatagtggcacctcccagtgtcacccagaatgatatccctagtggatgataagaagggaggaggtagttctcagccttgttggcttgcagcttccagtrtgggaccacctcctatgagtgagctgagaaaggggtgatcagagtcttagtattcttgatggctacttagggtagagtttccaccctatgagtaggacttgggtagaggaatggcacctcagttctcttggcattgcttgactagaacagaggttctaccacaaggtaatggggttggggaatgagaaacactggtagtctgtccttccaaaggtgaaactgtagccctaaactgagaattgggtggagagaaagctcttacgttcttgtctgcacttggtcagaatacggtacctgtagtagagtttctgtaacatggggctgggggtgggagaggaaagcagatcatgacccagatgccacagactcttactgttctcatcaagacttggtaaattttcttggatgaatgttgtcctttgctgtatgcccttaggggagttttgagagacattaaattattttttawataatttttcccactaaatattttgtggggtgaagatctgctgagttactcatgctgccatgctggaagaatcactgggatagccagttttgatctctctaaggctgcatgaataggtggtagaattctccaaggtattagggagctccttagcttgggttctatagtgttagtcagttttcttcagttgccttctgttaaatgctaatctatgttagacaccaacttaaatcctcctttttaagctctctcaattgtccagttatctgaaaaggattagcactttttttcccagatgagagaaccagactccaagaggttatgtaatttaccaagggttgcacaactggtaagaggccttgtttgggcatgaacaactgtcaaactccagagtttgtgcttttagtcattagactatattgcctcacatacaaatattttaatgttgtttcatttataagattactatttttagccatctagctgaagcagatctgtttcaaaagccgttgatacctgtactgtgacagcagaatatattggtttttgtgtgtttttttaaagaaagttttcttattcccatttctttctcattgtcatttctgattctacaactgggcctcctctttcctggctacctgcctggtattgaaaactaagccaagttactgattgctcctgagaccttcaaaacccagaggatatgaattttactcaccggaatctattctgttttccaagactcactttcaccccactcctcgttccatggggctcaaagtagataaacagttgtctggcaactggactattttaagctctgaagagactggagagttaggctggaccaggtgtggaaaagtcccacaggagacagtgtaaagttggcgtaacaggatctctaatccaggcagagtggtgcagagcttatcttctagcctctctctcaggaaacctgtcttctcactttggcttaccactaactagttgtgtgaccttggttgccatttaatcatcatggccttgatttcgtgacctgtgaaatgagagatggttggaatgttgaatctgtaaggtctcctctagattggaaagggtaatttttatgagactccataagggatcactgaagctagaatttacaggagctggattctgccaactatatgtgatggagtagattctttgtttaaccagattttttaactttttaattctagacttgaatattacagtatgtatgttagtttatgcactcttctcaacttcagtattacagtaggtatgttagtttattcacatggcaggattgagagctctgcaagttatctgtggagagtttgaagaaggcagrtatacaagcaggccaagtccgaagagatgaaggacaaacttacaagacaggagaaagcacaatctccaatcagtcctgagataacatagcatacatcagatttgaatggaccaagtaaaagaatgagaatcaacagtcacatctgggacaggctgacatatgttcaagaaagaggaacttgggcagactatgcggttctttcccagcagacataactctgggtcttcatggtttatggtctctgagcccaacacagcaggtcattgagtatttattaatcctcattggagactgacatctctaccgaaatacagggctttcttaaaattttaggattgtatgtttttattatgtttggtgtatgttttattatgtttgtatgccatattatgttatgttttattgtatgttttatattagttagggggctcctggcggcctggactgagtcttatccatttctatattctcaacatctagcatcatactcagtaaatagttactcatttagtttactcatttatttgagaaacagtggatttttaaggtagttctttccttggggtattattcacttgtactaaaataaggccttcttctacattgtattagtctgttctcatgctgctatgaagtaatactaagacaggataatttatagacgaaagaggtttaattgaatcacagttccacatggctggggaggcctcaggaaagttacaatcatggcggaaggcactccttcacagggcggaaggagagaatgagtggcaagcgaaggggaaagatggttatacaaccatcagatcttgtgagaattcactcactatcacaagaacagcatgggggttactgccccccatgattcagttacatcccactgagtccctcaataagatttgggtgggacacagccaagccatatacataatgaatgatgatactgttgagccatcatcatttactcagaatttccctgattataaaattaatacttgcttattatagaaagcatgtacataaatataaaaataataaaaatcacctgtattggtccattttcacgctgcttataaagacatacccaagactgggcaatttacaaaagaaagaggtttattagacttacagttccacgtggcttgaraggcctcacaatcgtggcagaaagtgaaaggcatatctcacatggtggcagacaagagaagagagcttgtgcagggaactcccctttttaaaaccatgagatcttgtgagacttattcactatcatgagaacagcatgggaaggacctgcccccatgattcaattacctcccactgggtccttcccacaacatgtggaaattcaagatcagagttgggttgggacatagtcaaactatatcattctgacttggcccctccaaaatctatgtcctcacatttcaaaaccaatcatgctttcccaacagtttgccaaaatcttaactcatttcagcattaactcaaaagtccacagtccaaagtctcatccgagacaaggcaagtcctgtccacttataagcctgcaaaatcaaaagcaagctagttacttcctagatacaatgggggtacaggcattgggtaaatacagccattccttgtgggagaaattggccaaaacaaaggggctacaggtcccatgcaagtccaaaatccagcagggcagccaaatcttaaagcttcaaaatgatctcctttaactccatgtctcacatctaggtcatgccaatgcaaaatgtgggttgccacggtcttgggcagctccatccttccaggctgctttcatgggctggtcttgagtgtctgcagtttttccaggtgcacggtgcaagctgttggtggatctatcattctggggtcttgaggacagtggccctcttctcacagctccactacgtggtgccacagtagggactctgtgtgggggctctgatcctacttttcccttctgcactgccctaggggaggttctccatgagagcaatgcccctacagcaaacttctrcctggacatccagatgtttccatacatcctctgaaatctaggtggaggttcccaaaccccaattcttgactcctgtgcactggcaggctcaacatcatgtggaagatgccaaggcgtgaggcttgtgccctctgaagccgtggttcagattctacattggcccctttcagccacaactagagcgactggaacgcaggtcaccaattccctagatggcacacagtatgaggatcctgggcccagcccatgaaaccactttttcctcctaggccttcaggcctgtaatgggaggagctgcctgaagacctctgacatgccctggagacattttccccattgtcttggggattaacattcagctcctcattatttatgcaaatttcttcagccagcttggatttctcctcagaaaatgggattctctttactatcacattgtcaggctgcaaattttccgaacttttatgctctgcttcccttataaaactgaatgcctttaacagcacccaagtcacatcttgaatgctttgctgcttagaaatttcttctgccagataccctaaatcatctctctcaagttcaaagttccacaaattgctagggtgggggtaaaatgccaccactctctttgctaaaacacagcaagaatcacctttgctccatttcccaacaagttcctcatctccatctgagaacacctcagcctgcacttcattgtccatattattatgagcattttggtcaaagccatttcaacaagtctccagggagttccacactttcccacattttcctgtcttcttctgagcccttcatactattccaacctctgcctgttacccagttccaaagttgcttccacatttttgggtatcttttcagcagcgccccagtctactggtaccaatttactgtattagtccatttttgtgcttctgatgaagacatacccaaaactgggcaatttacaaaagaaagagatttactagacttacagttccacatggctggggaagtctcacaatcatggtggaaggtgaaaggcatttctcacacggtggcagacaagagaagagaacttgtgcaggaaattcccccttttaaaacgatgagatcttgtgagactttttcactaccaccagaagagcacaggaagccctgcccccatgattcaattacctctcaccagatccctcccacaacacatggaaattcaagatgaaatttgggtggggacacagccaaaccatataatcacctatgatattttcctctagagagtcattgctatcatttctatttttccttttgatatttctatatgcatatgtattttattttataaacttgtgttcacactgcatatagtttgtgtccttttatcttatatatcatgaacatttaccacatactagtaaatatctttttaaataagttttaatggctaccaaatttaaatatgcaataattaatataatgccttgttattggaaactagattattttcttatttttttctcttcttttaaatagcatgggtataaaatcttttaatgtagaaagaagtatagacttttaaaggaaattttatgtttttaataaatgacatataaaggaggaatcattggtatattctaggaagttgtaggagagtagaaacaattagttttgaaactgcttgtatagatgtaaaaaatgccaataaagttcttagaagctgttttattttttagtggttttagttgtttaaaaatgttaacacaatagatatgtaaacattatatataatgtacattttaatgatacaacgtaaatatatattttaattactttaaattattaatgtacatattgatacatttatattcttgatatattttgttaaattgttttccagattgtacacacctattctcttattagcagtgtatcttcaaaaccctgcaccttcacctgcatgggtattttttcctaatctttgccaatttgatgaaccaaaagtgatatttccctattattttactttgcatacctttgcttattgttcaagttaatattttcatatgtttactggaagcatatttttcttctttaaattatttgagcatatctcttgcctatttttctactggtgctttaatgatattctaattgatgaataataattcattattaatgaattattttaataaatcaattgtaattgattgtcctattttattcaaattgagtgttttaaaagatattaagatggtttgcattgatatatcaccttctttttcattttttcttaaaagcatatttctttctgtattttgaggatgacttagaatgtagttaatagactgcaaaatagcaaagttgactaatttccactccctctcccctatcaaagtgctctaaggaacagttctttaggttagcttacacatactttggaacatcagtgtcattattcgaagattggtgaatgccatgcttttgaatatgtaccagcaaacttaaggtctcagtgtagctagacttggatttttgagctgtgtatatggattggtacttctgctggtttatgtcaaactgtgtgtaccttatgacttttccttttgggaataatataggagtgagaggaaggacaggtaaagagcactagattgagctcaatgtgcagagttgactggatagttaatgttgagctgtggagattagcatctcctctaactggtttaaccagctatgaatatcttacaggattttaaatggtttacagaatcactgggtaagctaatgatgcagattttaaattgagcttctcaggaatgaatttgagaataattctgtagaaccaggctaccatgattcctgttgcctttcctagattaagcaatggcctttgtcagaaaactgccacagaaaatctagagattttcacaatggtgcttgtctctgaaacagcagaaaacagtctctgtctaattcctgctttccagatcttgttcaagtgcaaaaaattggtgacacttaaattacttctagaaccctaactgtagaaaatcccaggaatgtagttcttaggtgttcagtctttgtgactcagaaaagcacatttgaaggaccttgaatggatgttgaatgccaactctccatatctaacacaatactcctttcattatgtcccttaatcaacaatatgatatggacttttttgcataaataaacaagaacagattgccattggttatatagtacaagtaacactaccaatarcattgtggtcctctgtggttataggattagaatgaatttaataggacaaaaaggaatatagagcataatcatgaaaggaggtatctccaagggcattctgatggattgaagggaaattgctttaggctgtttgtcacatttgccatataagttaaagtaggtttggctgggtgcggtggctcacgcttttaatctcagtgctttgggaggccgaggcagatggatcacctgaggttaggagtttgagaccagcccgagcaacgtagtgaaactccctcactactaaaaactacaaaaattgccaggtgcggtggctcacacctgtaatcccagcactttgggaggccgaggcaggtggatcacgaggtcaggagatcaagaccatcctggctagtgtggtgaaacccagtctctactaaaaatacaaaaaattagccaggcgttgtggcaggtgcctgtagtcccagctactcaggaggctaaggcaggagaattgcttgaacctgggaggtggagtttgcagtgagcctagattgtgccactgcactccagcctgggcggcagagcaagactccatctcaaaaaaaaaaaaagttaaagtaggttctccttcattttttataccctttccctttatctgttttgtatgcttctctttcctaggccatatatatatatatttctggtcttactctgttgcccaggctggagtgcagcagcacaatcatggttcactgcagcctgagcctcccaggctcaagcagtcctcccatctccatctctcaagtacctgggcccacaggtgcatgccaccacacctggctaatttttcgattttttttaataaagatgaggtcttactatgttgcccaggctggtcttgaactcgaactcccagctcaagtgatcttcctgacttggcctctcaaagtgctgggattacaagcataagccaccatgcccagcccctagacctcatcttaaagactggcatttcaaaggtttctatcttttgtttataaacattctccttaagtgatatgatgcagttccatggccgtaagtaccaccttgtgcttcagccacatggggtctatttgcctttccctcaacatgtgagtaccccttgccttaaaagctgcttcttggacctctgtctaacctaaccctaaccctgaccttaacccaactcaacccctctctgcttggagaatttatactagtttttaaagactcatttttttctttgaagtctttctggaaccccaacctaaataaatttaattgttctttcatctctacttttgtagcactgtctgttttatacaatggtcagattttattgtagttgagtgttcacatggttatctcctctgaaaaactgaccttctccatggtaaaagccacaccttatttatctttccatctcctgtagcactaggcccagggcctggtatgtcatagatacatattagatatctgcatgttaaatcatgagtggattgtgaaaggtcacaaatttaaaaaggatatttgaaaactcattcatactaaaacaagcttcattttagcactgtgtgattctcataggtcttttgtgtccatgtcatatccaaataacaagaaattttggttggcatctcagtgaaagcagatgagaaagagaaggataaataaacatcaatcaaatggtgattaggttgttcaccatggcctattctttctggaaacttaagcagcacagataaagtctgggaagctacagcctaaacttatttccaaactcttgtctcataggaacctaaaatagccttcctgcatacttcaagcacatctagcaaaagaaggctttctatagccaataagttcagtccatttgttagtgagatgctaatttacctgcaaagtcccatcatcagataagtaattatttgcacatgacctcatctcctcttttgatctcatcaaggaaacagcattttcagtattttttttttagggcttaatctttgtctgatatctaattgcagaatgagcagaagtgctctagacagcctgtatccacagatgatactttaaaattggcggtatgggatcagttgacggatctgactacaaagtgtcagaggttgcaaattccttctctctgtatcaaattagggatggaaatgaggaagtagggggccaaggaatttacattgatcaagtgtttatcatattctagtctagtcattgtgcagattcttttatgtattttgtctgtgactataggggttgttcccactttacaaatgataagctctgggaggttcatcatcttgtccaaggtcacacagctaatacatggcagggtcttgccccaacatcatgccttcccagtagccttccctcttcaccttgcctcatggtagatctttttgcccatatcttttaagtatttccacttccctcttgactgtttctgtaagaataagcacacctatctcctatgcacacaaacatgacctaagaagcataaattaaaagacaaaaatattgctgaatttgattgcgtcagaacttagaatttctgttccgtgaaggataccatgaacaaagccattagaaggcaaaatgagagaagatattagcactgtctaaaatgttaaggaataaatatgtgggcctagagaatactggaaatcaacatgaagaaggcagtagtcctaatagaaaaatgggtaaaagttctgaattggcaacttaaagaagaggaagcctaaaagctagcaagtatgtaaagaaatgttcaactcattagtaataagtacaatgcaaattttaaaaacaatgagatcactttgtagcagggatgtattaataaaatgtgttggcagggctgtgaagacgtaggcaccctcatgcactgattggtgggtgtgaagcatggtgctgccattctggagaacaatctctagccaaattaaatatattttcatattctatgacccagtaattcacttttctggtatatttcccagagaaattattgtacagacccctaaaggtacatattcaaggatgattattatagcagtatttatgggggcaagatctatgtgggagagtggacatataaaatatgatggatggccccagggactatgacaaaacagttggaagcaatagactaatgtatgtattgcaacatgaatggctcttataaacataaagctgggctttaaaaaagtaaaaaatagaatgatatataatacaattgcatatgtatacatacaattttacatgcacacagaataatattttatattttgcaagaagatatacaatcaaaaaacatcttagaagagttttctacttaggacattgtgggagggagtgagaaatggggataaaagagaacaaatagttttttaaaagcaaataggacaaagagacttgcgatgaataggctaatgattttgtaccatgaattgaggcacataattaactgaacactctgaatttgatttttttttttttttttgagacagggtctcactctgtcaccctggctggagtgcagtggcatgatcttggctcactgcaacctctgactcatgggttaaaccaattctcatgcctcagcctcccgagtagctgggattacaggcgtacaccacaacgcccagctattttttgtattttttggtagagatggggttttgccatgttggccaggctggtctcgaactcccgacatcaggtgatccacccaccttgacctcccaaagtgctgggattaaatgtgtgagccaccatgctggcctgaatctgatcttaaaaacaaaaatccactcacctgtgaggcatgaggttaagatagatatatggataatttattacttacttcaagcataaaggaggccacttctcttttactctttcaatgcttatccagttcccttttcactcactattttatgacattcaattagatttttgcttttgattttatataatgtaaatacaatgtaaattattcactttttaaaaatatgtttttggtttttatgtcatacatctttgccattgttttcttcttcatttctaagcttttaagggcagggatgatatttcttttcacttgttattatatagtccctagcatggtgataatcccagtgttcaattttatgaaaaatcttctaggaggaggttttcctttttaaattctaaaagtgtggataatgttcctaggagagtagatgactaaataatgtaggctgatagcatcaggtatcctttttaataaacaccccattccatcttaacacctcctctctgcctcctctctgccttctctttagcaaatctgtctgccttttttcctgatagaaagtatcattggttaataactgtagattcttgataattgttattgtgaatgaattgcaaaatcgtggtcaataattaataggttataataagtattgagcttaatcaagtagaagtagtaaatttagatatttcttcttgatagttatgattccatctctttgtctttgtgtttattttttcagcttctctctgtgtgtctttttctatatctctctactaatcacctctttctttctctttatctccctctccctttctttctctttgtctctttctttatttttgactgtgtctctttgtttttatctctttttttcccctctcctagtttctggttcatggcctcaccaacagtgtagtccaaggctgatgcatttgcagctatgtcaggttagtgctctagaattaattagagcttctatcttttttttgagtctgtaaaagctttctttgacaggctcattgtagtcttggaattatagtcacttgaatcaagctggtgagtacatattttgtagcttcataacagtaaagaaacattttgtgatgcatttcacattgaaagtggctccaaaagagtcagtgccattttgatggcacttgggaaaatgcatcagtaatatcatttagctgaaggcactttgatttctccaggagagctgaatagaccaaggccttgtgagactctttacagtcctgattttcttttccttgaaaaatttcatggcaatttccaggaagtttcagaactttatgtcatcaaactgaaactttttttcttagaaaaacattaagatttttcttctttagtagtagatggcttaaaggttttaggtctgctattggtaaatgcattggatgttcaaagcttgattgacwaagtgggtaataaataaaccactgggaccagatgacatcaacccagtatttttgaagaaagtagaaggtaatattgtcaaaacttggttcaattatttttaacccttgttagttggcactgaacacaagaactatcagatttttttgagcttacccttcataagaattatcctacgaagacttaagcagtacattttgttggtgattattatctctttatttcatccttgtattaatcaaggttctcaaaagaaacagaagcatacacacacacacacacacacacacacacacatggcctctttggaggccaagaagtctcatgatttaccatctaccagatggagacccaggaaagccagtggtgtagtttgaaggactgagagctggagaaccaatagtatacattccagtctgggtgtgaggacctgagaaccaaaaaatgctgagggcaggacaagattgatgtcccagttcaaatgatcaggcagagttattccagccttcttttgcctttctgctctattcagcctcttaatggttggatgatgttaacccacattggggagggccatttgctttattcagtccaccaattcaaatgctggatggaataagagaaagactgaagacagagtccagatttgagggatgaatggtttgatttaatggcttcagaagtggagaagcaaaaatgttaaagatctattaataccttttgtatatgagagatgaaggaattggaggaatcaaagattataaagctttcaagtttggattggtgagaaaaccataatggtattagagagaaaaagaagagggttgtggaggtaagttagctgaagccagtaatgagtttggttttcaatacactgaaccttttgaggttgattccataaaaggtagtcatgtcctcatatgcaatgctcccaagtgtcacagagtgataacaatggaccagtgtagtcactgatcccacccatgtagcatttcttattttcttcagttaaattctacaaactcatcagtatctcctactaatactgccacaacagtgatctctgcttagttatctgtcaggtcaacatactgtgagcctgattatggcaagggctgcctgtaatctgtctcccaagtcctgaagatagcacctgccacttggtaggtgatcagtaattggttgttgcattggcatccacagtgtgcccaggtcaaggtgatgatgatacacagatgagtcaaatgaggagatagcactggtgtaatgtgggaacatggagaagaggaggagtgataattctgtttgggggttgaacaagccttcaaagagatgtgacattgaaggataaaggatttactggggctaaggagggaaaaaagatatttttaggacaggaaactagaagagcaaaggcatgcaggtgtgagagtataagatgtgtttgctcaatgactggaggagcaagttcacagagaggagaaataagtggatggtgctagaactggaaacgtatgcaggtggactatagaaaaccttgctaaggctcttatgtgctctcacacttcttaggacagaaattatttttagagtgaggaaagaaggggagggaggttgttagatggtaatttaatctggtatcttttagtagaagcacagagaactgggaatgaagagttttgagttttaatttttgttgctaactaatgtgattaggacaaagttataaaaattctctgaactatctagggttagtttctgttatttataaatactattattagtagtataatttttatttgatacaagaattcctaaaagttttttttttcaggaaaatatctagtttttttaattttaaaaaatctaataaaccaaacaacagttcatactcttttggtcacataggcatcaatgaaataatttctattctgactgtcatggagaatcattagcctgttacctgctaatgttccctttgtcttttacactgtggttttttgtaaactatgtcagtcttactatgattcaaaggacattaaagcaaatggggtgtttagtgacaaaagtatttacaaaaagcttttttttttttaagttcacactgccrtattgtactctcctcaaccttacttttaagtacattttctatacttaatttgggagaaattaccataaaacatttagtgctttgttttctgatatggtttggttttgtcccttagttcatggaattgaacatttgccttcagactgtatttatgtattactttcatctgaagaacatttattaagcacctgtttgtgggcattgccagtgatataactggtctgaacaaaaatatagctaatgatgtgcaagcagaaagtgtaagtttcctgcagccttttaaaataatattttactgatcataaaagcaatgtgcttagaatgtaatatatgtagaactttgaaaaataaagaaaagcacaattaggaaaataaaattccatgaaattctactgcctgaagataagagctgtgaatattttggtctgtttgcatgctctggtttttttccctatgcatttaaatatttatgtacatttacaatatcttgtgaatgcttcccctcttttaaatgagagtatagtgtgattgttcaggacttggctttcctcatccaattaataatgacagtgtgacctttatcaacttatttcgcctttcaaaggctctgttttattttctgcaaaaagggaataatactagtgtctacttcacaggtttggagtcagggcaaaatgagataatgcatttaccgcactcagagcctggctcattacaggagttctttattattggatattgcagttatttcatttttttcatgtatgtaatgtttgctaagctatgcacagtcagtgccatcagtttccttaccattcagttgttaatcacagagtttgattccattacaataataatcgctgagtcagactttcaccccactgtaacttgtccctagtggaaatttttccattagtttctgaaacttgggacctctctgttgtttccctcatgcagatttggtcacactagatgacctcatttggttgtcgtggggtttatttctgtagtgatgatagcctcttacattccctccaccatagaacttggtagggatgagaactagctggacggggccagtaacggggttgcatatgaccttctgggtggttctagagtctggatctgagtcacttctggcaatggatcagccataggatttcataagagtggccattagagcccttttaagcagaatactgaagtctggggatggaaccaacctaggattaagagttggggaatcagctatcaccagcatgaggtgggatggagaaggggatgaggctagcacaacattagggaattttgctgctgttttggtgggcaatataggtttggctgtgtgtttgtcttcttgtgtcttggtgacatcttagagcctcacactactcccttcctcaacttatttatttattggaaaatataataaaattgagataatttttacctttaacataaaagttyggctctaaaaaatgtttggcaaagcagaaactctaagtactaatgaggatatgagttgctcytacagccactttagagagctactaaatgcaaataagcatgacctgattctaggctcacaccctaaaaaatctctcccacagtactaagacagacttgtacaagcatatttatagcagtgttgtttgtaaaaatatgaaattattattaaggaagagtagtaaaccaggtcagatttatacaaggaaatactagaaagcagttaaaatggatgaactgtagttacatatgtcagcctgaattaaacaacgttgaatttaataggtgtgttgagaattacaggtacagtatcatacaatttaaatgatattaaagaacatgcaaatgatactgtatttatgcatttatgtatagtgaaagtataaatgcattcattcacatgttgaatactgtatttagataacaagtgctatgtctagagaaggaagagaatgagatgggggagataaagcatcagagatttgtattctatggatatgtatttaagttaaaaaatgacagcaaaaacaaatatttgagggggtggataccacgttttccatgatgtgattattatacattgcatgcctatatcaaatatctcatgtaccctataaatgtatatacctattatgtacccacaaaaattaaaagtaaaaaatttaaaaggacaaaatattaagttttaaggagactgaagtatgttttatattctctatttgttatctgattaacgtatttcaccattttcttaaatggggaaataaggacagaggaaattaacatataaccacaacaaattctagcagtgcaagggaaagtaagcctttatcacactgctgatccctgatcccttgttcctgtggccagagaaaactgctgttttttttttaatttttattttttattttttgagacggagtctcgctctgtctcccaggctggagtgcagtggtgcaatctcctcactgcaagctctgcctcccaggttcacgccattctcctgcctcagcctcctgaatagctgggactacaggcacccaccaccatgcccggctgattttttgtatttttagtagagacggggtttcaccgtgttagccaggatggtctcgatctcctgacctcgtgatccacccgcctggacctcccaaagtgctgggattacaggcttgagccaccgcgcccggctgaaaactactcttaatagttacccatgaatcctcatgacagccggtgatatagaagcatattgtatgcacattccttttacacctgcatggtaaatgctctttgctcctttcactacactatgtataccttggaggtcatttatcctgcaatatctgaccttttcttctaaagaaacttttgcttcatgaaggtaagtacaactacagtttctctaaagctcagttttgaaatcagtgatataaaatacatagggtcagttttacatagtaagttgtcaagacagattgcactcagactcaaaccaaccttgaaaacaaagtactgtatatctgtatttacatttgaaaggctcttttcccacttcagtttgtcaaacagttgaatatgttaagcttgagactagagacaatgtcagggtgaacatatgtgagggattcacacttctcaaagaaaagcacgctttttgtggccttggacaaagctgggattccgtgctgttgttattttcacaagtccctctactgagatcatgactgcatcttagagttgctgttgaatacagatgatgttaattttgttctcattcatattctatttagtttttaccaaactaaatgtttattagttggtgatatttaggaagtttgataggattgtgactatatagctatattttatgaaaaatggaggaaaagttccctttaaaatacctaaattttttttgagttaaagaaagaaaaataaaattcatgaaatagtgacgtgaagcttggtagtttagctgcagctgccaggtgtctaggctggctcttgggagagattattatgggatcacagtgagcctggctacacagagcatggaaagtcccctcgtccttgtcatcacagagtttggcttacagacctctcctctcaaagatggaggcttctggtctttctgatattgttttctcttcctgtccctccttatagagagaaatccaaaatatttttgctaaaattctctagagttgaatttgggaacaccaggggataaaacccctcatgttaaggcatgtaggaggaaaggtatcctcttatcaatcgaattgtagttcaaatatgctgtaaacccacctgtttactccttcgtggtggccgtaagatgtgaaaaggcaggggctccagaagttctaggtaggagtcctttgttcttatgtttttcaagggtctcatggtgaccaacattgttaacttcttttagcctctgtttcctcaccctcaaatgaggtcaatagtatctactttcagaagtgatattcaaaatatctgatatgggagtgggacttggctgttatcagacagatggcatatgcatcccgtaatgttgtgcctggtgctgtaaggttgtgcctggtgaatgtcaactaggactgttttacagggttgctataagggtaagataagatcatgcacatgaatgtgctttgaaaactgcaaggggatacataaatttgtactattaatgcaaaatacatgcaatgggcaggaagtttgagaagtgctttgagctgtttgaccagaagattctttaatgagaataaggaattattgccctgtgatgtcaatgtatttaaatatatgcttattatacatatattgaactatatatataatatacatatattacacatatattgaactcagcaattgaatgcttaggtatttacctaagaaaaatgaaaacacaattctactcaaaggcttataggtgaatattcaccgtagttttattcatcatagctaaaaactggcaacaatttcttatgttgatcacctgctgaatgagtaaacatgctgtgatgcctccatacaatggaacactacccagcaataaaatggaacacatgcctgatggacacagtaatgtagacaagtctcaagtgcattatgctaactgaaagaagacagacacaaaacattacgcaccatatgattctatttctatgaaattctatcaaaggcaaaactttagcaacagaaatcagatagtggttttcaggggccggggtcaggggagagattggctgtaagaggtatgaggaaactttctgaagtaatggaaatattctatctcttgattgtggtggtggttacatgattctatatgtatttgtcaaaatctatggaattgtatactgaaaaattgatcaatttcattatacataaattatacttcaaaaaaatggaactgggtaaaaatagttccctcatgaaaaaaatagaaaatgcaatgttgaaagagaaaggaggaacattctttacaaaacaaaatgtttcttctttataggctatatatttcagtttcagcttcgagtaatgaattttatggcttcgtctcttgcattgagcattacactctagtgaacacccaacttgctaagtcgtcccccatacacaccttactgtttctctctttgttatcatttccttatgctgagcacttgcctggrgtagctccctcccccagccttccctggggctctcatttcctccctcactcatttggttaactcttatttaccattgaagattcagtttggaattcaccttctccaagagccttcccctggtttctccccatccctttcacattggggctcatttgggtatccctggccattagctttgtcagtatactcaccagatttcactataagtagctctttatgggtttgtcttccccaaaagaggttaaggactatatcttacacacttttataccctggtgcccagcatgttgctgatggtcaatagatgtttgtagaattagtgattgggagtgccaaagggagtggtgaggacatgtgagattgtggaaagaatgcaagggaaggaagattatttgaatcccagtctctcacttagtggttagagtaactttggacaagttggttaatgtgtctcagatagaagatggagatctagacccatctactggataggattaccataagatctacataaaactatgatgtgaaagcactctgtacctagtaaagcagttcacacacataagttattattatgtcattggaagagtgttgtttctcagctcttggatatagcaatgtaaaccaaaccaaacggataaaatatattcaccttcaactttaagggtagtgtctgcattgcattgatatgttcacctgactccttatagcatctagttagaacttcctctgctcataagagacagctatagtcttgtcagtcctttcactctgttatttctcattgaagcaattgctaaccagtgtatataatttttgaaaacatggatcttgttttatttagctttgggtcctctrtagcacttactagagttcattgcatctagaaatgttaaaatggcaagccaagtagaggttaacatagacatctagagaaatgttatccagttttccagagaaggctaaatatcaaaatagtgttgtaattaaatcttatttttagaatctgataaagtaattttgggttaccacagaaatctttcaagtttaagctaataaaatattaatgtcctggatctttggaaatctactaatgtcttcatttggaacttcataagaatcaagaatttcactgcatctaagatccgttttccacaagtcttaaaatctgaactacagcacgttatctatgtgatattctttctagcatttcataaacgtattcttttaaaaaaataattattttatcttgattatagaagaatggagtctataccttatttgtaggtgatagagcaagcaccaggcccttgacccactcttactgcctccgttcatcattatttttagtttctactaacctttattgtattatttggaacaaaatggaagaaaacctaactgggtgtataaattttgatgtacattaacaattcatcaaagtgatattatagataatgtgactgttttcataaacaaaacaggactaaaataaatgaatatgcagaagaaagtgtgagagatactgaaatattttgctggtatagtatattatgcagatgtttgcatttatgaggtagaactagaaaacaaaaaaactctatgttataatcatttttaataaatgaatttttatttccaggtaatttatacctatattcaagtcttggtaagcaatttaaaataatttgctgacttgttgatctcacctttcaaataatatgccaagggccaataacttcttgcaacatgtatagatatttatccaaatgtgtttttgataaggatatgaaaatatttggggaataaatccaatacttatgcttatttatggtacataaatcggagtttcccatgagtgaccgtaaaaattggaggaagtggaaagaaagaggaactgaaatataaaccaaatgtttgtttatgggctttatttagaaatccacattagtgattctgacattgggatattaatccaaaatttcctttctttgtggattattttcacacaaaattgtacattctcatgaggcaattctctttggagtacccatagagaattattacatttttaccagataggttctttttaatattctaatctagcaaatttgcatttaagaaaactactttattccaggatagcttttttgcacaagttattgttctgcccacctcccctcaaataaaaccagcatcataacttctcagagctttgtctgctttcaagattctttggcacctgcactgggttatatgccataccaaaaatgtttcccagccattcatgtttaaatacatttaagtttacattaatttttaaaaggattaaaagcaccttcaaaaatgaagcatgtattctctaagcagcaagtattaatttataggggctgttcatggaaaaaaatgctgttattgtatgtctcttgccccatgcataataaagaacttttctttttgaaagtaattgctgtaaaatattccttgagggatcaaaatattagtatgactgggaagtaggatctctgttcttaggcagattgttttgttacttagttccaaatataaaactggacaaaagtaggtgaggtaagggaatgatagagtggttagaagagatctttagataagaacatctttggcaacagggatagggccttcacgatctttcttaaaatcctggagcggcaggcttcacgtgggaggaaaccaggggttgccactagatcagctaagagacaagcaaataagaggctgggtgcagaaaatgctgagtctctccgaaggtttttccctcaagctgagctggtgtctggttttctgaccacatgttgtttcttctctttataagagtgaaacaacattcctgtttaaaaaaaaaaagccaaaatgtttgtcatcaagcctgacagtgatatgggtcctcactcaaatacagtgagacttcttcctacgatattggtcctgtggagttaggtcagaaggatgtggttataaaataaagtgatttcattttgtttatctcctactcagaaactttcagtgttccccctttcccgcagtgacaacaggaaaaggcccaaaagcttcagcatggcaggtggaggccttctagaacctggttccaatcttagcataacttttaccacttcctaactcaagcctcaactctagctcaaccattcttctatgtaatcaagagatattctaggcacttctggtgggaagtagagaataagccaaggctgggaggggtgaggcctggggaactttaacagagattagtacccagatcactaaatttggggttggagggtgaggcaaagaactctggtactgtctacactgacagtctttctaaggtacctttccaagaagagaagacagtgcttgcctagtgactgtgatggttcagggataatgtgacaattcttgacaccctgctgttactttacttatagatcagaacatattctgtgagctgatatattagattttagaaggagaagccaatcccaaaagacaggtaggaattaaatggggaactcaggatacccaactatcagtttggtggccagagctggacttgctttcttgaggaaattatgatgaaaaccagggcctgagtcttgcagtcaaactggcctctgaaagagagggctggaggtgggaatgggtgggaaaatggcagctcactctgctgcctaggactcataacgcctggtatatcagataccagaaaacaagtattatactattccagagattatctgtcttactaatagggccctgggtagggcagagcctataggcttttaattttgacacctgggcaggacaagttctttcagtgacggacacttatcttccagcactataataggcctcattatggtacatatgataaattatcttgtccaattaatttatgccactttagactaaggactgtcatatatatacatatatatacachcatatatatacacacatacatatatatgcacatatatatatatagtttctttargtcttaccaaagtattaaatactttttgaacaaataacgtattttggggggcattattctgtccacttacctaaatcaaggatgatataaacaataaatacaatttcaataaattagattttaatttttttttaatgaacagaaagccaattgattggtttcctgaagctctattgtttcctcctgtcaatggaatacaaaatcacaggaactctttatcacttagattggagattacgaatgccgtgaaggcaagtaactgcctttcttcttctaattattttggaaagaacatatttttcactagaaagaccagaagctggaaagccaaaggctttggccacaaaactgtgaagggactctggatggatggaggctccacaagagcttcattccaaattaagatgttcaggctacattgaagaaagcaatctatttgccttggaaaaatttattagygctaagagctaatatatgaaatatacaatctgtatctggatgtttgcatttctctaaatcttgccctcaacatatatatcattttcaataaatggttttgagccataattttttcattcattctatatgccagttggtgtgcaggtggtgttgatatagaaatgagtaaggcacaggtgctaacatcaggggctcacagtcctcactggcatcaggtgaagcactgcatgcaatacaaggacaagtcctcaagcaactgatgcatagatttttaaaaagtggtatagccatacaacagaatagtctttggcaataaaaatgaatgaagtactggtgcatgctaaaaacctcagaaacattaggataaatgaaaaatgccaatcacaaaagaccacattttatatgattccatttatataaaatgtatagaataggcaaagacatggaaatagaaagtacattggtagttgccaggggtttggcaaccccactttgccagcggagggtgcagatggggagtgattattaatggtactgtgtttgtcgtagaggtgattaaaacctttcaaaattgattgtggtgatggctgcataactctgtgaaatactaagaacctttaaatgaacgcttcaaatgagtgaattgtatgacatgtgaatttaacctgaacaaaggtattataaaaagagagagagagaaatggtaggaggagatagatctttcaaaaaattgtgaattaggggaagtagagaaaagggaaggtgttaaaagaagatgttttaatctacattggttatcaaatgtacacaacagttttaagtacacattctcatttcatccaaacaacattgctgtgattttgctgttatttagataaggaaatggaagcttggagagcttaagcgatttgccaaaatacatacaacttaacaagcagaatgggctattaaggtcagacctgaggaaagcagatcacagttgagggggttggaggaaaaaaagaaagaaagaaagagaaagaaagacaagatgaagatacagggattttgaattctctgatcccagaagctctcattggctaaatcacagttttagcactgttcacttttattcttttgtaggctaatgtactaagctaattatgtatttacattttaaattccttgaggactaggcaatgtctctatcatttagattcttctaggtacaggcatccctcggagatattgtgggttttgattctggaccaccacagtaaagtaaatatcacaataaaattttttggtttcccagtacatataaaagttatgtagtctattaagtgtgtaatagcattatggctaaaagaatgtacatactttaatttataaatactattaatatattgctaaaaatgctaactgtcatctgtgccttcagcaagttgtaatctttttgctggtggtggtcttgccttgatgttgacggctgccgactgatgagggtggtggttgctgaaggctagggtggctgtggcaatttcttaaaataagacaacaatgaagtttgctgcaatgaatgatatttctttcatgaaagattcttctggagtatgtgatggtgtttggtagcatttttcccacagtaggacttccaaaattggagccagttctctcaaatcctgccattgccttatcagctaagtttatggaacattctaaatcctttgttgtcatttcaacaatgttcacacaccttcaccaggagtagattccatctcaggaaactcgtttatttgctcatccataaaaagcaactcctcatctgttaaagctttattgtgagattgcagtaatttagtcatatcttcaggctccacttctaattctagttcttttgttatttctcctacatctgcaggtacttcctcctctgaagtcttgaacccctcaaagtcatccatgagggttggaatcaacttcttccaaactcctgttaatgttgatatttttacctccttccataaatcatgaatattcttaatggaatctagaatggtgaatcttttccagaaggttgttgatttactttgcttagatacatcagaggaatcacaatctatggcagccatagccttatgaaatgtatttgttaaataataagacttgaaggttgaaattgctatttgatccatgggcttcagattggatgttgtattagcaggcaagaaaacaacattaattttcttgtatatcttcatcagaactcctgagtgaacaggtgccatgccaattagcagtaatattttgaaaggattttttttctgagcagtacatctcaagagtgggcttaaaatatttactaaaccatactgtttaataaaccatatctgttctataaacagatacgctgtcatccaggctttgttgtttcatttatagagcactgttagagtagatttagcataacttttaaaagccctatgatttttggaaaggtaaatgaatattggcttcaacaaagtcatagctacattagtttccaacaagaaggtcagcctgtccatttgaagctttgaatccaggcattgacttctctctagctatgaaagttctagatcttctaatagaaggctgttttgtctacattgaaaatctgttgttcagcgtagtgacatacctcaatggtcttaactgggttttctggataactagctatagcttctacattagcacttgctgcttcaccttgcattttcatgttatgggccctctttccttaaatgaaccaacctctgctagcttatatgggtgcagttcatggtgctccaaaacaattatgatagtaaatcagaactcactgctcacaggttatcataacagatatagtaaaaatgaaaaagcttgaaatattgcaataacttttcttttgtagcttccttacttctttcagccatcatagaattgaagagagttagggctttcctctggattaggctttggcttaagggaatgttgtagggggtttgatcttctgtccagacagccagaactttcaccctatcagcaataagactattttgctttcttatcactcacgtgttcgctggactagcactttttttttttttattattgagacagagtcttgctctgtcacacaggctgcactgctttggtgcaatcctggctcactgcagccttgatctcccaggctcaagcaatcctcccacctcagccttctgagtagctgggactataggtacatgccaccatgcccagttaattttaaaatttttttgtggagacagggtctcactatgttgcccaagctggtctccaactactggattcaagcaattctcctaccttggcttcccaaattgctgggattacagcaatgggccaccacacctagccagcactcataatttccttcaagaacttttcctttgcattcacaacttagctaactgtttggcacaagaggcctagcttttgccctatcttggctattgacatgccttcctcactaagcctaaccatttcttgtttttgatttaaagtgagaaatgtgtgactcctttcacatgaacactaagaggccatcgtaggttattaattggcctaatttcaatggtgttgtatcttagggaatagggaagcctgaggagagggagagagcaccatgtactgcacccatataagaagagaaacctaatcaataaactttgtgttctgactgctccatcaaccttccggacaagtcagaacacaagcaacatttattgattaggtttctcttcttacatgggtgtagttcgtggtgctccaaaacaattacaatagcaatatcagagctcactgatcatagatcatcataacagatatagtaaaaatgaaaattcttgaaatattgcaagaattacctaaatgtgacacagagacatgaagtgaacaactgctcttggaaaaatggtatggatagacttgcttgatgtggggttgcaacaaactcgatttgtaaaaaacgcattcatctgtgaagcacaaaaaggcaaagcaaataaaatgaggtatgcttgaatatttggggacctgactacccatttgcctgttttgggcaactgtattctgagaaaaatctgagctcattggcaaccaatcagtagaagtagggtggccacagatacagacatatgtccttgttagttgttattattttgtaagagagtatcacctgtagtgtcaatatgtattaccctgccctgaactgataacatggaacacacattagctccaagtttttggcagagatgctgtcctttaactctttgttattcaatcctcatcaaatccttctttcctttttctaattgcactccttttatactcccgtatcaaatccttcaatgtaaactgttaattctatttctaaaatatattgcaaattcagccacttctttttctcttctgtgaaatcaggcctggccatctccatcatctttgtttaggtctttcttttcagctggttacattactttcaagtctgtctctcctctactccgtaactgaaaaactatattttttttctatggaaattccatcacatagctccctgaaggtcctcctgcctagaaaaattatcatcacacaattaccttttaaaacacatcttaaaaacccaatcagcaaatgtttgaggggctaatatgagggagcttcaaaaagtttgtggaaaaagtgaattaaaaataaaaatgaaaaatataacctttatttctcaacataagctccatcaagttcaaaacacttttgtaagtgatgatatcagccatttagtttatccctaaataactgggcactctaggtatataaccatatcattgcagtcttttttacattattaactaaagaaaaatgggtgccctttacagatttttaagattaggaaacaaaaaaaaatcaaaaggagttaaatcaggactttcaggtggatgcctaataactttcccttgaaacttttgtaaaattgcccttgtttgatgagcagaatgagcaggagcatcattgtggtggagaaggattttctggtgaagctctcctgggcatttttctgctaaagatttggctatgtttctcaaaacactgttataataagcagatattattgttctttcacctgcagaaagacaataagcaaaatgccttgatcatcccaaaaaactgttgccatgacctttgctcttcattggtcagcttttgctttcacaggaccacttccacctcttggtagccatggctttgcttgtgctttgtcttcaggatcataccggaaagccatgtttcatctcctgttacagttatttaaagaaatgctatagaatcttgattccacttgtttaaaattttcattgaaacctctgctcttctctgcagctgatctgggcacaatggttttggcacccatcaagtggaaagtttgcccaactttgatattttagtcagaattgcataagctgacaaatcaagatatctatggtgttggttattgtttctgctgttaattgtcactcttcttcaattaggacatgaacaaagtgaatttttttcctcacagattgatgtggatggtctgccactgcaagcttcattttcaacattgtcttgtcccttcttaaaatgagttatcgatctgtaggctgctgattcctttgaggcattgtccctgtaaacttttcataaagcagcagtgatttcaccattcttcttcccaagcttcaccttaaatgtgatgtttgttcttgtttcaattttagcagaattcatgttgcactgatgggggctctttttcaaaaaaatattttttattgtactaaaatatacatatataatttaccatctttatcttttttaagtgtgtagttcagtggtaataaatgcatttatattctatttgtttctttgactcttctcccctctccccttcctggcctctgataactaccaatctctatcttyatgagatctacttttttagctcccacatgtgagtgagactatatgatatttgtctttctgtgcttggactttttcacttaacataatggtcttcaattccatctatgttgctgcaaatgacaggatttcattcatttttatggctgaatgatatttcattgtgtatatatatggcrttttctttcttcattcatctgttgatgggtacttagcttgattccgtattttcactattgttagcagtgctgaaataaacacgggagtgcagatatctctttgatgtattgatttcctttctttttgatatataccaagtagtagaattactggatcatatggtggttctacttttagttttttgaggaaccttcatactgtacattaggctgtactaatttgcattcccaccaacagtgtatgaaggttcccctttctccacatcctcaccagcatctgttattgtgtgtggtgagatgctgtctcattgtggttttcatttgcatttctctgatgattagggatattgagcatttttttcatgtacttcttggccatttgtatgtcttttgagaaatgtctgttcaaaccttttgcccaatatttaatctgaatttttttttttttttttttttttttgctattgagttgtttgaactccttatatgttctggttattaatcccttgtcagatggatagtttgcaaatattttctctcattctgtgtgttgtcttttcactttgtcgattgtttgctgtgcagaagctttttaggttgatataatcccaattatatatttttgcttgggttgcctgtgcttttcaggtcttaaacaaaaaatatttgcccagaccaatgttctgggacatttctccaaagttttattctagtggtttcattgttttaggacttctattgaaatattttatccattttgatttgatttttgtgtatagtgggaaatagaggtccaatttcattcttttgcatatagctatccagtttttgataggggctcttttaaaactgatgtcttatccttcttagtgcctcaaactagattctgttcagatatgttataataaattagtatgagtttattttgatgcaaaaaagttgaaatctatttttttataatacacatttttcatgaacttcttgaagacccctcctatttgccagacactgttcttycattgactaataaataaattctctctcctttcttttttcatttttcagctcttgggttttacagttttaaaaattaatttttaattagacaagtaaaaattatatgatttgtactgtacaagtgtgatgttttgatatgtatgtacactgtgtaatggccaaatcaggcatatccattacctcacatacttaacatttttttgtggtgataacacttagaatctatcctcttagcaattttcaagtatacaatctattgttattaactatagtcagcatgatgtacaacatatctcttgaactttttctaactgaaaatttgtgtcctttgaccaacttcttcccaatctctacattccctcatctctggtaatcattattttactctctgtttctatgaatttgagttttctagattccacgtataagtaagctcagatggcatttttctttgtgtgcctggcctattttacttaacataatggccttcaagttcatccaagttgttgcaaatgacaatatttctttttttggtaaggccgaatagtaattccattgtgcctatataccacatttcctttatccattcattcactgatggacacttaggttgattccatatcttgggtattgtcaataatgttgtaatgaacataggagtgcaggtatctctttgacatactgatttcatattctttggatatgtgtacccagtagtgggattgctgggtcatatggtagccctatttttaattttttagctctatttttaattttttgaggagcctctacactgtttttcataatggcattctcaatttacattctcttcaacagtgtacaaggattcccttttctacttatccctgccaacacaaattctaactcttcaccatggcccaggaggtcctgcatgatatggttcctgcctttttgtcagattttgtctcatgtttctctttgccctttctcactgcactccagccacaaaaatcctctttcagcttcttgtgaaggttttcctgcctagaggcttttgtaggtacagtgacctctgcaatgagtattcttgtctccattcttcttgtccatagttcgttagcataaaatccttcagtttttcagcttaaatatctcctcagagaagtcttccctgatcacctaatacaaagaagttttctgtccccctcattcttcagttagctaaaaataatagaaaacccaaaacaatagttgcttacacacmatagaagtttctttctctgtcatatgaaattatagataactatgcaccagagtgttagcaacccagattccactgtccagatgttcctttccaagcctacctcgtcatccaggatggcttcttccatctgcatttgagtgaccaggataaagacatgccaccccctttaagtaacatggccacatctagctacagggaagctagaaaatggggtctttttaaaactctagacagtcatcttcccagcaaaattaaaactgttattactaagggagagggagaaaatggaaatggagggatgaagaggagttacattccacattttatactcatggtagaaatggacttttgtacattattgtatcacatggcatttttaattatataattttcttgtaggcaaataactttcttatgggaaatttgtgctactcttaagcaactggcttgttttcctattatggacattgtgaatcttctgcctgattatgttttgctttttgatttgtttgccaggaagtttgtagctaaatttatggtcctctccagcaactacacaaatcctatgatggatattttttctgataatattatctgtagcgttattttattttactatactttcttcctttctttctttaccttcttcctttctttttattttcttcaatgtaattttgcaagtctcttcaaattcctttggtaataagtcaggaaataagtaaaacacaagtataaataaataaagtattttatatttaatgaaggtgataaaagtgcctacattatagggctgtcgagagaatccactgagttaatgtaagtaaaacatttagagcagtgcctggcatattgtaagacctatagaaatgctagttcgttattattattattttaattaaatctttcctgaagtgactgtcagataaatctgcttgataagacagttttactttaacttttgttctaggttaaacaaagagggaaagattaaaatatacatttaaggaccactcagcaacaatcattctatgtcttcatattctaatctacatggcagctagtaaatgcattgtgctgtgtaagataatgtgctaaaactcttagtggagatggcctctaaattttttatgtttagtatttaggcatcttgtagataaaatgtatggatgaataatcagatgaggattcaatgaccagaagtactgttgctctctctccatctctttctgttagaaatagatctccatcagataggtctgtgtttgaattttagatgtactaccaaccacactatgtgacctaggtcaagtctcagctttcatgtcaatatatttaccgatgggtggcagtaatacctatcatatagggacataaggattacattaaataatacatgttaagatctttgcatggttcctggccagagtacacatacaatagctatttctgatatcattattttcactcaagtcttttaaattgaagaattatcaccttttagcacttgaatttatattgaatctatacacacatcatttttttatttaaatatttgaaatccttaccctacaatccaatggaaattctgcaaatgtttaaagttttggactccatgacaaaattgtatagatagaatagtggttttaaatatggctcggggattacaaatggtccacatggatccttgggaatgaatcaagctacgagctcctatagcaataatatttctattaccatagcgtatgtgcctaagtttctggtgtggattaataaattattactgttgttaaatggatgcctggttttcttaattggtagctcatcaaaagcttattaaaaacttcctattcattttgttgatttcagtggttggggataaatggcccaggaggctctttgccctgctaaagtggatcatgaacaatgtgggatatttaattcaattcaattcagcaaacatattgaattcaaaatatgcaaaaagcattgtgctacaaattgtgacaatatcaagggacatcccctgtggtggccttctgttatttggtacccaggatccatttttattctatttgggaactacagccttggcccactccaagctatgtggtttgggtaggattggccccttacccaggtctgggggtggaatggccttgcttggcttaaggtagtcagcataaccctttcctatggccatggtattagatttatgagtgggcatataactcatgaatctttaaaagacttgtgcctggggcttctgaaaaaaaatgaagtctcctctgtctttgcagtgggaacttctggaaaagatactttctctttccctgggcctatagttaggatgtaaggtataggagagcctgcagatgttttgggggagaacaccacacagattttgaatatgaagctaacaccatgggtttggagtcggtctgacctggattcaaatccaagcactgtcactttctagtttggtaaggtatttgagcttcgttgtgcctccattttgtcacctataaaatgtggctaatgcccttactctctcctccttaaaactatttggtactggcttttaattgtaacagaattaacatcaataattggatttgtgcccatcaagccaatgaactttcataaaatgaaatccagaaaattttcatgtaattcatagagttcttatatttaacccatgtctctagaatcttcttctagtgacaaattatgttgtattgaatcatgtgaaactgagccaagtttatcattatttagggtagaaattctgttttgttacagtagtttcactcaagttttacttctctaagaagaacataagacacacttaaaattttaagcatatctacataaaaaagcccagtttgttataccattttcatagagttattttagccctctaatatagcactgtaataacattttgtacttgctacaaacataagcacactagtttctatcatttttgcccttggtttataaagatggaatttagaaagcaaatacatttagggatgaaatagtgaaatctgctgaatgtgtgtagaattattaaagagtataacatggctgcttgttttatttagaaatgacattgggtgggttagctaaccaaagctgccaatactgtattttaatgatcttgagtttatctcctatttacaattctttgtcatttagtctacaggtgttagatcacttaacacttgctgaattcttcagatttgtttgtttcctgccgtttggtgttgatcattttgatgtgtgataggaggaggaagtagttatctaattttcactgaacaatcttccctaaggtatcacatatattcattctatatcttctatcagtcagccatagattgtgaaaaactttgatagaaactttaaattcagagcccctgaattagtcagttttcactcagtaatgctatgataacaaacaacctccaaaatctcagtggttcacaaaaaccaagctttaattcttgttctgtatatatatatacatatatctgccgattagtagtgcctttgctcctgcctcaggtatctttttttaccccagaatgcagacagaaggagcagcttccatctgggacatgccattctcctggctgagggcaatgatctctctttttcttttttcttttactttttaagttctggggtacatatgcaggatgtgcaggtttgttaacataggtaaacgtgtgccatggtggtttgttgcacccatcagcccattacctaggtattaagtcaagcatgcattagctgtttttgccaatgctctccctccccgtactccactcctcaacaggcctcagtgtgtgttgttcccctccctgtgtccgtgtgttttcattgttcagctcccacttataagcgagaacatgcagtatttgatttactgtttctgcattagtttgctgaggataatggcttccagctccacccatgaccctgcaaaggacatgatcttgttcctttttatggctgcatagtattccacggtgtatatgtaccacattttcttagagacaatgccaaatcttgcaatggtccttaaagctcctgctcaattatgactgtatatcatgcgtattcatattccattggccagagaaagtctcttggccaagtccaagctcagtgtctttgactgagatatcgcagtttacaaggcaatgggtgggcatgagttttaagaggaaataatggaacatatgtcataggtctgttttggacagggctactggtgtatttttctcttatgtcctattcttctgctgtttttttctccaaaaactcccttccttggttctctcatccacccctccatcacttcctctgtactcttggctgccaagtagacccatggagcctactccacttttctgtccagcctgatgtagaatctttaggatataggacctaaattattgctttagtaaaaactggagctgtctgatgttataaggaatagctctactctgagccaagtaggcttggtatttactgaagtcatatccactttgttttattcctggtaatttggcttgaagtgaaattttaaataaaccagatacttattgcttatgcccactaaatatatgtccacagcccttaaataactacctttgtcttatagtgctttatggaacatagagcaattttaccaccattatctcatatgatggtcacaagaagcctggtgatgccaatattattgtgattcccatttcacaggataaaaaaaagttaagtagcttattcaggatcaaaaggctggtgagctttatagccagcattcaagccagggtatrtagtgataggcatttcttgttattgacaaagaaatcctctgctttaagcatatatcgaataatgcataatgtaataaataccctgttttttcaaaaaaaagttacagagtaagatgttggcttgtttcactgaaaatattcaacttaaaatttttagaaatgtcttattagttttgaatgatctgatgactaaatttcagtttatataaaactttccctcataaaacaatcattacacagtttgggcactatgcttgctggagtataaaaccccattgcagtaaacagtgtgtcatcatgctgttactgaaagtggcctactatgctttatctccactgccctgtcccaatctaagccactgtcacctcttacccagaatgtggcagtagtcctttcaacagtcctctataccttttctgacttcctccaagcttttcctcaagctgagcctagtgatatttttaactgtgaatgtgaatttgtctgacttccctatccttacccaaagtccttaatacaagtctcccatgtgatatcaccctgcaaacgtggccagccttctatcgtcattctctccctcaatttctgcttactttctcatcttagtcctctctcctacccaccctccagccagtgtctcctagtcaattggcactcatttttcccatcccagcttcccagggaagctagccatgacccccagaccatgataactagcccattttagtctactgtagctggcaactcacctccatatcccacccattgccacacctggattttcctctgtaaatactgcttgaacctgactgaggtgcattatgcttcctgctgctcactttaccaggttagatgacagcggttttcatgaaagccgtccctcactcacgcacattagtcacctttacaaggaaacacccagtgattagagagaaagcaaccaccatgtcagccatgcttcaaagcaaccatattcaaaacaagttgtttttggaaaagagtatatttcatgttttagagtataaatgttccctgtgataattactataagaaatcaagatactccagtctgagtgcctgttcatgctgctgcaaaaacaatgggaaaagtttggattttaaggcaatccaatttctaaggaccagaagcagtctatgcttatggctgcttattgctagttgggttcttataaacctggagtgtcctacatttcatgttgaattgaacataatgggcctgtgataggcacctctccacaaaataacaaaagtctctgtataaactcaatattttagaagtcaaagtagacaggatactttgcttgtggcttgtcctcaggtatcagtacagcaagtggctctcagcacaccaccaaacagggcaggcagctggctctctagagataattataatttattgtgcccatggattttgatgcagtggggtctgggctctctcacaaggccaacagagcaggtctaatttgagccagatctcaggagacacagtccggagaggatgggtcatgtgccttcagttatcacttggagttgcactttgccccttgttcctctttctctcaactagtagctgagttttaatttttttccctgaaaatttattcagagagactgttttccttttcttcctggaattcacagaatgaagatggaggtccataaataccttggttaaaagttggaagatcatagagtgtcccactgtctgttttggggcctggcaggaatactcctaatcactgtaaatgaataggtgtttcatctatttttgtcttctcttctttgttctctacctgaaaatgtccttccctcattttcaggctactgaaatcttctaaagccttcttaaagtttcttctttataggaaacttcctagatttcttcctttagtcagaattaatgctgatttatgttctctcatgaaattgtactttgtactttcatttastgctgtgactgttctttttaaagttattgtttacttatttttttctcctccagattatacaatccttaaggatagtactggaatttcctcatcttcctattgtccacattgcccagcgtgaaattttggcccagtaggaaggctatacatttgttgaattaatttkgatctgtaaggcatattcttccacgaaaaggacattgcacaatcacaatattctccataaacaaatggacactcagaaagaactgttgtgttcttttatctgccttccatgaatgtgcagtttccttaccacttctccatggacctagttatcttgcatagtgcacacattagaagattatgtgataagagtagaaagctaggtttcctttgggtagggctagactatttcctgttcagaggtgaagacttctgaaatcagaatcaattttctaaaacataccacattaaaataagaccatagacaygtttttctgtctataagtctttttattttratggtagaaaatgttgtaagattatttcattatcttcttattgttaactgttttggggaagaatcaaatcaggagagactgagattggagtctttttatcaaattctctatagactacatgatccgtgccaataccacagcagtcagcagctgttgtctgtgctaggagaccacagtagtaattacacacaggttaagtggcttaaaaaaattgatcggttttgaaaattaggtgtggaagatagaaaggaacctgaggatttttataatatttttgtgatataatagactatagccaaaagagttactttatagtgagtatttttagcttcagtcccacattctcttcagaaattagtattataatccttttcattactctaaccgagtctgatgactcctgtcctaggatgaaacacccctcccaactcccttattaagagattgggacctagtgtgattaacagcaccctgatcgatgagcaagattcttacagattaaggaaaagaattgctgacaacttaggctgacttttatatacctatttgttttccttcctaattcctcttaaaatgaaaatgccaagmttttcttttgatatttgttacatttgtgaaataatataacaatgcagttaatgggaagagcatgacccctggattcagatatccaatagttacaaatctcagcttcagcacctagcagttatgtgaactttcttctctgcacctcagtctcttcataataactactttgcagagttgctgtgaatattagtgtaaataatggacattcaaatatagctattactgttattatcatcatcaattattctacctatagaaatatgcaagttccttggaagtatacatttctggagagtgatcagggatgggrtattatacttttattttttcggtttctcttcattcattcagtgggttatgggtatgtgtgtgtgtgtgtgtgtgtttcacacattatgtgctaggcactatttcaggcacttggaacktacattattgtaggggtacaactggaaactgataaatgctgtaaaaaaaattaaacaagctaagaggtacaggaggttgggagagagttgcaattattaatagggacattagggtaggccttactgtgaatatgacacaggttttgtgttcttagaggttttcatgaactatcttttggaatgggaggatgggaagaagggagatgagagtaaagagtaagagcttgctgatttgtaggcaggcatgaatattccctttggtataaggtgtcaaaacacaaactaatatggaagggtaaaattttctaggtggtctagttttattttattccatttgagcaaaaatcttcctaaagtattttgtacacaccctgccttcccaaacaatggctactgaatacagtggcccaccttgtctgtgactgctggaggaggtcatcaccatggctcacatctgttattggactttcatgaaacaagtccctcagggccagaagagatgctgtcatctgtttgtcctatgcaatggcctgagcctgcagtcattgtgagttctacccacatgtggctatttaaatgtacgtataaattaattgaaattaaatgacattaaaaattcagattcttagtcagtctagtcacatttcaagtggtcaatagccacatgtggctaatggctactgtgttagcacagatatcaaacatttctgtcactgtagaaagttctcttagtgttagttattttatatgtttctgactccaacattgttttttgtggtactgttgtcagttttcagaccttatttcctctttttgatttgttgtttctcatagctgataggtttaaatgccagatgtagaattttgtgtaaagtaagggtaaccaggctctaagagatcagaagagctttcttgtgttcaagtttttgtacttggaatttttatttctattctgagtgccccaaggcctcttttgcttggttattgttctgcagctgtactgtaggtgtaagggaatcagactgctgagttcctatgggagaagggctatcaaactttaaaggtaaaactgaacattcatggaaatgctttagatccagtcagcagtctcttatttggagcagcacaactccaggggtgcttaatgaccaactggctacatgtacgccaggcactgggttagtcccttgacacacaaacaagaatgaacatggacccaaatggaggaaattacagtttaaggggtagagagagtttcattaagtcaattcccagatatgtcccaggtactctgaaagtccagagaagggcggtacctgatccaggcttccctgatgttacaggagacaagaggccagggaatgctccctaaagaagtgattcttgagtggaatcttgagggatgcataggtactggtcacatgatgaaggtgggaaaaggtgtctgtataggtaggtgtctatacagggaaaagtgtctgtataggtaggcagactttggatgttgaaatgatgggttttcggcagaagtggaaatggggaagaggggttggggatgctgcctggggcagatctgactcttcagtagtttgacttgttcactctggcagctctgtgaaggtaaaaaggagccaggctggaggctggcacaccggtggtatgggagggccagggagtagagacctgtaatagttcaaaagagaggtaatgagggcctgctgtgagagtgtaagggggttgaacagagttcatgatttcaattggtattgatttctaaggagtaaaattatcagtattgggggattgattacatatgggggataaaggagacagaggaatcagagatgactgtgagttttcagaaaaacagattaatttaaactcttcttccaagttcacagtgataggttttgacctgtagctgctactagtgatttgcattggcaactgtggtgtctagattaggttttggcactttaggactccactctcttgtttgttaaaaacaaaacaaaacaaaacaaaamaaaacttgaatggaagcatagaccatartgaagtaccaccctcgtgtgactttaatttcacagtggcctatgaaaatttatagaaatttggcttcatttctagtggctccaatccggatgccaaaattgccctattgttgcgacatcccttgagtggactatcgaacctgttattcattaggagcagctgcaaaccatcagccaagttcccatactatgccaacaataacgccagtcaaatttcaaggtaactccaggtttcagaaatgtatgaatctcaaaatctgtctagccaaactcttatttgtatttttatgtatgcatattatatgaaaaaagctggtggtttccttagtttccataattatacattgcttcttttagactataaattgagttctcagtgttggtgaaggcatacctatagatcttagccaatcactttaaagtgaaaatagaaattcagtctggatcatggtaccaggggtagccagcccaaagggcccattatgatgaggcctatattgaaagcaaaaattcttgcatacctgtagtgcattttaaaaggattttccaagtaacagttaacatttgttaagctttcagaaaaacttatttctctagtttttaatattaaggaaatatggaaatatatgttgatactttgttttttactgacatacttcatgactgcatggctaaagccacaaaacactaggcacttaccactttctttcttttagatatatttagccactgcatctggcctttgttgccaaatattttttcccttttactctaactactccatcaatttggatctttaatggtcaggcaaattttgaatgatttcttggaagatgtgaaaccctgttccctaatcaggaaaatgtgggcaagtcttatggtatgagaaaagaagggacatctcttctaacaaagacaacaggattatagcgccattacacaacatcttcaaagtttttatttgaaaaataatgatgtgtttggtgatgaacaagtaccgtaaatgggaagcatgggaagtttccactctttaagaatgtttctatgcaaaggaggaaggaaagcttactttttgtggttcttcagagagattacattaaccatttgttgaaagtttcatttatgaacaacattggcttctaagagtattcttcacacactggcatcctttgtatgatgttgttgtaggttgtttagcaacatatcaaaatagttatataaaaagattaatatgtgtttcattaatcctaaggagagctttctgaaattcatttttaaaaataaatgattagcatcattctttgaaatttgtgacttctgagggtgggaaagaattaaaaaagaagctatcttttcaagcagtttgtgatttaataccagctggtcaagtgagttgaaaaaccttatgatttttatgttatattattttgaatgccttttcactctcttgggaagttggctaaccccacagtccttttcccatggtaaatggctctaaaactttgatcttcttataccagtttgccagatgtagcagaaagagcatgtatgtgacctttcctgtgccaattcaacccagctgatgggaaactgtaagttwatcttgcatgacttttatttctaggcattacagcagaagttctggtggtgacctctttcgatgaactgcagagaagggcctcagaagcaagagggaagattgttgtttataaccaaccttacatcaactactcaaggacggtgcaataccgaacgcagggggcggtggaagctgccaaggtkggggctttggcatctctcattcgatccgtggcctccttctccatctacaggtttgtcacaatgttcatttgaattcctttcaaaaacaagggttttccgtgaaggaaaagtccttatgaagtaaaaacaaaccattcaaatgaaaatacttattgttcatggagtttcccccccaaacacacacacccattccacatttggtcatttgtttgtaatatcttctttggcttttctggattccaagcatcayttgtgcattcctttaaaaagctttaaggcttttcacatccacagtgatcccattacattccttatataactaatatattatgtattttcattggaggaagaactgcgttcatgtctgcatttcatcaaagattcctaatgacttcagagggagccagcctgttttmcatgttgctagagaagtggagtaaaaagagagtgggtgacatgatgggggccatctatggtatagtgaagagttagggaattagaggamcttggatacagacttggctctgctcccaaacaactaggtggtcttaggaatgtttcttaaacttctctaggcctcataattttcttctgttaaccaggggtaaagaataataataaatgtacaaaataattttgagattaaatgaggtcaacttgaaaaagatacttaattatctgtaaatgattatctacaaaggtccatataaatatttggtaatattgtttgagagtaacataggacttgtctttttctttgtagttttgattgaggtaatgccaaataactttattggccctcagtcctaggatgaaattcagtattacagtggataaaaagtctaaaaactgagatgtagatgttcagcctagtttaatagctattatggcagtgtcatacgttaaggataaaatatttgagaaacatggggaaaagaagcataactttagtgtgatagcctggcctaagatttttttaaaatgcaaaaataatagcagatagggtttatttgggtctccggattggatttttaatatctattggaaagggaagtttatttattctgcacaattgctatttggaactggagacacagctgcttgaccttaattagcaccctacacccctgaaaataaaaataactggggaacatatgtcagcagctaggaaatccagtcagaggaaagttgtacaaaagtgcagggaaaaggaaagagacattttccttatacagggataagatatcttcccaggggaggaggatggggcatgttaaaactacatgttagaaagttatacgactagttacattgatgtcatagtgctaaaaataatgttctttgcggggtctttagaggtttcaagactagtgaaataatgattgsaccatattcttttggatgattaagcttcccaggagggaagtcctaaaatggctagcttacttcccataatacctccatcaccccttggaataacatattcagcaagctgtggccattcaccatgatttcacggtcatgagacttaaattatggagctggtctgttgctttgtgaaactgggtgattgccagaaacctttatttaagaactactactcataagactaataaattcccaaatgatttaatgcacagtaatttgtcaggattcactggcatttttttttttttttctggcataatgaagacatctggaaacccaagctacaacttaggagtaccagtagaattgtccagcaagggacttcagaatctgttgctagcctctaagactgattataatgtttcactgattttatagccaatccatatttcactggactcttaacttgtataattctattctttcaacatttataaatacataataacattggactttacatagcactttagaatctttcccatgttactttatttgctctgacaacaattcagtggctcatgcagaagggtcattattagccctattttattgatagggaaataaaagttcagacaattagacatattaacatgtttaagttttgcatcctaagaaataaaaacgaaaataaaatgagataaactatgtttgtctacttctagcttattgtttttagaaccaaatttctttgatgagtattctatattcctacctctaattcctcacctttcatttgctcttcagactattatagcctggcttttgccaatactgaaacaggacttgttaaggtcgcaaataactgcctacgtgtcaaatttaatggacatttttcaggccatcatcttacttcacttttatgaagcacttgcctccatcaactgcattttcagtgtttcttctctttggcttccatgacttctttctcatgttttctctctctttcttgcttgctgtcactctcactctcttctctattccttccctatatctctggcttctcactgtgactgtttgacctgtgtatcctcatcatgctcctatgaatgcggttcatacttgtgaagatgtgacttgaaccacaatctacattgtggccatttccaaacccctctctcccatccataccactgccgccagctctaggcctatatattcacctgcctgtggattcttctctgggatgttccatagctatttcagtttcaatttttttcaaaattgacctcatccttcatcttctaagtcacatggtcctttattgcttttttctctttctgtgtccatcatttctaacagacactgagtctcttaggttctgctccttatcagtcatttcaacaattacacacggaacagctccatttcccagcatgactccacattccagcagtcagcaatcactaacacttttcccacgcaccacgtttcctcaaagtgttgtgactttgcatatgctttctcctctgcaaccctccatttcccttctcactgccacacacttatgagtttcttcctctggggatccctccctgatatccacttgtagcccaggtgagttacctcttttttggtatttccacatacatcgttctgtgcatgctctgtatcataatgtcttggaagtattgatagttttggtkcgtgctttggtagagtagactaactgttgtaacaaacagcttcaaatctcagtcacttcacacaataggagtcttttgcatgttcacataatggtttcaagggggtggtcagaatgtggccttctgctcctttccatctgtggctctatcatttttgagatctgagttctctgcagagtcttctgcattcatctgacgcataaggggatagagagagaaagtcgataacctagagggagattttccatggttatccatatctaggcctggatatggcacacctcacttctgctgacattctattgggcagaatgctattacatggaggctaggaaatttggcctatctttatgtccagggtgaaaggaaagtgaatttggtgaaatactgcccagtctgccccaattgcctgtctccacactagactctaagttccagaaagacattgattacgtgtattttttaacctctggattcctatcatctagtataatgtttgaaacatggtaataacttaggaaatgtctacggaaggaatgaatttgtctgaggatgtagagtaaatcatggcagggctctcgtaacaaaccagctgacccggttcctggtgctctttgtccgaactatgtaacccatgtatagtaagtttgaaacaacttgaacttttagggtactttgctctgcatttggaggaaaatattcagatgcccaatatgccagattatacattttttctgccactacacttatgaacaaagatgttttgagttgctgattaaggaaaatagctcccttctctctgaaaagcatttcacctctatgggagtgggtgatactggatttcatctaaaaatattatagaggtcagcaacactagagaacattatattatatatatatatatatattatgatttgttgctgttggattcaaaatttgagaatcccctggagggtagtttgatttgaccagtttgattggacactttgtggtgtaatcatcaatatcatcagccattttgggtctgcagtggtcacacagttgcatgacagatgtcctgaaaaaatgtccattgcttgttgtcagcatcgtctccaggttcattattgttattctctgtgttgccattattagtgttcttgggctcaactttacttctaggagatattccctttattaatgcttttctaatgacacttctttccatcaccattatcaactgagacccccccattagagcttttttagtttttctgatggtaaaatacctttctttgcttttgtcctgggaaatatgttttaagaataaatgcaattaattagagatttaagtcccacagaggaaagcttctctatggaacaatttgtcttgcattatttctctaatttatcatattgtttagtrcatatttcttgagagcttcctagttgctcagaaatttccgagtactaggattactaaggtgaattccatrtgttttttgtcctcaagaaatatttttatgtagccaaaagagamgggggtaagaacatgtaagtgattagtgttatttattttatatttagtgctaagtgaatgattgggggaaagggataaagaaaggaaattactatttattaagcaccaactttgtactattctaaagggttaaagastttgtctcaattaattctttatgtaacccaatagaagtagatactgtattggtatctcttttactgaaggagagacaggttcagaatgatwaatggcttatcatgctacacatctaatgaaagaactaggattcaaactcagtctctggctctaacttccatgctgttagattgtaccaagcaacctggagagctaatgctataggaatctagaggagataacagaaatctgattggggttggttgcactgacaatgtggatttggggtgtgttcaataaaaaggcagaattgaccaagagaaaggaggtggaaagactctctgtaaatatcaaagcaaggtgggactgcatgatatatttgggtaaaacacaagcagatcagtttagctggagccaggcctcctagggggtcagagaaatgcaattctggggtgagaggaagagaccaggcttgaagaattcagggtagcagattaggcagttttaagtctaatgtggaggaaatggagaaccatggaatgtgttaaagatatggggtgaattttacagcagtggttcttgaagtgtggtccctggaatagcaacatcaacctatctaggagcttattgatgtgcaaattattaggccccacctaatacccgttgtatcagaaaagctaagggtggggtccagcaatctggtttaacaagccctccaggtgattctgatacacattaaagtttaagaactactgttttagaaagatcaatttggccattgtgcatagcatgcattagacagggaaggacaggttactcctctaataatgcagatatgaagtaatgagggcatagatgatggcaattggaatggaaagaaatcagcaggaggcatagtatgagaacattagaacttggggattgattgtattcaaagggggaaggagtaggggtccaagttgataggcaaggattaaaatctatgggatgaatctgtatttagttcagcccaaaatttaaaaatcwtaagtttcaaataacaataaggatttgtggttttagagaaaaaccagatttggtgatatatcttgtatgttccattgggcaaacttcagctgagcagattagccatcaaattcttcttgttgatgggatgtcccccctcttatctgccaagttttcccctctttttttatatactttattcatttatgttgcctattcgagtcctgtagatatttgagctgatgatccctgctctaaggatcccagcttggggacaggagaataagaaatgtaggggtcgggagagggagctggcttggagggaaaccagccagtttggtttctagacattttgagtccgaggcaactgtaagatagtcccattaatctggtctttatattttgcaagaaaaacagttcagcatttccatttctctgttgtccgctttttagatcacccaaggcagtttaaaattctaggctggctttcttgcaataccttgggacttctgcctcctgctttcttagcatgcgagctcaagaatgcaaagtaatttttatattagcccatgtaaaatataattcaaaaggtaactctactgaggccaaactgtttgttgtattcccactgccacacatacattttttcctagttattttctccattgccccagatagttgaacagggactgcgacttttaatcagctaaggaagcaaaagactttctcttcactttactgtgaaaattgcatcaccacactgggtatgaactcattgaggtgggaatgagttgttgatagggcttggctttggaaatactactggctgatrttttatatcacttggcctttgtgtactgtattgacagagtatagtgaagaggaggaggaagaggagcaatttagtttgaagatgactaagagctgattaaacattcagctggggagagagatgagtgaatccaggtgatgtttatggagtgtcagagagggagaatgctataccatctggtgagagagacatgaaaaagtacataaatcaatctctataatgatacttaattaatacagagttgataaatgacataattgaagcaatgggtgggctacatcatagagttaaatagcttcaaagagggtgctgattaaagccattacaatttataaaacattcttcatgttaagaaagcatcttgatgagatttcacatgaacattttgtaatcagagggccagcttaaaacactcagagcagaggtgaaatgtcttaagaggtctattttggatgatttttgaaaaccagttattctcagggaataaaaaagcttgctttccccactccctttgttttttaatgggaaaaaaattaatgttgcattcttcacctttagacaatctcagatttttgatgtcctggtggtttggttcttaagcatgaccttaagataattagctatcaagcttcrtttaaattgttttgaaatatcattgcaatttggggagcatatgtgcctgctggtgaaaaataaggaaaataccactgggactcaaaaactgtacaagtgactcacctcgattagtaggcttattttgtttttgcttaactcactctgaagctcataacagatgcacagtaatcaagcagaatgccaattctcatcattcatgcaggtggagggccactgtgctcccaagggggaaccagagaagacccacaacaaacactgcgttttttcttctcatcatcctttcttttccccctttctgatttttggaaggtacattctttgtttggaaagcctttgttagaaattccaaaatgttctttaatcactggattcttattattgtatcaggtagtgtgacaggcatgcttcctcataatggatagagccaggcaatgtattttggagcccgcattctggagactccatgcctgtgtctttgttcagccacttgccagatgtgcctcattggtgcctcagtttcatctgtaaaatgggkgaaatatcttctttgtttttcttcctggagttttgagggttttctttttttgtttcattttgtttttgtttttctgaggcagagttttgctcttgttgcccaggctgcagtgcaaatggcatgagttcggctmactgctacctccgcctcccgggttcaagcgattctccggtctcagcctcctgagtggctgggattacaggcacccgccaccacgtccagctaattttttgtatttttggtagagatggagagtcaccatgttggccaggctggtcttgaactctcgacctcaggtgatctgcccgccttggctcccaaagtactgagattacaggtgtgagccactgagcctggccttttgtggggtttaaaagcagtaatgttattaatgcctgacctatagtaagttttaagtacatgtaaagttgctactattatacagtcttattaactattgactggacatagttattgaatgaaaaggaggaagggagggaagcaggtaatcagggagggattgagggaaggaagaaagagaagaaaggaaagaaagaagaaggaaggaaggaagaagaaagaagagcttgatttagttaatgtcactgttgtaattggtggattataattgaagctgtctggttgggagacaaaccctatgccatttagatctctgtctgttcagtttgtccaaactctgctggggttatgtatttactagtctgtctccctttttggattggcaattctgcagacagactgtgtgtcttactcatctgggtatcgccagggctgtgctctatacctggcacacagtagtgctggaataaataaagagctggaagcagcacatccctttctctaacatgtaaattcaaggtgtcaccatttcacattcatagacattgaataataatgtagatgaggtgactaaccttttgaattgctactcatcaaaaatggaatctctggaatctgagaggagactatatagttatgtaaatttcggcaaagtattgcaaactccatattactatggtgctttgtggggctgctataattaatggtctgtttgcatttctagtacaggctgtcatttttcatctgcttataaccttgatataaacatttattcttggctgctattttgcattcataattgtaaaatatatataaacgttaaccttctgtttttcagcttttttatttatcaaaagcacagctcaagaatcacatcattgtggcatgtttttctgaatctctagtggcaaaaagaaatgaatgcattttgaattcaggcttcaggattaaggcaatgttgtttgcttatgcagtgccctttgaaaaatgtgtaatgtagcatatgaaccaaaagaatcctgagaaactttttccagccggtctttttctattacttatgccttttttatccctctgtgttcctccccacctctgtcatcagttcaagatgactcttaaagtcctcttgcatccatccaaatgacccattggcctctttaggtgcctggagaaagtaccagcaaaggtatttgttggagtctatcaaaggtaacaatacatagagtgggtttcaaaatcagacaggctgggttctattgttggctctcccatttagatgctgtgtgaccttatgtacattaaacaaccagtgtgagcctgttttctcatctgtaacatgtggagaacaatgtttacctcatagagttgttgagagaattaaatgaaatcaagcccttgayacagactgaaacatgggaagtgattgatgaaatataactgacgtcttatcttggccatggtcattattatcactgtcatcattagatagtgatgggactaagctaggtaggttgacatgagctgacttatcttaaaaggcaccagctctagatagagccctcctcagtgttcaaagactcaaaagacttgggttctgtttatctcccgatttcgggagcccactctccttagtctccctcagtcattgactaaaaactatgcacttgtcttttccattctctctatcctcatgttaaatgcttgatattgttcttgcaagctgtaccaaagttgtggtggcccaaatcagtatcagtggccagcttacccaaaatgcagcaaatattctatttcaaacaatacccaagatattttccacctcagggcctttgcactcactgtcccctttgtctggaatgctgtttccctgctttgtgtatggttggctctgtttcaatctttacattttaactgaaaggttctttttgtgaaaagcctttcctgactatactaagtagagtagcactctccctcaaactctctcacacataatctcctctgtatgcacagaatcctaattatatttggtaatttatgtctatctacctacctacctatctagttttcagcatgtacttctgcataaaaatataaattgcatgaggactggaactgtgtctttcgtgtacctcattgtattctcagtacctaggagattgctggcacagggcaggtacttaagagatattgattgaataaataactattttaaaaatcatctaagacaatagagaaccaattaaacagatacatactgtattatagctatttttctgaagccacattctaaagcaccacagatttttttctcaattttttgttttgttttgttttgagacagggtcttgctctgttgcccaggctggagtacagtggcatgatcatggctcactgcatccttcaccccctgggaccacagacacaaggcacaatgcctgtctattttttaaaaaaaattttagtagagatttttgtggaaaaatataaatctatagtaaggctgaaagaatagtaaatgactcatttactcttctgagatcagacaagatctcagtgtggtatggccatagatgtgactcatatactctttataagaaattgcctaactttttatttttatttttattttttgagacggagtttcactcttgttgcctaggcaggagtaaatggcgcgatctcggctcactgyaacctccgcctcctggattcaagcgattctcctgctttagcctcctgagtagctgggattacagtcatgcaccaccacacctggctattttgtatttttagtagagatagggtttctccatgttggtcaggctggtctcgaactcctgacctcaagtgatccacccacctcagcttcccaaaatgctgggattgcaggcatgagccacggcgcccagcctcctaactttttttaaggaagttgtaccattttatattttcggcagtcatgtgtgacacttcaggctgctccacattcttgccaaaatttaattttagcctttttggcagatatgtattggtatatcactgaagttttgatttacatctccctgatttctgaatccctctttgtgaaaagtctactccaggcttttgcccatctataatttttttaaaaattactgagtggtaggagttctttatataatttagatacagatccgtagtcagatatatgttttgcaaatattttctcccagctgatgtctttcccatcttttgtgtcatagagtcttttcttaatagtgccttttgatgagtagaagttttaaattttgaagtctaatttatccacttttagttgctttcttttatatgcatctacattcattactcaatattttgccacatttgctttctctctctctctctctgtttctggatcatttgaaagtaaggttgttataacactgaaaacatttcacccataaatatataagcatgtattcataagagcaaggaccacctctaacataactgtaatatctttgtcatgcctaagaaatttagcattgctatagaaatattatttaatttaaaattcatccatattcagattttcccaattgtttcccccagtaatgttgttgatcttttctttctgaattccataatccaatcaaggacatacattacatttagttgtcataaagctttagtctccttatatctaaaattgctccctagtctttttagtattttatgacactaacattttcaaagaatataagggagttattttgcacaatgactctcagtttggagttgttcctcattattagattcacgttaaatatatttggcaagggttctatatggataatgtcatgcccctcattgcatcacataaggaaacaaataatgtcacttttccttattggtgagaccaaatttgatcacttgtctaaggcattatctctggatttctttatygaaaggtagcattccacctttgtagaggaaatacattgcaattattgtgggatgctcttgagactttgtgaatcttaagttctttaacaaaatttcacccagtgagattttaacatccgttgatgacccctgcctgaatcaatcattgtaytggaagttgcaaatgtttttctaattcaattatttctattacaattatttgctgtgtgcttttgtaataaagagcatctgcctccttttccttctttttgtttctgatgatcacttcatgggtttttaaaaaatgtatgtgataaaattcattactatcatcattctttttgataaagcatcaaaaatttcaaaataattaatgtaaaagttagcattacatgataagcttgaatatttgaagcactggaaggaatactctttttattcatccaaagttacccagactaccacagataagtcaactaattaggagtgtgtaatcaatatcatttcctctgaactttttattaacagcatgagctttggggtaataatcctgaagttatttttagtttacaattgccaatgtatagaatatgcaaataaagatccttcatcccatacataattgctgttaattgttaaaataagtgagcaaaatctcaggtccagcaattgcttctgagtttctgcagactgatatttgttttccttttttttttttttttttaaactatgcagctctgatgttgaggagtatgaaaagagcttttttttttttttttttttgcaagagaaataaggatctcaatataggtttgcagaggccarcagggatgtatctttaggatgggtttacctcatatctgtgtaatacagagaactataaattatccacccactccaacctccccatgtcatcagtggttgtgaaggggtaactagcctctgcctgggtgtcaacagtaatagtttaatagctcagtgaatgtctgttgcctcactggttactgctccgtagagtaaatatttgacatcaaggacaagaatttaatttttaactttctcaacttaattttattcagtaaacatttattatgtgtcttctatatttcaagccaggagaagacccaatttttgtaggggtaggaacttacataatttgggggcctctttaagaaaaacaatacaaagttacttctacacatttagatataaaatcaacatttatttacaatagggaagaaattataacaatttatgaatttaagagagccaccaaatactacaaacgtgacacaattcagaaaaatatcttgttttgattaaataactacctatcaagctgctgtactttgtctgcattttttatttgcacattctttgattgctctttgtatgacagtgcttttgtgttgtagtttctaaaacaagaataaaaaaggaattcagtctttcctgtagtatggttgatcataatttagcttttattattgatagtttggaaaagtttatttcagctttatagcttttttattggtagtatcattatacaattttaggattgttgtcaaatttgggaaaatgttatcaagttttgttcatgtatgggctgtaagatttcaggacattttatgtttttgtatagtgacaatgaatgaacatcattccatttagtttgctgtctagatcctcgtttttagtggcattttatgaatttttgttatgtttgtatttgtcagcattttgtgtcaaaccaacaagaaatttcaatcttttctcaaggtgatgtactttttcattatttggcttattgagtgatctgtgagactactcatcccaaatacccaaagtatgtctctttctgtcaataaactgtagttttgtatggcttttgtctgggaatgccatactttgtcagaataagatgtggtgtatattttaacatgtaatccaatatgttaacacaaatraaactgtgacttcatacatagatgcatttgctctttgagctctacaatcacaggaattctgataaattctattttgcatgacttccttaaaaatataaaattagaggttgtgttcgcaatagcatactctgaattactgaacctattcttgataggagagaacttccattttaagtaggaattaatgaggattggatacctcgactgcagttctgcatatctgataactggaagcattttccagtgactggcttctggatctccaccactgtctccatgctttcactgccagatgttgcaggatgcattcttgttacaatatgacctctgaccctgtgtctttgtattatgacactagtagtcccgggacacattcctgtaccaagatggaaacaactgtgaatcacctaagcacatccctgtaaacccaagccaatatatctccaggtcagcttctcctagctggatcctcaatgcctatagtcaatccagtgctgctccatatgttgggaagtatgacagaaaggaagtcagagtggattaaaagattccacacctttggtgtgcatggattggtgcagcccttctagtgagacatccccagatgttagctgataacatcctcaccctcatcctccccaccatcacttctctatgttttactggcctgatccagtttttggtggcttggcacttggaattctttacaagcactttctttctatattgacttactatcatttttagaacccagattttttaaatgttcaagctggatgaacccttatacatttgctctactctttcattttataaatgaggagcttggggctgaaggtcattcagctaagtagaagaacaaggacacattattttttagctctttatgccatctttcttttctttcaagtctccatcagactacacccagccttccaggattaaagtaagttaattaggcatgcattgatttgatctccgtaggtcccccctaaattgatatttttaggagttagaatattcaatgtgctccccaaatgctacgtaatagtggttttttgctcattttgatagggcttttagcagagtgaactgtttcgtggacactgtcacaggaagtggaaactcaccttgtgaaaaggtaagctttccatgggctttgagttttcctttcctcagcaggggaagggcctatatgtgttagtgttagctgcctggccttcctctggggcttggtttttaatctccagggaggcaaggctgacaaaatgtcatctatttgcctactaaggaaagaagctgtgaaatagatctccattgcttatgcacctcaagtcgcttagttccagctgtatccataatatcatggtgtatttaaaatactgctcattgcaatccttttgaaaagagattctgatgctcgtaaatactccaaaaaggcattaaggtgttacactgatttttatttttwttttattttattttwtttatttatttatttatttatttatttatttatttattgagatgcagttttgctcttgttgcccaggctagagtgcagcagtgagatcttggctcaccacaacctctgtctccagggttcaagcgattctcctgcctcaacctccctagtagctgggattacaggcatgtgccaccacacctggctaattttatatttttagtagagacagggttgctccaagttggtcaggctggtctggaactcctgacctcaggtcatccactcagcctcccaaagtgctgggattacaggcatgagccactgcacctggccgctttttatctttaattggatttattccctttagaaaacttaagtttgtggattcatatccaaatattgccctttactgatctagctttttctgctgtaagttctaggaaccttttaattcagagaggggwaaagaaaagagctagcatacactcaatagcttttatgttttggatgcttcataaatatcacctcatttggacccttacaagagctttgggaggcagggagctttagacacattttacacctgagtaacttgatcaggacattttgaaaaaaaggtttttgattatctgtttttcaacttgagagagtcgtgagataactaaactacaaatgaaaaatacgtaggtaagtctctttgtaaggtcatattcgtaaaggttgcaaaagagaccaaacaatgtattccaattgagaagtccaggtagagtatttggttcatttgtgctgctrtaacagaataccatagactgggtaatttataaagaatagatctttatttctcacagttctggatcctgggaggtcaaaaaacaaggcactggcagcttctgttgtctggcaagggctgttctctgcttccaagatggcaccttatttcttcatcctccagaggggaggaacgctgtgtcctcacatgtggaagaacagagggacaagtgaaccaaatctttgtgtgaaacctcttttataaaagccttaatcccatttatgaggggaggagccctcttaaaggccccaccacttaatatcatcacattggccattataagtgtcaacacctgtattttggaggggacactttcaaaccatagaataaagaaaacgaaagggggaaaactgcaaacaaatgtgctatgagattagatggatttgaaggggactcgacagtcttgggccytttgttttggaagatggattttgaaagttatcttttattgtattcctgtgaggcccatttgtttcctacccttttctcttgtccccctcttccttctctttattcagtatcttcctctggcaaatagcagttactaaatttggttctctgttatcttccaactcgaaaggcaaaaggcacaggcagtaccctcctggtaattatttatgatatttctccttccagagatttgccctatggcagcttcaatccgttaccatcactttttatttttttgcccatattggcagcttcccaagactttgggaggaaaaagcagatctgcagatacgcaaacctcaaaatcaagacttggttaatgaaatcactcctccacttgcccttgcctgttactgaatcctgttccagctgggatggaaaaagtgcattggtcatgctgtcaaaagcatatcacatttctccactgctatttccttccttcttaactaaaaacaaaacaaaacaccatagacaacaaatagacacacacacamaaaaaaagacactaggtgagagtgaaggtagtttgtactattttcatttttcgtgtgttcaatcgtatttctctcagcaaatatgattggaagtggtgcttttccttccttccccaccttccagcattaggtttgtaggtgaacataaaaatacactgacactcaaagaaagagctctttctgctctgcacacatcccatctcgccctcttccttgctcctgcttatttctctctctttctgcctccttacctccttcagtttagagcttagagaagtttttcactcttcttttgacaggtgtcagatagacagtatgagctcatttaagctgaactgtctgggggaaactaaatttgttcaggagaatagcaatttggatgacaagtgccaggacataccagatggcacggctggagaaattcttatcgggctcccagctcacgttccaggcggcctctctgtctctctcctctattcttatttgttcatggttgacccaratggaaacttgaaatgcaaatgtatttcttcttggaagtttccaagtaaaaaaggtgatagtgactcagcataagatgcttacatgcccccaaaagaatagccagtacttgttatttatgcttattactactgatgcttcccagacccctgtgggcacatatttgaagaagtcttaattgtgagccctaaactgattgtgtaattccagttgtttactaaaataggactgttacctaagctgcaaaatatttgatgttcttgtcaggatgtgaatggaagtgttcttaaacattcttcctcagttgccacacagtttgactgattttgttggccctcactttccagaaagggaaccgtggacataaatgtcatgggaaggtatttagtagaaggtgtgatttttgggggcgcatatraaacattctaaaattcaaggccagggcgctgtgacaggctctaatctatgaatcattatattcttaacatattctgagaacaggaagagaaagctcaacctttatagacacagatggaatttctcctgtgaagactggtaattcatgtgacatttgctgtttgcttttgtttgcagtcaaattctttctctcaaccttgcactgtgctgttactggtcacttaacagaccttctgaaagagcaatataagtttatattttaggtacacaaacaaagcagatgtttataatactgggcatgatttttttttttttggtcaatatttggttcacatgagaagatcaactttttctagcctgtatactttggctctgaatttacgtgttttgaaaggtttgttgttgttgataatttagtgatgaaacttactcgtggaaaaggcttattgtgagtgaataaataaatagtataggctaaagtgtgtgtagcctacattatttggtagtgtagtgtacactccacatacttttatcattttaattttctactaaattatgcatgtcctggtattaggattcccatagtcatggcaaaaccaatgatggtaacgccatacttatctggaggttaaagtttcattaacaatttaaggtggaaatcagagaagaaggcctctgagccagcctaatagctattctaaccccacacagcaaggtagtatattgtattgctgctcttctcaccaagagcttctgggcctttagcacattatttttaacatgtttaaatttctgggttttgtggacacatcacattagcagatgtgggaatgatagaggttattttgacatacagagaggagacaagaaaacggaagtgtaaccacaaagctgggttgccacatcctatggaggtgtaaattcataaggataacattgagtcacccagaaaagttgtattgtgtcttccttttaagaaacaatgtgggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagcagggcgtagtggcgggcgcctgtagtcccagctacttgggaggctgaggcaggagaatggcgtgaacccgggaggcggagcttgcagtgagccgagattgcgccactgcactccagcctgggcgacagagcgagactccgtctcaaaaaaaaaaaaaaaaaaaaaaaaaaaaatgtggtggaactaaaagcccagtaaaagtgtaacatgaaaggaaaggctatgttatattcatccaatagggtgtgtgtttgtgtatgtgaatatgaagaaatttatcataaagaattggttcatatgattacagaggctgacaagtcccaaaatcttcagggtgagtcagcaagctggagacccaagtgagctaatgctttagttacagtctgagtttgaagcctgagacaggagaactgattgtgtaattccaatcctaaagctagcagactggagaccaaggaagagttgacgttttacttcaaatgcaaaggcargaaacattcttcctcaattgccacacagtctgactgattttgctggctctcactttccagaaagggaaccatggccataaatgtcatgggaaggtatttagtggaaaatgcaatttttggggtccatataaaacattctgaaattcaaggcttgatatcccagtttgagggcagcagggcaggaggaattctctcttccttggggagggtcagcctttttgttctatttgggctttcagctgcttgaatagggtccactcacattgggaaaggcaatgtgctttgctcagtttacaagtttaaatgataatctcttccaaaaatgccctcacagaaacatccagaataaagtttgaccaaatatatgagcaccctgtggcccagtcaagttgatacataacaatcacagccatccttccagttagtcacagaaagataccttcctgcatctagacaacaggcagctgctgaggagggctgggaacagcagttcatgatctggtatcagatcatgaacccaggggtccagcacaaagacgtagatccagccctgataggagaatgcctggtttttagaaatagggggattagcttccaaactataraaagaattcattcatccattcattcattcattttaaaattcaggtcttaattcaaatatcacttccccagggaggcctttctgatacattgtctacagaagtcctttcagccgctctcatttattcattcacgaaaatgtatcaggcctaccctgtgaaaggcactgggaatccaatagtgactgtgaataacaagcaaggtcccttccctcacgcatcttacttactagtggggacagacagaaactaagtaagcaaataaagaaggtaatttcagatagtgataaatgccataaaagataaaatwgggtaatgcattagagtgttgatttgaggacagggggaagttacactagatacacccgttagggaagacttcyccagaagagcagtcagcttggattgaaggatgaaaagtaaaagctccattcagagctcttggggaagagcctcttaggcaaaaaacagctggtgcaacagatcaacggacagaaccatttggccagttctgggactgaaagaaagccagtgtgactggaatacactgagcaagggagagaaaggtcagagaggtgagcagagaggttggcagggcaagatcttcatggaaggtcatataggccctgattcagagcttgcattttatcctgattggaaataagttttaagcagaggagtgatatgatctaatctgtgctttgggaagatcactgcccagcgggacacagattgtgtggagcaggaatgttgtaagaagtacagacatgtaggaggctattccaatagtccaggtgagaaattacgatagctgggctagggtggtagctgtggagacagtgggcagtgggcaagcttggctgttctgtgaaaaagtcttcaggaattgctgatggtttggatataaggggtgagaaaaataaaggactcaagagtgactgctaggttttattttcttaatggcacatatttttatttgaaattatcttgtttatttgtgtacttctttactgttgatctccctcatcaggctgtaggtacagtgagagaaggaatcttgcttatcgtgttcactgcctcagcctcagtatccagaagagcacctgttccttgaatgtatgtgtatataaatattgattgagtacttagtatggaccaggcctgtactaaggctgagatacagaggagaacaagacagagatgacccatacgatcatggaggctgcattctggcagaggagatagacaataaacacatgaactgagttgtttcaggttttcataaatgctgtgttgacaaaaggatgaagagagtggttaaggaaaaacctcttctctagtggttctgttattctacatgtattcactagactctaacatctgtgaaagcaaggactaggtcttatattcttcgtgtagtgctaagaagatagtatgtgcccaggaaataaaagtgggcttgtcaagcctggaagccatgctcagttcctggagcatcctcagtacctgttttgttatctatgtgatgtgacctgctagggaaattgtccgagtctctcctttcttgtgtaggttgacaatgcctagacccatcagtctctgcctggacaggcctgtaatttaactgcctgcctggctctgattgctaataggcatgggtagccacctatggatttgcacagccacacacggccttgctgcaaatttagcagcagatagtgcctcaaggtcactagagaagaaatgaatctgtaaggtgaataaactaaggccaataagcatagagtgccagaaagtagtgcccagagggatccgaggggcatctgcatgtttattaataaacaaacacacaaaaacccccgcctcctcctctacttaaggaacacagtgagatctcctcttatgaagtcatttctcccatgacttctgctttgaacagaagattttcaaaagagctttgtttgcccttaagcagtcttatcctcagataaggataaacgatcagaggaaaatttcactgggttgttggtcagctatcaaaatgaaaaatgaaaaatctttcttaactggagtaagtgtggaatgcttgaatagtgcagcagcttttagtcattcttttacaactgctgtacacattgcagccagaaaagacattttagttgtcaggtagtcaataaatatttattacmtgcttcctgtatactggttctccactgggaactgttcctaaaggtttgttttcttgttacttttcttgtccctgtgttcctcataactcaaaactgctgacccatttaggaggtatgggaaagcaagattgatcagaaagcagactgggaagagacaagtcatgataattcttatgctgtcaaaaactgagtttagcatcatgctaagcaggcagtattcaattcataattcaaaactgagtgtcgcagtgaatggggccctgcaaagtcaatgtctgattgttttcttgctgataagcaccatgatcagaggtctcttcactttggcttaaatcataaacatgtttggagcacctaccatgtatggccactctcctaagagtgargtaggatattgaggtactcccagtgtagtgtctggcttctggggactcagtgttaaatgagtgtggagaagatgtgtatatgaagactgtgtcttaagggagaatgtactaagggaaatatgaagtctggtaggtacacaggagaaggagatattaatacttcctggggggaatccaggccttactagagatccttctgcacactgtcccccagctcctcactttgagtgtttcttttggattattcattttctctatcttgtggcaggcctcatcaagactggtatgtgcatctgtgtttgcttttatcagataatcttctacctactttgagtttaccttctatttctaattccttgcttaacttctgggttccttgcacagcagcrtctgatatcctgcatgttagttctttgttttccctacccaactgaaaattactaatgcaaaattatattagcaaaatgggcataaccagaatcaccactgctggggtagttaatgagcagaggtctcccatttgcttcctgcccaccagtctctctcctgccctttcaaggcagacgggttgctggctcactaatttcccacatattgcaatcttttcctgtgatgcagaaagctatgtgtatttccccactcctgaggtgactgaactgtttaagtagttttgataattcgttgctttaaaaaatacacaaagatttgaataatatagataaatgttttccttgactacccacaccaccctattgaggtcagtattcttagatataacgaacaatgtgagtttgatctatattcttccagactttgttcccatgcactgacatatgtatatgtgtgtgtgtatgtgtgtttgtgtagttttgtgcttttttctaacaactcagctgccaaatgatcagtgcatatagcactacttcattgtttttattctcttgagtgtcattcatgtatttctaactctttgtatgcctaatatttttttgtttgaatgccaggcattgttttaaaaagctattgatgctccataggtttacctttcctctactaggcagatcaggttgaaagactgattgccttaatccaacaactgactaagttgcatcagaacaggttgcaattttgttaaattactttttgttctccctatttcagaagcatggccctccagggcttttgattgtaattctttgtctcctcagcactaagagactgcagaatatcttgtctgcttttgagagatttgggcttagctctttagtcttctgtactgtgcagcttctgaacatgacaaataacttgacagggagaccaactctgtgttcaagtctcctcaaatcttcaatttaaccactgaagccgtacatggtttccagaggatctgctggtttctttgtcccagcagcttccctctgcctgaacctaccctagattccattctctagaatgagccagcttagggtggcaartgtccctgaagttggctgcatgtcctcagatcacctctgaaatctttcctttctataattttactgttgttagaacttttggcttcattaactttctaatgtccttaaatatgtgatttttataatttatttaacttttctagttgtttttagtgggcatgttggcctgccatgaacaacttcattatacttagaagtagaacttctccctcattgcttttaactccttcagattctttcattgcatgatgtctgtggcttatttggccatttccctgttgatagacatgctgatttttatttgtcactgttacagtcttataatttaaaatgaagtacatacattttgtgtacttatttatagcaattactaatatctggaatttctggatttaaaatatggatttttaattttaatagagattaccaaattgttctccaaaaagacttaaatttaaatctcaggggctgaggcttccctttaaataaaccaggtctatctctgatcttataggttggccctagtaccaaacagttctactagtaacattgagagttctatgaactcttttagagactctgagcacactgaaagcttacctgctgtgttgtccttgccactcttacctcagtgctctcctgtgggtacatttagtacctttacaacgtgtgcagtgatcatgccatggattacaagagtttaacacattttctaagacaccaagtgagtaatgtagatactgaggagatattcagtagaaaaagccaaatcactaataatagcatattytcaatatacaggcaatttctcagttgaaaagcttagctattattgctatggccatggcttcaaagctgtgaggttcgctttttatttatattggcaattttcccatgtgcttataaaaatcagtcctttggatggttcactcagtgtatttgaataccttttccaattctctgaagctccttgatccagtaacagtttctttccttggcagaccatgaggagtgggaaagtagctttttctaagtaggcattgattggcattgagcagtgggaaagattggagctggtgaacatggggtgtgcaaatgtattcagccaacaggagctcttccagttcatagggtggatctgctggaatagttgccttggttctcctttcacttcagggtggaattaagctcctggctcaatagggaggaagcaggataagtcttagcctctggacacttaacctaaaattctaaagaaaaattccttattccttttttccttttcaatggcttacctttaaacagcattaatatcctgcctgttgtactgaagcaagaaactgtagtatctattttcaaaactagtacatggattttcaatgtgagtgtcttggtaataaatgctggtttattttgaatttaaaaatgtattttgattttgtactgacagtttaactctttgaaatataacggaggaagggtcagaaataaagcaatctttctttcttctggacttatttattcactcttctttaaacagttgttaaawctctcttatgcatttgacattgggctttgcactagtgatagaaaaatgaataagactgtgacatcttttggtactacatcatataaattgtctagattgtacttctaagccagcatgagcattttagaatataagaaatagaaaccaaaccaagaaactctagttcggagcaaaattatatgcccagttgtctaagaaagggctttgctttttaccagtaatttagaattttatgactaagacaaagcagaaaattgggaagaacagtgaaaagggcaagaagttaatggagtgyggtcagagctgagaggacaaaatctaaatgaaagggggaaaagcaataaggattgaggaaggttgtttaggtcrttaagcttacaagatcttctatttcccaattagtacattctgaccctgaagacgtttaagtacatgacgaggatgtcactggagtgtgacaaattcttcacattctcacttccctttgctaattctggcgtcagaagttattgcagagaacatagtcaaccgtctgtggagatacatctaaaacagatgtgcctattgttaaacaaacatggtatgtttaaatccatatttatttattaaacaaaaattagataattactccgattatctggtacccacagggatcatacaaatgacaaacacaaagggccagcactctgagaatgagaagcctagagagaggccaggctgggatagtgccaaccctgacataagatagaatataattaggactttaaaggaaatacaaacaaatattgtgggcactcaggaagaaaagcacttttggtggttgtggatacaggtagagggagaaagcacaaacaactcagagaaactttcttgaaggagatagtatgctaactggccatggaaaattgtttgaatatcaacaagtgatgggatctcaacagggataaaggatacaggtgtcataggtaaggtagtggcataagcaaagccatgaaggaggacagcttgtttgatgactagcagtgtgtgttataggagatggggtggaggatgcagagaaacaatgtattttgagaccacacaactatgcctttaaatcccagcccttccgcttatgcatacgggaccatgcctaggttgcttaacctttctaaatctcagattactcatctttaatatggggacaataatattgatttttgcatttgtgtgtgtgtgtgtgtgtgtgtgtgtgtgtgtgtgtctgggagagagagaaaggagagagagaggagagaaagactggttataatctatgtaaaccttctggtgctcaataaatggtagtaattattatggcaagtagttaggctatctcaattttggacaatgtgttagataaaataaaaaaaataatttgtgatcaaattttgggtgatcttaaggagctagtttaggaatatggagttactttgataggcaytggaaagccattgaagacttttgaccagggaatgatgtgattagggcttagaattgcagtgctgattctagatatattgtagagctacgacataaaggattagacaattagatatgaaccatggtgtcagacacctacatatctgttctttactctcttgcagttataaaaaccctgatttttagctggaaacatgactgtctaaaatgaagaccctatttacctgttttgcttgtggctaagtgtgcctatgtgacgatgttctggccagaagtatcatgcagtagcatacctaaaagatggctggcccaccttcttctttatcacttcctccatcctgcttcttagattacctgccatcttggtctaggtccagctgctaatttggaccctagcaatattggagggatgaactggcaggagactgagtcccaaagaacttcatggaacagaattctgccataccatcccttgactaaatttcactagccttctacatgagaaaagaatgaactaccttgttgaagcctctgagattttgagattstgttacatgcagttgatcttacaatctgattctaaccaattcagatatggaggaaataaatgaataagaacttagtttctaggatttcaagccagtagccattataggaatataaggaaacatgtttggagcagggggaggatgatggttttggtttgggattcaatccaggtggagatgtcaggtaattggaaacaaatgtcaggagcttggaagagaggccagagttggaggtttagacttggggtgggaagcaggactttaaatagctctgatagttgaatgtatgataggggaagacattttcaagggataaaagtataaaaagagtgcaaaaacctgaaggctgaccctggactaagtgtctgcttatacaggtgaggaggcaatagagatagtgaaattgggcaggaagaggtgtggtgaaggtgagggtaaagggaagaagagttgaggctgaattaatgagcttatttcttttgcatatggcatgtaggagaggaaaaggattcctaggtttmtcatagtcaagaatgtactgattatatgcatttgcttcattaatgaatacagtgctattttgtttagtgtttcaggaaatgctttgattccagcattgttttccgcttttaatgcttggaaacagctttgctaggctcttctcaggtgagtagctgcacgccaaagtgtctcagtgacagcattgctaaggagttttatggagaatggatggtcttgactggaaagtcacttaatggcttttaaagttgtgagcagatgatcatactgtataagtgacagactgtgaagtctgagacctcatgaatggttttgatgttggcatcagataaaattactaacaaattagatctgacatattttaatggtatgtataattattattggtctttgtgattataggctacatagtaactgctatcactggtaatagccagtattacttttgtctggacacacaccagacatttacggaaatagctggaagaagaatgatattgagaattgagggagagggtggtttgtgccaaaaggaaggtttggaagaggtggacactattcctctctcacttcctaactggcttattctggagttggaggcctgcagtgcctcaccctgtcaagctgacctaggcacctagtatgtttagctgttccagtccccactctccagatttggccacattctcccagttggaaatgatggaagatattgccatctggagttctctgatttcctgtaagttcttggagactttatgcatggccccacccaaagcttttccttcaccccaacaggagagaaggaggctgcagaccacagaaacttcagagatgatgatttatgtggactcatcagaagtctaaaggggcatgtctgtgttcttaaagggtacgggaacctcagagagccaattggcccaagaagcagtatgtagaatggctacatattctatattttcaaagatcaaacagtgcagagtgcaagattataggaaacccaaaagggtcacaaaccaggataagaaaatatcccattcactgccatattttccaaacctaaaagagtgcctcaatcaatgtttgttgagttttaaataaatatctttatttcagtaatatttaaaaatgtatcctaaatctacttgtyrtctgtattttcaaacatagggaaataagcaccaatagctaattggaggaataggatgggggatggggcacagcatgaggagaggagtgagagtatgtctctcccagaaaacatttattgtaggtattgattcaaattccagttcctttcattcctagctgtgtgatactggacaagttacttaaatttgagccagagtgtctccactgttaaactaagtaacaatatctactttataagattattgtgtaaagtaggtaaaatttatgagaacatgcttaataaattctaagtgacaaaatgttaggtgttattactgacatttataacaataataataataataaaataataaagattggaacatggccagggagtggtgaggggtcatagcattggtgtgaaagttggatttgaatgtgagtttctctggctcatatggtaactctgcctatccaggatttaacttagaatcaacagctccccaaacaacagcagagctctatccagtttgaacacttgaactagttcttttactcagtgagaacctgtgagtctgtctggagtagagaggcgggtgttgagattaaaccaccacagtgggctgtctctgtcttagggaagaataacagagaaggagtttctgcacaccagtctgacttagagctgagcagcacatagacgtgtacccaggtatctcatgccttatgcccagcgggacccttcctggtgtgtatggtcgatatgctaccctgtggagggtggctatttattgaattcctattccactcaacttcagtttatctgactttggaggggttgcaacacggccttgcctcttatgctgagctttctttggaattgctatgtgactgtttctttgacagacttagttagaaattcagatgatactgatttaaaatagacccgtggggtttgagaacagttagagagagcacagatgagaaggagaggttaaattttttctaaactcaagttgtcagtactaaattcattatcccccattaacaggcataataatgaaaataataatgtataactttttcactccattcactcatttattcatgaaatatttattaagtgcctatgtactagagtgtatactaaatgctagacatatatagataaatagataaaccatgcctgtcttagggagtaaggtggaaagcctgagggtggcatgtaggttagtctggcatataatctcaacaagcttttggaaagatgaaatggttgtacttagaggcagaaattgcattggttttggtcacagatgtagcctacctccattgcctgccacagaacctggctcagctaagtacccaatagatgttttttgaattggcttaatatttctaattgcatgattaagtggccagaatcagttaatttaacccatgagtccttttcactccttttacagagctagaaactttttgtggccagtcaacctggtaaccaaacatttaaattctggtaattggtaaatatgcctcgtcacaggtttgttgaatgatttatttttcataaaagcaggaggttcatgacaagctcagcaaatctgttggcagttttaagacattataccgggtagtttagggaaatttctcagcacatgagaccctttagattatgtaatattcttgcaaggcaactaggaaaaatagtttttaaaattatgtctattttgctatatttaaaagcagaaattatcttattatggagaattgattaaatatttgatagcatttttgtatgatttaacatatttataggtgttaatttctcacaaaatttaagttatagctctaagtgtagaattaatagtttccctttgattacagtttttttggtgttaacgttcatctatttttggatgatttgacttacccttcctttttaaaattcagactctaaatttaaggctatacatcaccatagtgtttatgaagtgaattaaatcttacagaaygttccagtgcaatctgaaactacagcaactacttgaggttttatgtctgaaaagtgttttaatcagtgatggatttggaattattgcagctgattcctgaattcttaggcctaggccttaggaacacactatccagatgtttataaaatgccattttaccaatgtcctgtttatactttgactttgtggttcaaaaaaaatacatttgcctacttcaaagtaccagatgaaagtattttacatcaactaaatactgcatttgagctgcccaacagtccctaacactgactccttctgccttaaaggcatttatttcctatcatcacctgttttctccaagacatgtgagaagaataaagcctgtattgtggcattttgtgtgaatgctaagwtcttggcaatgtttcttataccttccctagctcttctattttccctaaaaagtattctctttttgaaagaaaaatttaatttctcaatttcttaaaccagattattaattaaaactgcaaaatgaaggaaggaacacccactaattcttcaaagctcagcaacagaatcaaatcctttgaagatctgtctgcttaactcatcactattaatcagtttaagactatttagaaaaggtactgagagaaagaaatgaataaaaatgggtgaataaggcaatattaagctgacactttatagtccggttggtagagtaaaaaagcaatcaaacttaacagctttttaaaaaattaagaatgttatataggttgatgttatttttattattataaatrtaatatttactccttttgccaacttggaaaatgtagaaaagtcaagaaaaacataacattcatccatgatcccaccacccagacaaaaccacttttacctttcccctattttttaagtcattttttgctatgtaattaatcaatttgcataaatacaaaattgaggtaacggtatatgcacaattttgaaacatgttttaatcactttcttgtggcattaaatattcttcaaaatatgtttttagtggctgcagagttatgttatgactttctcatcctttagttggtctttagtgtgtttttatggtgtccagtttcagtattcatgttgatctcctttcaccctttgtcttcactgagtcactcttggctcastatggtaatcattagcactggtttctagatatttctggctcttcacctgcacataaaacagggctgtacatctcagtcccttggagtttgggtgaggacatgtgactttttctaaccaatgagatgtgagtagagcatttaattactgatgagagagacctttcagagtgctgtcctctttgccacagtgactggcagctttccagagagtggctgctccattagcgtggatcccagagtgaggttgaggccaacataaacacctaattggcctgggatggataggtaatgtgagaagaaaatgaaactttgttttagtgagtgaaatcttaggggctgtttgttatcagtgaataagtttgcctgtcttaactgataacaccaatcatttgtatctagattgggaatctgatttagaccttgtggtcatcttatagactcatgttcaccttcacatctgtaaattatgtggcaggtcatcatatacactttctcaaacaattggggaatctttgcccctatgcatctgttttcagggtgtttctttagttgacttcaggcgtattcaataactcatatcatatacatacataaacactcataccttcattctcacaatgtttatgattagccttgttcatacttttctgttgcctaggaaaatgtcaatagaaattttaaagtaaagactgattttttttaaagtataaacttagtagttatatgaaaatgagaaaattcataaggaaaaaatcctgtcatttcccctgccattcaaacctatttttattatcccatatttcctctattccctgtgtataaaactttatattgcttatcatagtttacatacaacttgacattttctatatatataaaaattttcatgtttttcctacacttcataattaacattttaatggctgcaaaatattccactgaaattgaacaccgtaatttatactacaatttccttattactggttttttagtttgctgcaatttttttgaaattctgttggaataaataatttttagagcattttaaaacaaatatactagaatgtatacatctaatcagtattatcatataaataacttctaagtctaaacacatattctaatgcaggtgccattgatataaacatttctaatctcttttaaaatggtctttatggccaattgatgagctacaaattaaaaattagtctcattattttataatatatcttgatttggaccccaaatcattcattcattttgttaatcatattttggctgttttcaaaagttaattctaattttaaagcaccaaattttgccttcatttagaccatttggaaggctgccaaatgctctaaaggcaatttcagaggaaaagttccaaaactgttaacagcactgggcaattgctgcgataactgagcagcctaccatagtgatggttttagagaaaaaaacactcctttttaaatgtgagtttgagtggatttgttactgtaatcattaaatccacaactctatagtcacactgggcatggatgtaatattgttcaaaataaatgccagttgcttgatagcagggactgattctttcatgacatctacattagtgccttgcacatggtaactacttaggtatatttgtgatcgagtctgtgaaagtgatccctgttgagatcacactttttccattggcaaggacctatctttgaataaatcctttctgctggtgaagtcttgaagtctccagcactctagacttacagcattagcattatgtgggaatttgttagaaatgaaagttctctggcctcaccctggacctactaaatcagaaattctagagattgggccagcaatctgttttagcaagacttccatgttattctgacacataataactaaatggtaaagttagcctgaagaaaaactgaaaataaaggtcaaagaggtgattctataatgaaagaaagttggtgttagaagccacagactagcaaaattcaataaacatcttcagagcacctactgtggtccagaaattgagcttgtagatactaggtatgcaaaagcaaaatagatagtgtctatacagaagacataaatgtgcgtaaatgggtataaaataaatacaatgctgagtgatacttcgatatagaagaatatacaaaatatgggtgrtgatgatcataactaccatttataaaccacatgttgtctgtcaggcacagtacagtgctttatatatatatttttttggtatgattatcagaaggaatataaagattaaaaggtgctgcattacttaaataggttcccttaaacctggaaagaataaaatcctggtcacaaagttcatttcttgcccagagcacttgacccattcagggatcctgtgtttgtcatttctcttcagaaatgattatattggcacctatctcagaattgatatacagattaaatacrgtcatggatgaaattatttagcccactatgtatcatcaatattcattagatagtaatcatttttattgctactaatagtaatcatcatcatcattagaggggtgagcggcaatataagatagattctatagaggttaaaagcatgactccagccagattcagattgccagggttcagttctgtctttgtcagcttctagctgtgagactatgggcttagcctctctgtttcaattttgtcatctgtacaatggggacagtaagagtccttcacagggttgtaataactggtaaatgaattaatgtgtgaaaagcacacagcacactggcaggcacagggcaaatgctcagtaagtgctagcttggagtgttctgtcaaaaagcctaacatctctttgtggtattttgtgatttttgacagaatggtgtatgctttaggcatctatggaacaaaaatatcacccttccttaaatctgtggcgttgagggatcactacatatttgaataaaggcctttctctgatgtctaacaggaagaagaaaaccactgataccaaactaaggtttaaaaaaggccaaggggaagaaaattttaaatcaaaagtcatccattcttatttcatggaaatacgttatttaagcaaatatactgataatgatgcacagatgctgtttgtatacattactttcctcctttgaattcactaagtactgatttcttattkgtgccagcgatcttcagaattagttctgtccccttctgtatcattgtgtgagacaaatatctcatatacaacttttctaaagattagaagactaaaatatgtgtctattgcctcaaaggcagagaagaggtacacaaatgtgaataaacagttaaaacattaacagatgtattggaagagtccttgaatacacatgtgattgatatcaagaaaacattagctttgtaattctgcctagatcgaacactgatgggctggcactacagaaagattcagctgcaagtatttcatgtaactgatggtgtaacgcaaaaacatttcagtagatatctttctaataatttgccacaggtgctcaaatgcctgggagctagaatttcaaggattcaaattgctactgtgatagcttcaggctttgcttccaggtttttttttttttttttttttttttaagcaggctgtggcacatgtttttaagaatttaagtctgtttattggtgatgctgcagtttgcttgattacagtttaagagggtgactgtagtttctcaaagaacccaatgaatatgaactcagtttacatcattgaaaactcatgttcaatctctatcctgtgtgtactgtgttcagttattttctttgaacttaacattatttcatctacatttctatgtactgctttcgacccatttacgtgtcatagatgtcttctcttttgccacttcctctcctgaagtttctgtcctgggtttcttctagagttcaacgtatatatagagatgcagagaacatcttagtacaaattattttttctttttttacgatattggcgatgagtttgttctccaaagcaaaataaccaaaacaaaatcagaatttttataggtttgctgcattttgggagatcacactctagaaagatcaaactaatttaagtgccaccagcattggttatacagattgatcatcccttatccaaaatacttgggatcagaaatgttttggattttgaattttttcagattttggaatacttacatgtacataatgagatatcacagggatgggacccaagtcttaaacatacagttcacttgtgtttgagatacaccttatatacataacctaaaggtaattttatgaaatatttctgataattctgtgcatgaaacaaaattttaactgcatttttgactgccactggccacagaagtcatgtggaattttccatttgtggcatcgtgttggtgctcaaaaagtttcagagcatttgggattttggatttttggattagggatgcttaaactgtatgtgtaattttcccatagcttatacggtaccagatttttattataatttaggtgtgtaataacttcttacagtaattttaatttagatttacttagttggtaggaagttatatatctgtgagagaaaattcttaatatttataatttgaaaatatataatgcactgatttatcattttggtcatggcaaacattgggatatatttgtctgcaaataaaagaaaactcgactaatggtggttgtattagtcaggaytatccagagaaacaaaaccaataggatgtgcaagtaagcagaaattttaacatacggtagaattaaattggaaaggaaacaaggaaactcatatattttgtgatgtttactatgggttacagaatgtacagtaaacacaaaagctaatatttattcaatactttctagctcacaaaacattaagtgtaaaattttagctattttaacttttcttttatctttatttcacaggcacttacctcctgtatctttgaatcttctttatatttttatgtttaagagaaaaaagccaaaagtccttcctgtatggtgtggatgttaaataccaaacagttttattccccttaacattttgaccatcttccttcttccttgcactcttgtggagttggctgctttcctttactttggaagaagctacgtttttctgaccctgtaatggtgttcttctgagatttgcggatgaacataagatattaaacatatcggttgagttttgttcatgtggagtctgtcatcaatatggaatagaattcaataatttgactttttcttgcctctcttctgccatttcaaatgaatcataaaaattaggaaggaaatttagtcccatctcctctctcttgagcagatttcttttccttctcttttttttttaaacctgtgggagttgggaatattttagtgctccccctttgtgaattatggtgtaaatgaaactttttgcttttgtgttattaatgacagtttaaaagtctgagatggattttctcttattgttgttaatgacagtataaaagtcttaggtaaatttactcttaaggtgctaaattaaaaaaaattaataaagtcaattgaaaattttccaagagttattttaaagttgatttttaaatcaaataagcttttctattaagcaaaataagtgctcttttaattagaagctttaaaaaaaactctatggaaacaaaagactataccttcaaaagctcacaatctttacaattcccacttccagacctttttttaggaaacattccaaggctttaaactatttgtgaataatttttatcttagtcaatgtgttatatgcccctgcacagacttatatattcttcattgagatatataattgtcctcttgttggatatttaacctataagctgacactcactttcaaggattgatttgagctttgcaaattttgaaatgctcagaaacataaagtgcttggtatcttttataagaagctagtcagaactgcctgacatgaagggagtttgattgatgtgtgataatcaggtgggaaatttcaaacttatttatttaagcactgcatttattttatgtagatcaaaggaaaatattcagctggcttcaaatgatgtcacttttcataagatacacaagaaatttgatgaaatttgaaaaactgattaagacttatatttgttcatgttcattttatattttgggtgtactatcttgcaagcacaaacaccagcaggctttgcttttacacatctcataagccaagtccatggaagtataaatttttaatgagatagatactaggattctctccttaaaggaaaattggaaacttaggattcttattttgacttttataatagaagttctatttgggatataattcagacacaataaaatacactcctttaacttgcacaactctatggatttagtatattcacagagttgtgcaaccaccacaactaattttaggacatttcatcatcccaaaaagaaacctcatacctattaatattccactctcccctgccagtcctgggcaacctaaaatttactttctatctaaaacctaaaatttcctttattgaatttacattctatctagatctgcctgttctggacatttcatacaaatggaatcttgcaatatatggtcttttttgactagcttctttcacttagaataatgttttcaaggttcatccatgttgtagcatgtaccaaatgtcattttgtattgctgagtaatttcatcatatggctatactgcattttgtttacacatttatcatttgataggtattaaggttgtttctaccttttgactattaaaaataatgctgctatgaatatttgtgtgtaatatttcttcatgtgggcatatattttcatttcgttataatatataccaaggggtagaattgctgggccatgtgataagtacatgtttaactttttgaagaactgtcaaattgttttccagagtaactatgccatttcacatgcaatgtacaaggattcaaatttctccacatcctccccaatgcttgtttttatctctttttggtaatagccatcctattagatggaaagtgacatctcattgaggttttgatttgcatttcctttatagctaatcatgttcagcatcttttcatgtaattatagtccatttatgtatcttctttggagaaatgtctattcaaattattttcccgttttcataattggattttaaaattattgaattgttaaatatctttatatattttagatacaagtgccttatcagatatatgctttgtaaaagttttctcccattctatgggttgcctttttactttttgatggtgtcctctaaagcacaaaagtttaacattttgatggttccatttatctattttttattttgttgcttgtgattttggtgttgtctctaagaaacaatttcctttcccaaagtcatgaagttttgtagttttagctattacatgtaaggctatgattcattttgaaattgttttgtctatggcatgatttaagaatgtaactttattcttttgcatgtggatatctggtttgcctagaaccatttgttgaaaaaactgttctattcttgttgaactgtctgggtatctttgttgaaaatgaattggccattcctagaagggtttatttctggactctcaattctactctattggtttatgtatctatccttataccagtaccatgctatcttggttactatagttttatggtaagtttttaaatatggaagtatgagttctccaactttgttctttttttaaaattctaacttgttttgtttattttgaatgatttccatatgaattttataatcagcttgtcaatttctttttttaaaaaaagcagctggaattttgatatggattgcgttaaatccataaatcaacttgaggggcattgccatgttaacaatattaagtattctactttatagacatgaacatctttccatttatttagatctttaatttattttaacaatatgttatagttttcagtgtacaggtttcacatgttggttaaatttatttgttctattttattgtttttattatgaattacatggattgcttagttaatttaattttcagattactctttgctattgttttgcttttgcatcgttcattgctgctgcacaattgatttttgtrtgctgatcttttatctgctaaccttgatgaacttcttaattagttctaatcgttttgtgtgtgtatgtgtgttccttaggattttctatatgtaagatcatgtcactctttctagaaatttggctttgatattaaaaatacattaatataaaactaaagaattagttagaataagattttgttaaaaatattaacttactcaaaaaaaaagatcatgtcatctgtgaaaagagatacttttacttcttcttttccaatatggaatttaaaaaatttttttattatttgattcctctggttagaatctccagtaaaatgtttaataggagtggggagacaaacatccttggcttatttctgatctcaggggaaaagcattcattcttttcccattacatatgatgttagctgtgggatatttgtagatgctttttatcagattgaggaagttctctttcattagtttgattagtgattttatcataaaaaagtgctagattttgtgaaatactttttcagcatctgctgggataatcatgtggtattgtcctttattatattaaaatagtatattacatcaattgatttttggatgttaaatcaactttgtgttcctgggataaatcccatttgtttgtggtatataatcctttttatatgttgccggttctctttgctggtattttgttaaggatgttttgcatttatatttataagggatttttggtctgtagttttcttttcttgtgttgtgatgcctttgtctggttttgatgacagtaatggtggccttgtagaatgagttgagaagggttccctcctcttctattttttgtaagaatttatagaggattgttattaatctttaaatcttatttagattagttatggcttccttggtagtttaccctttgcttttataaattgcagaaggggcttgtaaatggggacaggacggtggtgtttgtgctgattggtccctttacaataattttactacagtgaaagtagaggattttaaataaaactgagtcttcattttgcctccttctataaaacaatgatagatgctccaccattggaagacatgcttagttgcagaaacaaattcaaaggtttttatatcttaaattaaaattagaagatgcctttcagtgccgtctcctcagctgagccatgggtgcatgcccggctcactgtccccactttaagaagtcttaccagtaacctataagtacaaatctgtctagaaacactacttaaaagagcctgttaagaagtgttatactgaccttctcttgggtaagagcctaagaacaaggagagtttgttgaatcccagacatcacgtaaggtaatatgaataataaatatttagattgtcttcctacatgttgcaaggtaatttttggtcattaatcactccactrgctcagtgggaaaaattaacaccaaagaagtaataacaactaatttttactaagtaattactatgtgccaaacactgtcttaaatcctttatgtatactatctcttttatttttcatagcaatattatgaggtcaatgctaacattattctccactttacaaatgcggaaatttagaaacaaagaggtaatcttagttgcaaagaatgctggagctgggatccgacctaggttaagtgaccccagaacctgaaccagaatttggaatagattatatgcatcccagggatttagactcagggtctctgtattccaagttctgggtttggaagataagtctttgtactccttttgatgaataataaaatttgcagtccaccttttcttttctttttttttttctgagacggagtctcgctctgtcgcccaggctggagtgcagtggcatgatctcggctcactgcaagctccacctcctgggttcaagtgattctccttcctcgctatacctgtaatctctggggattacaggcatgtgccaccacacctggctaatttttctgtatttttagtagagatggggtttccccatgttggccaggatggtcttgatatcttgacctcatgatccacctgcctcagcctcccaatgtgctgggactacaggcatgagccaccatgcccggcttgcagtctactttttagaaatgttcatagagggtatactcagatggtactaatcacttgagattagacagtctctgcagggataattgaataagcaagttaataaaataaatatttaaaatgcattgagtgattaatgtgtttgagggtaagtgatttagttgtataattaattatttctgcaaaataactctatgaaatggtattattatcacttccatttgtagaagacacccctgaaacaaagatgtgggtaacttgccctgggccagttagcaataagcccagatttgaacccaagcagtcttgttccagaccttctgtttttaacaattctacattgcagtttctctaagtaaatagtcaccygaaatatggctacaacaatacagtcacaccaagaatgtagttagagataagaatgcatcattgtgtttgtgcatgtggagactggagctgcttctataggagataagcaccaagctatcatctgttggagagaaatgtgttgtgggtgaaaggaggaggagggctgttctgtaaatatgagacaagctgaaacaaatatagaaatatgaaaagaaaatctgattttcaaaagtgaagtttttagcctatgctttaacagaagataggaatagactgtggcacgcacttggaagctgtgacagtttggtcctgagagcactgtggtgtgggagggttaggagccacacctcaggggtgaaaaggaacagtttgaaagggcaattttagaaaatgactttgataagctccattagtagatacagaggttgaatcaacagattaatataggcttcaattataagtgtttctatgaatataagaagcatctagaaattaacaggaaaatatctgaccagttgggatggtatttctcctttagtgccaaaagtataatagtttttttttctcttgtggcagtaaaattaaaggcctggatttattcagcawcttttctttatgagaataggaatatattcccagacattgttctacacttttcctgcgtggtgttctaccaccaatgtggagttatagatttagacctctgtgtttgggtgggaagagagtaggcccactggcaggcagtaaccacagaactacatgtatctgggccagttttattccagacatgtggatcttctggtctgcagccttgacaaacttcagagttcccttgtctccttgtacagatgtgtgtaccttttgatcatgaaggcactattaatgtccttcagagtttgtgtcaatttgcaactttgaaggatatccaaattatcaaataatttacatatgatgattattaaattgaagtttctaatttattcttaacaaaaaataaaaattacattcacatcaaaagcaagtaaatcaatacttcccacatttcctgtttcccagatgcaaacaaagataagtggaagttaaatatcaatatacaggtgctttcaaaaaagtcttttggtctatttccactttcaaggtaacctggtggcttcttctctcaagtcctcacacaggtattcaggaataccaggatggygtgcccaagattccaacagcctgtattacggtggaagatgcagaaatgatgtcaagaatggcttctcatgggatcaaaattgtcattcagctaaagatgggggcaaagacctacccagatactgattccttcaacactgtagcagagatcactgggagcaaatatccagaacaggtgagtgaaggagaaggctggcctaagaatacagtttcctggtctagtttgagttattagagatagtttgggaaagagagaacgtgaaaccacctagatggtcctcatagattcrttgaaggcagaagctttatatatattttttctcatcaaaattttaccatgtttaccatctcacaccagtcagaatgggtattactaaaaagtcaaagaataatagatgttggtgaggttgtggagaaaaaggaacacttatatgttgttggagggactgtaaattacttcaacccctgtgaaaagcagtttggagatttctcaaataactgaaaacagaattagcgtttgacccagccatctcactactgtgtattgtaaccaaaggaaagtaaattgttctactaaaatgatacctgcactcacatgtttattgcagcactattcacaatagcaaagacatggaatcaacctaggtgcccatcaatggtgggctggctaaaaaacaaatatatggtcatatatatatatatatatatatatatatatatatatatatatatatatatatacatmccatggaatactacccagccatagaaaagaatgaaatcatgtcctttgcagcaagatgggcacaactgaaggccattatcctaagtgaattaatacagaaagaaaaacaaaaagcatgttctcacttacaagtgggagctaatcattgggtacatgtgtacataaatactggaagaataggcaatgggggctccaaaatcggggagggagagagggaagcaaggtttaaaaaaactacctgttgggtactacattactctttgggtgacgggttcaactgaagccaaaactttagcctcacacaatatgtccatataccccctgaatctaaagtttaaaaaataaaaaaataaaaattttagcacattgactgaagaagggcaggagtaattgaaggacagaatggtattcgtgatgtggaaattcaacctcggaacaattgagagtggtatttgtccacgtgttgtatttattccatttgaagctagcctggcatttgagataaaaccaatagttaatacttattgtgttaattatcttatttaatcctttcaaagcttagtgaatttgcatatattttctgtattagtccattctcacattgctataaagaaatacctaaractgggtaatttataagaaaagaggtttaattggttcacagttctgcaggctgtacaggaagcatggcggcatctgcttctgggaaggcttcacagagcattcaatcatggcagaaggcaaagggggagtgaggtgtcttagatggcaggagcaggagcaaaggggaggggagatgccacacacttttmaacaaccagatctcatgagaactcgctaacacaagaacagcaccagggggatggtgctaaatcattcatgagaaacagcctgtataatccaatcacctctcaccaggcctcacctccgacattcgaattacaattccacatgagatttgggcagggacacagatctaaatcatatgaagtttcttcattttataggtgagaaaacaaacctagaaggaaactcaattacccaaggtccacacagctaagtaggcagctaagaaggaattcagacccaggatcttgtgaatattaaaccaagctttaaaccacagtttatgtgcagtttccagagttcatgaatttatctgcaaataaagggatggtatgcaagtaattaacagaattattgtgaggactagattaggtaaggcacatcaaatagctttgttgagtgtttggcacatcacagctcactgaatgtaagtttcctttgtatggcatcaagtgtgcaataaacactttttataaggtttctggtgcaaatctcatgcatttgttattgaaattctagaaatggaacttaaaaatgttatttagaaatttcagacttgtattttatttgacagcatcagtgggatgaaggaaagggtgaagagtgatggcatttggtgatggagaaacaagtcttatgcacatgacttctcccagactaaggactgggagactcaggactcaggacttctcccagacttgagggctgtactgcagtaaagattcattttaagctcaggactcttttccctcttctaaaatcatctgcttcaaggacctgggcatcaaccatggcttttgccacagggatgatggaaaacaagaactcagtagaatcacagggagtcagacagctgtagagaaacggtggtttcaaatagacaagcccagccccttgtccctttaagaaactgataacaacagaagagccaagagtctatatttcagatgctaaatagtcagatgccttaaagtgtaatccttcccaggtattttccccagtcagtagttccagggtaaagttatgtcatcatcaggtagctagcccagggcttgaagggtttaggattataatactatcgctgtttggtcgagcaggctgggtgagctggcctaaggttgtgggcaggtgggtggcagggtgagagtgagttattgggatccttagtctgtagcagctatggagtctcagaatctgaggctgaagtatttaggcagaggagttcttgagagccagagggctgagatagtgctggctctgacagcttcatgagggacattaacatcttctggctaggagrgcttgggcctatttgtcagctcagcctgactcattcttttattttttaaaatcagctgaattgaggtataacttatataaaataaatcaaccaatctaatgtacaatttgatgagtttggaaaatgtataatgtaaccactactacaattataatatataatatttccaccacccaaagtttcccttgagttcctttgtagtccatctccgactctaccaccctgccctggcagccagtgatctcctttctagagctatagttgttttttaaattattatttcatatataagtgaaataatataatttgtagtcattttctgtgaggcttatttcactcagcataatgcttttgagatgtatccatgttgttgattcagttgtttcttcctttatatccccgagtaatatttcattgtacagatatatgacaattcgtttatccattcagcaattgatggatatgtgggtggtttctagtttttgattattgtgtataaagcttttgtgaacattcttgtactagtctttctgtggacttaatgttttcctttcttctgagtaaatatcttggagtggaattgctggactggcctaaatttaagtacccttctctctgtcaagatgcttcactctgtattttgtcggggtagcaccttctcccagaaggtagatggacaatttcagagcaatcatgagatttaggatgttgcctagaattccaagagttgatcataaatactttgttaccaagatgtaaaaggtagaagtttaacaaaacttcttccacaaagaagtaacagcattactttcacagaaaaaaatgaaaatgaggacagtaaagtcaagtctgtggttgcgttttgtggagggaatctgcattctagctggcctggaaccgcaggggacatacagactatgaaggcaagcaagaagcatgaagtccctctgcaggtgttaagttgactaatgagcctgaaaaagaatggccttatccccaataaatgtcgcttcttccatgaagactgctttgataacattcccctcatcccaacacttcatgccactgttatggtgtcatctcctagcagaacttgcaaatgccctgagagcaggcactctgttcactctatttcctttcttttcctttttcccgccctaatggctatttcaggaacttggcatgcagtggcttctcaacacatgttttattttggtaaaatgaaggagtaagtaagaaaaaaatggttggaggatgttactaatcttgatcctctttaaatctggaagttttactgcccttttagaataccaattgttcattggcacattgaacctcatccctgaatgtagtgcaacatgtccaaatatgaacacattggctccctcatacctgattttttgtctttgtttcttgtttctattaaatgaaccatatttatctaacagcaaagttataaaacttcaagttaattttcattccctctcctttatcactgtcctacagtcaggtatcacatcctattcagtctattttcagcatattaaaaaaaaattctgttcctaccttgcctttactgctactactgccttaattcaggccctcactatttccccccgattttttttcttctggtcttttccatacttctttgcaatgaggctcaaagttattttaaaacatttgatctcaacatggtgattccctgctttcaggtccctctctcctgtttcttataagataaaggttgtgatgaagataaatgctgaggtgagtaatcagaggtgagcagaagacagagaaaaaaagacaaagagagaggggagtcagggttagataagaggcagttatagtaagaagaaattatatggtaccattcataaatgaacagaaaatgagaatgaagaaaggggaaaaggaaatgtatgatggtgaaaggcaatgtctggtggagattcaaggtcaactgagaactgatctttcataggccagggaaggagttcagttccaaagtctagcagactttcctaaaatcattcatttttaagttatcagtaatgctaacaktaacttaaaagttggtttttataatttaggttgactaacttctgcctgacacaaccttgctactttgctccatagcatactaaagaatagtggtgctaaataacttataaaattagctgcagtggaaattatctctataaaaggagaaggtctgttgaaactatcattattctgcctgcagaataatgcaaatatctttggagacttgaaagtaggcagaggggaggaaagtgggtatcttagtctgttttatgctgctattgaagaatatcatagaatgggtaatttataatgaacagaaattagatcagagttctggagacagggaagttcaagagcatggcaccagcaatttgcaaggaactaaggaacttcatgctgcatcatcccatggcagaaggtggaagggcaagagatggtgagagcaagagagcaggaggggaccaaactcctttttataacaaactcatttttgagataattaacccattcctttgataatcatattaatccattcctgatggcagaaccctcatgatttaattacctcatattaggccccaccttccagcaatgttgcattggggattaagttctcaacacatgaactttcgggtgacatatgcaaaacattgcatggactaacactaggcagtggctaatagatattgttcagtaataacacccagtatagttccttacatctcatcaaccatgcagagaaccttaataaaagtaaagcagttagcatgtaaataatccttccattttggcccaaaacccatgggcaaaatgtggtaaatatcagctttagaaaagtgtatatgtgattgataaagtattagtacatttcaaaaccctgttgcataattcatccataagcctggaccgaattaaccacaggctttaaaaagatgccaataggccaggcgtggtggctcacgcctgtaatctcagggaggccgaggcgggcagataactaggtcaggagatggagaccatcctggctaacacagtgaaaccccatctctactaaaaaatacaaaaaaaagttagccgggtgtggtggcgggcgcctgtagccccagctactggagaggctgaggcagaagaatggcatgaacctgggaggcggagatcgcaccactgcactccagcctgggcaacacagtgggactccatctcaacagaaaaaaaaaagccaataatgaaaatactttattgggtttcactttgtgaaaatagcagaataggggtaatatatacctaaaatctaccctctttccaaaaaaccgatggtggcacattctggctcctctaagcccagaattctctctccactctgacttcctcagaaactgtactcttctgtgatttgggcatgttttgcaggacccagaagatcttggacagtgtgcatgagtgcacttcactggggctaaagcagtcctctggaagctctgacattagcctcagaactgcattctctcaagacagctttatccctgggaaatcatggtatatttaagacccatctatggttgagaataaatccgagtaggtgaaaatgagcgctttttgatttctgagctgatacttcatggtactaaaatagcaatattatttctacccccacttatcaaggaactactttgcatttgaaaattcagaggaaacttcttaccatctgtgaataggttttattttttgttaactctatagaggttatcctaacaattaaaatagtcttagaggcagagacagagagtagggatcctagagatttagtacaaactctatgactttcagattaggaaaattgaccaaggagaacttgtccaaggggacacagcaaatatgtggtacaaacacatctggaacrtaactctagatttctggactcccatttcttttaacctctaagagattccattatgcctgggcatgccttagttgaatggtgtataaatttgagggctatacattgattcaggatataggcagttccatccttaccaagtcatttttataggagaaattgtacctttctctcatgctttttctcctgacatcttttccctaagcacaaagagttctcatatctaccgtcctttgtcgtctcagagtttccttagagcacccctgaaggagtttcacctgggaaagtcgcctgtgcttgatccattgattttatgtatcctccctctaagtcctccttgggtcatttctttttagctccttgtcactttggaagaggatctgatgaatgcatcacttctggggtgttaatgactctttatgacgccttgttcccctgtgcctcttttcacaccccttcaccaatcagctactcaggtccatctttatcagagggcaacagaaaaagccaaaatagatgcactactaatcatattatattgtaaaataaattttttagaaataattttagactcacagctattgtaaaaatagtgcggaaagttcaaatgtatgctttgaccaggctaacatgatcagtgataacatcttacgtaaccatagtacattaacctgttgaggacactggtgagaggagactcctgagagcgagctgctttcttggaaagcgagggctgtcttgtgggcatctctgtgtagcacccagtgcagggtggacctgctctgactttagcccccttagtctttttccagttttaatttatgatgctttcatgattttccacaaacagatgaacaaataaacacagaaggaaggttgtgcttgaattgacctgaccagaggacaaactgatcctaaactggactctctctcaccagtaatggattctctaatgttgactcttggggctggcccatttcttttgatccccagcaatttcctaggtcttattttgaggtttgcttagtaaaggcaatatttttaaaatgttaatatattcatgaattattctgaagttattgtatggaaaggaaagtgtttgggattttggagtggttggcggttgatggtattcaaacccattttgataaggccttgatgcagtgaattttttttttaacatgcctttttcttacagcagttattttcatgcattcaaagaacaaattcagttttatatgccagtattattttaaatatagtacagtactgtgaaggctagtggggaacattgaaatgaaaactctagtttgttaactgaacacttcactttcttttttcagtgtggggcaggatttctcaacatcatctctgttggctctttggatcagataattctttgttgtagggggctgtcccgtgcattgtggggtgtttagcaacattcttggccactaaccactaatgtcacttcctaccccacaccacacctcctgcagtctcgagcatcagaaatgtctccagacattgccaaatgtcccttgggggacaaaagccaccccaagttgagagtcactgatgtggagtaatggaaggaagactagatgggtgttgtgaggctttggttctggttttatttctggcacaaataagctgagtggcttaatccttcatctatagaaggaggaactttgtctgaaaaagcttgaaggtcattgccagccctaaaattcctttattaaaaaaatactgaaagatgaaaaaaaatacttaaagatgaaatttatcatcacactaatggtaaattctgtgtactgttaaatagcaacaagacgtcatggaagccctttctaaagctggtgctggagaaaagcattatttacagagtaagggtgttgctgttttgttttgtttttaaattctgtgttcgaatacagttgggaactttcctattcaaaaagttaaacaggctccctttttctgtggtacttcttaagcctttaatgtgctgatgtgcactgggaatctttaagaggtagctttgcagtattctgcaaatttttgatcatggaacactgttttcacagagtatcttaacataaaacattttgtgaaacagtaggatgaggcatgagttttgctgggtagattatgttttagtgttttttattatattctttttaaattgctcttacattaattcagcatctatttayttattgggtattggtatgtgtgaggcactaaggttatagcaatagcatggggtgggcagtatgctctgagcataacctgtaaaatttgcatcctgtctcttatattttgttggtagactattttgcctttctggatgtaaacatcagcctttcctgaagatgggagaacttatgcagaagttgagaaataggagaggcccattaggagggacagcccacggtgggtctgacatgccatgtgaagggccagggctttgtcctgtaggcagcgcgaaggcactgtagagttttagcagtggatttgcgttttagcagtggattttcattttagcttactctggccactgcatacttttgagtaggcaaagactgaaattcagccagaagataatagagtttaaaccaagacagttgaaatagtgttggaaaagaggagaaggattcagaaaatgtttggaaataaagttggcaggagttgttgaagtttgggtatatgagagaaaaagaggtagaagtgcagtttgggtgagtaggagaattcatccattaattctacaggaatttattgagctcctactttgctgggtgtattagggttctctagagggacagaactaataggatatatgtgtatatgaacaagagtttattaaggagaattgactcacacgatcacaaggtaaagtcccatgataggcaatctgcaagttgaggaacaaggaagccagcagtggatcatcccgagtcccaaaacctcaaaagtagggaagctgacagtgcagccttcagtctgtggccaaaggcccgagagcccttggcaaaccactactctgagtccaagggtccaaaagctgaagaacatggagtctgatattcgagggcaggaagcatccagtacagaagaaaggtggaggtcagaagacttagcaagtctgctttatcctagcctcactggccattgcttagatggtgcccacccagattgagggtgggtctgcctcttcccgtccactgactcaaatgttaatctcctttggcaacaccctcaaagacacatccaagaataatactttgcatccttcaatccaatcaagttgacacttaatattaaccatgacaagttcaccccttgtcaacttgaacccatacacatctcctgaaatcgtatataatctccaaataaagacaataattatgcctaatataatacagctatctcttgtgcaacccggagcacactaattgttaacctaaatgctattacataaagttaacaatacttaaatactgatatgaagtcaataactcttacgtcacatgacaaaggaaaaagaaaatgaagatattttcttagtgcaagtgtatacatctacatattcttaacaaaattaggaggaaatattcacaacaattacagtcctctttctgtagctggtcacgtggttgtagctggtattgatgactacctttttctactacctattctgtattccctttgccttcagcaagcacctcagtgggtcgtagttttttacttggtgtagtgacccaaaccttcactcctgaagggtctgggccatttgtagtcatgcctggattgggttgttgtagtttcccattgaccataatcacaaggcatggtaatactaagagatgccgtaaggatctcctgtattccatgcatactcttccttacctccattatgggataatagactaattttatcttgataatccggatcagttgccccggccaacactgtaactcccttcttagcctgttgacttagaggtaggcagagcccaaagtgtccagatggcaaccttaacttccaatttaatagaatcattgttgtgcctcctggcaacattcctccctctggaactaagacttctaagccagcagaatataatgtagcaggaacagaaaacaagaattttgctagtgggtcactaggggtgatggtgagtgatgccacttccatttccaccccttgttttttggacctgtgaatcctggctatgggagaaacagtaccatgtattggatgctgattcagatcatacacagccttctggagaacttcactcgagccctgcaaagccctgcaaagtattgtcgcctagttggcattgtaattgtgacttcaaaagtcattccaccattctatcaatccagctgcttcaggatgatgggtaacatagtaagaccagtgaattccatgagcatgcacacattgccacacttttttagccatagagtgagtgtcttggtcagaggcaatgctgtgtggaataccatgacggtggataagacattccatgaatccatggatggtagtcttggcagaagcattgcgtgcagaatgggcaaacccatatgtctattccggtgcagacaaactgctgccctttccatgatggaaaaggtccaatataatcgacctgccaccaagtagctggctgatctccctgaggaatggtgccatatcragggctcagtgttggtcccggctgctggcaaattaggcactcagcagtggctgtagccgggtcagcttggtgagtggaagcccatgttgctgagcccatgtgtaacctccatctctgccaccatggccactttgttcatgggcccattgagcaatgacaggggtggctggggaaagaggctgagtggtgtccatagaatgagttatcctgtccacttgattattaaaatccccctctgctgaggtcaccctttggtgagcactcacattggatacaaatattttcacagtttttgaccactcagaggtccatccttaaaattttgtatatacatattatcccattatcaaatattgtcaaattgccctcatagcaccatagctgcatggtaagatgggcaattaaacaagcaacagtgatagaaggtggtaagtgccacagtatggcagctacatgcttctataggggctcatttgagggcaaccgtcctggtctaggaagccaaggatggctttctggagagattcagtttattcctactaaaaagaagattaactgcatgctagagattataaggatggggttgggatgaggtatattacaagctgaggaagtacatgtgaaagcctgaagagtagtgttactcttttttttaagaaacgtgatgtgacttcctttaacttctgaattcatttgctaatgaatcctgtttttatggagttatcctgtaaaataacccaaagacaaagacatggcttttttaatgtatatgtgtttttagaaataaatcattgaaaagctcagtaatccctttggaraacagctttagcattgatgctgtcaagacccttgtcaaaagaataaaccaaacctgattggcctggtggataaactcattccatacataactgaatagttagagactgtacagaaatgcagttttgcctttcatcttaatatgtagtctgatgatttgtaaaaaccttcttagtgggaacagcaggttattctgcctgggtgggagcctttttactagcttaagcagctgtttaaactttcataagcaaagtaattattaaatgtttcatgaacatattggttggaacgtttgttcacattttaaccttgagttggaaagtttcaggggggtggggttaaagagttttaagctggcaaattcattctttttttctttcttattataaactttttatggcttagaaccagccaacctaaatcatggaaggaaaaatacatgtgtggcaagcatgagacatttcattgtttatttttcaaatttctgaaatgtgctcatagctgtgcatgcctctgggctcataaagacagcaaatgsaaatagctgaagccagacagactgttttagatagatagccacccaggtaggcaaggaaaaccttgtaggttactctttcctccaatcaagtcatattaatttgccaaaatgggattttcaagcaggaggatgtgatctttcataggtctgaacaccttgcctttttcaatgatggagccatttaataataatcataatcagaagatgaggaataatatacatttatagaatacttagtacatggcaagtgtatatgacacatagtagtctacgtgtttctcatacattatctcctttaatgttcaccacaaccttgtcaaacaagcaatgctgttatatccatataacagatgaagaaacgaaggcttagagaggtcacagaatttgcaaagcttctgagtggctgagctgggatttaaattcatctgtcctatccaagaacaattcattatcctgtacttcttagtgcctttttattctagtttgtgaagtgctgctacctaaagagtttcccattttactctaaatgaaaaagaaaaccaggacaaccatcagcatcaacagcaactaatgcttgttgaacaactactatgtgcaggacgctatgttataagcttgggaaatattctgggatgagaataaagaagataaaagggtccttgcccgtggctggtgaggaaaataggcagtaagttctagagctcacactgtgcagcactagtgcagggcctgcagcactgtgtccttgctggcccagtactaatgtctgcatatagtactttacaatttgtaatgtgccctcactgatattgtcccacataatcccaacaataggactgataataatgattcccactttaaagatgaggaagctgagattcagagggacaaaataattggactaaggtcaggcacacaccaaaataagtggaaaatacgattcaaaatgtggttctctataacttgctgtagtcattacctagagccctgcaattttatatagcataaaataaatgctttaaggattacctgaaacacaaccttaaaaaatgaaagcctttaaataataataattacaatatagtgaagtaatgagagcaattttagtagttttaaaatatgtccacatttttttttaaaatttctgtttaaaaggtggagccgaattctcttcccctgcatgtgtactgtacttagtgtctgacttctagtgaacagaatattgcagaagtgctgggttatggcagccaagattagaacataaaatgcagtgtagcttcctccttgctctttctcttgcatcacttgctctgggagaagccagctgccacgctgggaggagcacttggagaggtccaggtggtaagacactgacttcttctgctattaaccagtacaaactagctaacaagtaaatccaacaggtccagtctaggcttcagatgacttcaaccctggccaatattttgaccacaaccttatcagagaccctaagccagaaccacccagctatgccactcccagattcttgactcacaagaacagtgtgagataataactgtttattgttttaagccactaagttttggggtaaactaatacagcaattaaagggcacaagatacacagaaaggaataactgtgtctaagctgtcacaaaagatgggtactaaaatgtgacaaatatgagtaggaacttataggtggacaaggaatttattgggaggtgttctgggcaaagaggcaagtgtatgcaaaaaagtgtggaagtgtgccacagcaaggtacatttatgaaactgcacagtacagcacaagataaaaatcacaccaagaaatgtaatatatcataatataacaacaaatgttcttaagagtgactttgagtctgcaagaaatttagttctatatggactattttaaaagataggaaagcaattaaaacattgtttgaaatatttacttcaaaatttttttaaagtactgtataaatttttagttagagtctaagctatccagaaaagccacttccctgttttcttacttcactagaactgtctggttccatgttttgaaaactttagtttaaatgtagagccaagaattaactaatgaagaacacctggattttctgcaggatttcactgcaccaattctgttacaacaatcaggtagaaattaacattttataaccaattatatgttttacttggcatcatgctaaccaactgaatttttacaaaagagaattggccaaattgactcattattctccaccatacctcactcattgactgactatttattgagtgccgtccgtgtgttacccactgtgataggcccataaaacaaccctttatggttgcaaaaatcactttgcatcccagttgcagctctactgttttctagagttaatagaagttcctggtgaaaaaaactatgcttagtttttttctaagcatgtttaacttgggtttttaattaaaattaatacctactcatttgaaataaagagaaaagtgaaaagaagttttacttggaaatacattaattgaaagacagttgctgttagcatcttgctgcacttctttcactctattttcttctatgagtatctttataaagttataatattttatagatactgtcaaatctarttgttgtttaacatcaggcaaaatatcccttgaaacagaatttttaatgtatttaagttattctaacaaatggatatcctgcaatttacttaacctggtattagatgttttgattatacatgaatctttcaggaaaaatgatgtcatagttaaataaatatgtagctagtgaattttgaatgtgtcttttgaactgtttatgggctttgtgataattgggtaattttaaatgataatcagtaggaagcttaggaagaggttaacatggtttctctcccttccaagagaactgcctttgtaagattctgagatgaccactgtggccatgtgcccaagtgtgctgtcacagttatactgtcagttaaattaagcatgaatgattggatggagaacattattattctctgcacattcttgattcttaatttaaggttaaactaatttaatgtcatgtgaatttttagcagcaattatggacagttaatgcatgttcttccttagttatgcctcatctctttgcaaaattacaatatttcattccaaatttcttctgaccagatttggaagtagctctctcttctcttttccctcaatgtttatatcagaagggttttgagtttatactgtaaatctccatttgtgtattttcataataagactctaagaaccttgactggttatgagggcactggaatcaaagcaaatgagggcactggaatcaaagcactggacccagtgctttctccatccttcaggggatattgtacagacaatagagatgctatcttaacatctctgtttgagtttttccctctccacctgtcttgcataccaccctaaccaatactccttaagtatggctctatattactatgcccctatcaacactctattttaaaaaggcatggcttcacacttcctgtaagataatagccagtagtccttgaatctggcattcaaagctttaaatctacaagatgatatactggtcataccttttcctgcctattttctagagtcttttcccagaagactctgttccatgtatttggtgtcactttcctgtctctgtgccttcctcatactgacccccttttctaacctgactgttgaaatcttacctactcagtcttttttcatttatttgttgattgtttcaataaaattaatttacttaataagtatttactgagcactgattgctcatcagacaacattcaagagcctactgaaatggcaccttccctgagaagcctctcttaattacacacccatatacaatgtttctctcttcagaacttccatakgtctcttttttatgctttccataaaatttgtcacaaatcccataccttatttatgtgcatataggagcatctaatgggaactcaaaattgctttaaagaacataaatgaatgaatgaacatgaatgagctaatgaatgaaagaaaarttatgccttctgcaccagcagaagctaatgactaaaataaaatggttaaactggactagaaatttaagattgttatgggtttctagtctaggaaacaccctcaatgtggtttccatattggattatcccaacagagaaagatatggaatccccatcttctgattcccacaccattactctttctgcaccatgttatcacatgctactctattaaaattgaggcagtattatcatactttgttattgcttttcattattagacatagtgttttaaggacagtattgaataggaagattgttttttcagagtgctgtaacctattttagcattcaaaggggcaaatgtataaacctgagtggtgagaaaaacgtagcagattaactaattttgaaagataatttattttgaacttgagtaggggctagggaccttcattagttcctaagaaaagtagaccacaaactcaacctctatgctcttttttatctagtcatgatattagagtatgtgtggactttgacagtgacacctaaatggtttttacttgcctcattgtttccttactaactgtatgaaaraagaacacgtgttgagcccctccaatctaaaaatacaaactctggaatgctccaaaatttgaaactttttgagtaccaacatgactccacaagtggaaaatcctgacctcacatgttgggtcacagtcaaaaggtagtaaaacaattgtttcatgtacaaaataattaaaaatttgtatgaaattatcttcagactatgtgtataaggtgtataagaaacataaattaattttgtgtttacacttggtcccatcctcatgatatctcattatgtatatgcaaatattccaaaatctgaaaattccaaaatccaaacatttctggtcccaagcatttcagacaaggaatactcaacatgtgagactctggaggtgaatttttgtttgtttgtttggttggttggtttttgcagtaaattgttgaagtcttagaaggggcgcattcagcagttagagcttcccttttaatttgcataccatgccgaagaagaggaggtgtgattctccttctggagatgatcattctttcaaaaagaattatggtgaattgtgttttttaaaaatagacttctagggcagagtaggggaaaaacatagggaaccgttaattaaggtatcagggcttgagaacktttttgtctgcccaagacccttcctttggaaacagcacctctcccaacatttgtgctcctagtggactggtaacttgcactcctaagaactggaatcttgaggaagacacagagcgatagatgagattggggctgagtcatccatgatggtatcctgggcagttcagaatctctgagcctcagtttttcttccccccaaaatgggattctatgtctcactgagttatttgaggattcagtgagatgatgtctctgcaagctttggcacagagttgttattcaagtgaatattagctaccactctttgaggttagtagtcctggggacaattcttttctccccctaaagaaggaaagggaaaggaaactttctactgaggaggtagcaaatgcagaatcactgaaagtgcttgcgaagaatatccaactattcaaattatgaattagcaaaagataatcaggtgattgtgaactgtgggttgctgctgctttgttgtaatactgctgttaaaacccacgttagagatcacatggacacaggaaggggaatatcacactctggggactgtggtggggtcgggggaggggggagggatagcattgggagatatacctaatgctagatgacacattagtgggtgcagcacaccagcatggcacatgtatatatatgtaactaacctgcacaatgtgcacatgtaccctaaaacttagggtataataaaaaaaaaaaaaaaagtcaatagtactgcagaaactcaggcttcttgttgggtcggggagtggcgaaatgtaaagggagtaaaaagggtggtagtctataaaggaactagccatccagccacccagaaaccaagtccctcttttaattaatagagttatggagaggctccagcatattaataaatgtccccctatgggtggtgagaacgtcaaatgtgaaacagagcatattggattttgtaataaaaatacagagaattataaatgagatgtccaggaggcatctaagttaaggacacctaagatcaagaatttatattctagttgataaaaagttgtggataaaattagggtgctgagatggaaaaagaaaggctcctgttggcaggaggaacactgatatgaagtgatgggagagttttgatcaagcctgtatctttggtatttaatatggggatgcgtagagagtattagaagccataggtacagccacatacattgttaaaatgtgactttttgtatattatttcacgtttgagcaattaccaacttactagcagttgtacaaaaagtaagccattgtgaatttgggatgcattttcacatatacattgtattagaccattcttgcattgctattaagaaatacatcagactgtgtaatttataaagaagaggtttaattggctcatgactctggaggctttataggaagcatggtgctgacatctgctcggcttctggggaggacttaggaagcttacaatcatggtgaaggtgaaggagaagcaggcaactcacgtggcgggagtgggagcaagagagagagagtgggaggagaggtgccacacacttttaaacaaccagatctcatgaaaactcactcactattgcaaaggcagcaccaagccatgaggaatcttcccccatgatccaaacacctcccaccaggccccacctccagcactagggattacaattcaaaaggagatttgactggggataaatatcgaaactatattagacatgaagctgcaaattattatttaattcatattctagcattaggtataccagaacaaggtatctgggtaagagaaagtcgatatgaagggcacaagataatggaggaagacagtttcttctatcgtctagggactttgagccaattcttgggaaaaaaaatagatgatgttgtctttgatggtccttttgttgttgttttgatcctcttcttcaaattcctggtaccttttctttctgactaacagaactctcttgttgtaaaacagcccagtgaaataggtattatcccaatgttacagttgagaaaagggggctcagaaaggttttgttaacttgctcatgccagtataataaataggaaaagccagtttcataatcaagtatgtctggctctaaagctcaccaagtccaacatttttgccttggaatgtgtaagttaacaatgcccccactaacaacatgaagcaatacagaaggaatgggttgagatggggtttgggcaaagaaaagatgagcttggttttaggtatgttgattttgagctaccttggaaagccattttctgttttgtggttgcaagagaaatcgtggtttgttgccctgtgttagacatgggtaaacttagagtgttccatttgctgtagaattagtggaggatagatagatgggatatataggcagagatcgatagatagttgtttgtacattggttgtttgaaagttgagcaatgtctgcagtcactagtcagtatttctattgcttagcaactctatttcctcatgtagccataacaaatggaacttttatatttattttttatgcttaagggtacatagtgctgcttataaatgatgcataagtgacaattttatactgtgagcattactctgactcttggaatcatagaatctcaaggttggacgggaacttaatagttggatttgttctatattcagactgctttacacctccatgaggtcctgactgacacatactactcatttagatagtgctccctatctgaaaagtcttggttttcagataacattttctttcctttaggcaaattattcctgttttacccatgaaggacaaatccaaatatcttgtcttcatgagaactcattgcacatttagaaataggccccatgtctctgccaattttctctttcctgggctgagcttcttctccatcttttcagtggctccttggagagatatattccttgagcgcaggactctttagcccaggttctgggaatgcacctcacagaaggctccagtgtcatcccctgcaggcattgtctcactggcagagagccactcatccatggccatagccttttccggtgtagtccccatctaatgatcaattcagatggggtataaaagctcagttatttcagtccaatatgtgacaactctgacaagccattttagtctcagagctgctcatggggtcagctgagtctattgttgggctgcattgcaacttgatttgttttctgttccttcttgagtccttcccctccctttctcaggtgttcattcccagggcataaacattctgcctgccaactctgatgcagagtctgcctcctggggaaccaagcctgcaatgtatgacttcaagtcttcttatgaaaccattccaatttgtttatggacttagacttctggagtggatagatacctctaggtgtaatctcctgtgtaatcagaatacattttgctttgaagaatattttaaattaagtaagattccacaaatctaatgtgtaaagctcatgcagtagaaagttttcagtgtggatgtcttagcttaggttccccctcaaaagcagagtgtgaaacaaggacttacatgtgagtagtttatttgaggaaattatcccaaggaacagaagtgggagactggaaatgattgktcacaataatctctgtcatttcatagccatagtttttcatcaacactttcctaatgagctcatctttgggatgccaagtgacattgctgtgtgctttcttcaagagatctgagcaatgtagtcagacagccaattaacatttttatttactttgggaaagctttgagtcctgagacctgcatgagatttttctggtagtatttccaactgtctaacaaaacatgtcaaaaatttcatatttgtcgttccaggaattcagcttaataagactacacagaccaggactgagaggttggtggcaaaggaaggagctactgagagccacacatcaataaaatgagatatccaaagcatggaaggagggtcagtcaaggcaatgagggatagactgggatcagttcaggaggctcctcccagaaccaggaatctaattaggagactgaaaagaaaggaagtgaaggggccccaagccagagagccctatgtataaaattatacatgattttatatatgtaagtcgtaatttaattctcacagaaatattgtgaagaatgtgccaatattattatcaaaactatttagcagatgaagtaactgaggcacaaagaggccaaataaattgtccgatgttgcataggtagtaagtggctgagcctgacttcaaacctcgatagacttttcccaaagttcatgctcttctgaatattacttatttctcatgtacctgtttctgaggcagaggttctcatgtattataaatttccttgatgaaagaccaggactggttcagaatgtgtgtgttggagaagaggggtgtaacagatacacattttatagacctccttccatcccatccatctgggcccactgcatcttgcactgcaccactcagggaacttcccccttgcccttgtctgctactatgtatctcggtcagcaagttccaacttggagtttctggctcttcttgccacttcaggacttggatgagatactaagccatggggcacgcaatgtggccccacatgtgttggaagaagccagatgatacaccctggacatgaaggagmgttaactccttgtagggtgaaatttgaccagaggagggcaatggacaggagggaagtggctaaattccctcatcttgcactgtccaatcgacttctctgaggcatgagtttttcttctagctcattctttcccttgtcaagtggacacaccagcaaaggacctgttgcgtctctttgtggcttagtgtgaagtgataggcaggatagtgatccttcagttggcattgcttggcatcttttcttgcctcaatttccttctagctcattctttcccttgtcaagtggatgcaccagcaaaggacctgttgcgtccctttgtggcttagtgtgaagtgataggcagcatagtgatacttcagttggcgttgcttggcatcttttcttgcctcactttccttctttctaatccttgtaccctgggtttacccctttcaaagaaagcattaaaggccaagctaagaaaatgggtctggactaaaaagtggaaacaaatagagtagtaggcatagttcttaacagcacttcactgttcagagacaagaaaggacatagattctttgaaaaataagtgtagaacaagttagatgttgatattatgactaatgtgtaagttccagtacttaacaagaagttgttgtaaggtgagtatttatgaagaagggggagaagggaagaactccctgatcaggctgattttaagtcagatctatttactgcctgttatgcctgtctcctcttcctcttcatgttgctaatagcaaaaatagccgctattttctgaacacttaaatatatgtctgagaccatgctaagtgctttatgtatattttctcatttattcctttgaggtagaaaattgagactcagagaagagaagtagctgtcaagcagctaatgagtgctagcaccagatttcaaacccagggctgactaactctgaagcccatactaaaaatggatttgttctgctgtcttctgcaaagttccttatcaaaggaagttatctagagcagaggaaagccatatggagaaaaaaatatggcatgagagcatcttattcattttgttcttatttgctccgaaagcaacttctggtggagccagctgctggtgtttggagtgtctttgccttctaggaggaaatactctttcctaggtgccacactgttgatacttctcaagaccaaaataccacaggcctccagctccttgataaagctttamtgtgttgaattggcataaatcaattccctaagtctgcctagcagaaccaaactctgaatatggtgacctcacagggtcacctagctcaaggcagccagcaggcttcctacttgatactttctttgatagatgtctttaggggagccaacttttctttaacatctttcctttgactctaaagctctcctctcccaacatttccycctcagtttaacccgagttatgtgttcatgacataaatagggccacgtttgccgctgaatgatgtcacagtgcaggtgatccacagatagagaatacaaatagcatttgacatttgcctttgggatgccttatactactttttatcctcccagtaatgtttacattgttgttttgtttttgttttttgttatttaaatgataatggcaaaagacccttgttaagagtcatgagatctgggatctgattgcagctctgacttatcatctggatgtgactttgatctgtcacctggtcctctgacgactcagttcattcacctgcaaaatgggagagttgggagagattatttattcttaaaccatgctgatcatcagaatcaccacagatgctttttaaaaagggcccatctcagagtcctgaatcacacttcaggtgaagggaggagaaaggagattggggagaggagcaaaggtccagaatccataattgcaacaagctgcctgggtcattctgatgcacagtttaggacaactttatgcaatactgccagttgcacaactccaaggggtgccacttgcattctacagactccatgggcacagttcacatgaaatagaatctgaacagcccctcttggtattgtgtaatacagcagccctgtatgagctgattactgtatagggtcatttgtaagcatggatattctttgattggatgacagtagagtgctttgaggtcctcagtagacagtagccctgtattagttcattttcactctgctataaagaactacctgagactgggtaatttatagagaaaagaagtttaatggactcttagttctgcatggctagggaggcctcaggaaacatacaatcatggcacaaggccaaggggaagcaaggcacatcttacatggtgacaggagaaagagagagagagagtgaggggggaagtgccacactttaaaaccatcagatcttgtgagacctcactcactatcatgagaataacaagggagaaatccacccccatgatccaatcacctcccaccaggcccttcctctaacatgtggggattacagtttgagatgagatttgaatggggacacagagccacaccatatcagacccataagcatgtggttacagatgaaggcacagtagctgtgaccaataggataggaaagtggatggcttaagaacagctgatgaacactgccccatacaaagctgactctcagattgtctcccacattatagcattacagctggtgcccatctgacaagagggagaggtgtgtgaagaaagcaggatgttgagagcagcgtgagccaaacagcaggacctcgggtcatggtttccccaatagggttgaattgaggaaaagaaacaaggctttctcccagctaagaaaagcttttagttgcctactaatttctgtgctttggggtttctttgactttgttttccctttacacatggtgaaattccttttgaaaataaattcagccctgtcttaaccaaaaaaaaaaaaaaaaaaaaaaagactggtaaacctgtatggagatattacttgagttcctagaagccaggttttgttagtaaaaaattggataagtttgggtacttgggcagacagaaagttgaaaatctggggaaagactgttagcatgcagttgtgattacattaaatgttataaatgaatttttatcagaagctattgagatgctgctgagctgacttgaggtattccattgtctagaataatactctgcttaatttgcatgagaatcagttgaggcatttgtcaaaaatgcagattcctgccacagccccaggcaattctgagtcaccgggtatggagggggcatctgggctgtgcattttacatgagcatccaaaaatcatgctttgagaatgctgccctagacaactgatggaaagacagggaactttgttccagaatacatcctgtgttccttggaaattatattaactcctctcagccttagttttccctcatgtaatgtggataakgatacttaccctttccaaaatcagaggtcttagaaaagtattttaaaaaataaactggataaaagaggtaatgctagttacttagaataggaatttatgtgaataaaagtctatgtcttgggcttctgtaaactcacctctcaaccccagcatacagcacaagaatatggaaatagaaggaagtatgtatgcmtatatgtgtataaatatgattgagattgtgtaggagcctgtcttagtccatttgtgctgctataacaaaattataataaaataccaccaactacrtagcttatatacaacagaaacttatttctcacagttttggtggctgggaggcccaagaccaaggagctagctgactcagtgtctgatgaaggctcactttctcatagatggggcttttttgctatgtgtcctcctgtggtggaaggggcaaggcagctctctggggcctcttttataaggacactaattccattcatgaggactctgccctcatgacctaatcaccttccaaacaccctgcttcctgtcacatcacatatgaattttgggaggacacaaatgctcagaccataggagaaccttggaaagatttctagaaagtcaaacaatagatttttaagaagtctattttctaataagctattagttagtgcttattagaaaatagaatctgccaaagtaatgtaggaggagcatttatcaaggcagattgatagagacagctcagtagataaggcaaacaaatgttgaccagtgaattatattcataatatattttgtatttgtaatatattttgttcttatttagagaatgtactaattagggtaaagtatagctgctgtaacagagaaccaacaatctagtggctcaaataacaaagaagtttatttactgctcatgtagcaatcctggtatgagtagtcattgcctgatgagtaactttgctctgcatggtcattcggtgagaggttccttctatcttgttgccctgctgtcacgtaggacactgccatcatttactttgcagaagctggcttgtcacctggaaaagggacagagaacatggatcatcataaagctcagacctggaaatggcacatagaacttccattcacaaaccactagtgagcttaaaaacaccaggatgcctaagtgaaggggaggctggggaatgtagcctatcaaaatagccatacccaaccataactctattgttactgctgttgaagaacgggagaatggggttggtgactaactagcagtctctgccatgggaaggtatacagaactttgaaaatggagccaattactactttttatggcttcactaattggccagagctactactgtgctgtggagtatcagtgtttcctttgatgtgttgttcctagcctctctatgggcttatatctagyatcccaggtaaacctgagagttatcctgggcaatgtggatgctggtattccattttctcaattttagggttctcctcctgtatcctgtacaggtcatgagaaaagacttgttgagtcctatcctactgttaataaatgtgctgttgataggaaaatgttggcagaagtgccaatatgaatagtcttctagttgcttttctgatggttgtgacataatgaatctcaartgtgacttttgtcatataattggaggctctgaacattaagaacattttcttaaggatcatccaggcagaaaatgagttcacaggtttttaacatttttactgatggttcccaaggctccacctgtcccttcattctattctatactgcctctttattggatttctcccccactgcaacktgtgtgtgtgtgtgtgtgtgtgtgtgtgtgtgtgtctgtgtgtgtgaggagagagagacgagagagagaggagagagggagaagagagagagaagagagagacagaaagagaaaagattgacaatatatttcagaattcttaaggtttgctcctcattattctgtgatgtgcagtactattcataacagaaaggtctgataattagctgccttgggatgttctaaaggtgaagccactctcctgcaatgcatcttgcaagagagattagtgatgtagactggaggttggcatgtgacagagactgttaaggacaaaagcagattgataacagtgaaagctgctgcttggacaggttcatggatttagagagcgacctccccgccatgggaactggatccctatgaaactgtggcatgaactacaatgagatgaaattacctcagagaaaaatctgaaggcacatttgagggttgggacattgcttaggaagctgattaccaaagacaaaaacattcatgtgtatagtgggagaatgggagataggttactctttaaatagctagttggcattgtcattgaagtttgccttactggaaaaattatgcagctatttctcttttcagttttatacacatgcgcacacacacacacacacacacacacacacacacacaccatatattctggggaagaggtgttttattttccttttgtatcatgatttcatagacccttatattctctaagagatctgggctttcagccacattcccataggattctggaatttttccctctaccctcagcctgccccatcacccaagtgtgatttttgtgattcttgtgtttctctagtgtctcaccaactgtatttctaaagcttggtcagtgttccatcttggatttcwtgttttgccacttgtgatggcaatttataataaaaccaagatatgacctgttttgtatccagcaatgaaacaagttggaatctgcctgtgatgtgcaatgtgccttcaatgaaggggcagctgtgatgtgaatggatcttgggggagagaaaggaccttaatttctcttctcttttcccatggatataaaactttgttatggtaaactaaacctctgatatcatatgcaaccgctggcattctagattgttttaatggccactccttattgcttcatgctaagcgttaccatctgtttctttcttaattataaatgcagcaggaattcacaattacatcagtaacggtggaaataaaatggagttagaggctttctacttaacacaaggcagccttcctctaatatttttcttctgttacaggcattggtcagagaggagactttttcagtggttttcttttccctctcttcagtatacttaccatgagaatgtcatgctataaattcagcaatttccttttaatgagagggagagctgtgtttattttctgtccatggagctggggatgtgtgggcagctctttctcacagtattggaaaccagtggtgtgactgtcctgctgttattggcctctgtttttgtgaaaacagatgagttataatagcccaatgacatgagtcatgtcatcccccagaggagagctgggagtggacatctaagaaactctggtagccagcctgcctgtctgtgaatatatgggaacatttatasagggaggtgatataaaagctgaagacatgtttaacccagattacttaggcttttatttttcattaagtggaaaaactaatcaaatttcagactcatgaaattttagtgctaaaagaaacccttataaatcaccttgatcaaagctgtagtgactgccctttcctttgtgtagtgctcgaccaggttgagcacgggatttggagtcagcagaacaggtttgattctgaagccaccaccatggactttgagtcctcttcactgagtttttagtgtcagttctctttatccatgacaggagacatgatgcttcttatgaagcctatgtttggattaaatgagagggaacaagtaaatcctagccattgtgtgkccggtctgtggggtttttttccccttctttccattcacatttatgatagatgaagagatattggtccagagaggttaaatgccttgcccaatatgatacatctagttcagggtggacctgaagtagaagtagttttaaaactctatttcaaggcttttgcttactatgtcatatctagaccctttgctacctttctccatccttgtcaccattgtacaaggatatgtacttttgcacaatgaataaccacaatggttatcatgtgtatgatactttttaaatctgtaaagtaccttttaaaatgtatattcccatttaacatgaagtaggtgaaatagtgttataatcttttttttctctctctctttgagacggagtctcactctgtcgcccaggctggagtacagtggtgtgatgtcagctcactgcaagctccgcctcctgggttcatgccattctcctgcctcagcctcctgagtagctgggactacaggggcctgccaccacgcctggctaattttttgtatatttagtagagacggggtttcaccgtgttagccaggatggtcttgatctcctgacctcatgatctgcctgccttggcctcccaaagtgctgggattacaggcgtgagccaccgcgcccggctgaagtagtgttataatcttatccttcctcttattttaagttggaaattctgaaaggtcaagtatcttgttgaagtcacacagaaggctgagtcaggacttgaaccaggtttttaagactttccatatatgggcttcactctatactagatggactcttactgttacaccagtacatgtaggagaggactgaaagatgcagtaaaaagaaatcgatattattatctataatttaatagttgtagttaggactttttatgatgtgaatactataagaccaaaaccattttcttgaattatattaatattttagcgatccacgtgctttttacccaccagaaggttcccctgggtaagtaaagaggtggagcaggagagagcaggtttgcaccgaaagtagttmcaaaacaaaacaaaacatataagacatcaaccacaagaagcccttgctccaaaatgcaaatgacttatttgctacttcaaaaatgcacctcatcaatgaagggatcatttgatcatttgttcctgccaagtttatgtttagtccaggaagggtcaggctggtgcatattctcacccaggggtctgagagcacagtggcaggtgtgaaaagagtctttgggccttgcacttgccttttcatgccaatgccctcatccaaataagaagtcccctttgcactttcccagcttctaggccatatgttatgtctgtttcttagagggtgattcaatgattcctggtgataatgacatcacactgagttttacttacatcctgtttctcttgtataatgcccatgctcctcttgtcatgcggtcctgagccatcagggcccactctataaagcttcctgaaaatcaggccttcctggcaacaaaactaaatcttttaatctcagaaaccctactactgaccatgtatagaaaaccatgcaaatttaaagaatgtaaatattgacattctcaggttttcccatgtaacctgatttagtctgatttccctattatttctgccatttctgtgggcattttactgaagccaggttttataaagcagcccagaagcagcatcgttcataaggtaagggcacaggctgtagtatcggccagacctttggtcgagttctggctgtgcagcttgactgtgtgatgtcaartaagttctcagagcctccctttccccatctgtaaagtgatgataacggtgcccacccattagctggtgctgtgaggatcggatgagctaccgcatgcaaagtgcttaattacaggacaatgttttgcctttctgaccccccagaaccagatgaatgattcatttgtgatgtttttctcttattaggaagctttagctggacaaaggtcattcaggattattttaacatatgaratgcatttgttttattgaaagagattagaaatgttattttgaaagttttataccttactttagaagtcaagtcttataacattagtaggttttcacttcaggttactttcatgttctgtcttttcactgtgagcaaggtggtaagaaagccattctttctattgtcttgtatgcgaatgtgaatatatcctctatgtgccaaatacaacttcgtgagcatattgtttgttttaatgtagccttttaatgtcagaaaaaaagtctcaaagttctagtataataataatgattaaaatgcttattaaagagcacattaaaagataaggctattttgaggactcaggggcatataaacaggttattattttttcatagatgtattaaatcagacatgtgctagccaaatgtctgaccttatataggttttcttcagagttttacagaaataatgctaaaataaaggaatgtgaattcctttgccagttctttgaaggaaatggtagagtctgacctacctcgaaggagtattaagagaaacaacctggttatattgctggaggcttagagtctttaaatagtctcagagatcaaatctccctcggctacatagaatgattccatacgctttcttctgaaacttcctctctatctctaaatggggccattttgagcccctcatgaggaggcgcagtggaagaaaaatgttctgctgagcagaatctgcaagccatgccacatgcagacatctcatctgataatgacattctcactctgtagaggccaggaccaactgtgttatcctctttctcctgctcctctcctcccacctcacacatgcacaagcacctgtcaaccaacatcctcataccccttcttctcttagaaaggaggggcttcaaataatattctagggggaaaggtcccatgactctctgataagaagaggaatcctttaattctactaaacatgcaaaagcattgagcaagcaattaggcaaccatgtatatagctccagatgtcccatacatatggacaattgtccacactgctggtggggctggcagcattttaaaaactggttacaacacatatggtcctttgctttttgctctggcatctgaagtcttgctaatccaaacacatcatcgctgtggtacttccagcacagtaaatacctatctgctctcaagttacaaatgcggtgtgcttccctagctcaaggttgtgggtaaattaattcttaaatgaaagtgagaggcagggagctttgcaaagagaagaagcatgttaggtgtaggaagaggaaattaaatggattggactctcctctatcttttcagtgttttggccctccacccattaaaagctttcaagctttattggatgatagtttctaattccccttctagccaaggctccaaggtatgatttcaggatggagagtaaattctttgtgtttcccatctctcagaaaaattgcttatcagctaaagttttcgaagagtcagtttatgggaagctattttggttgtctagctacttatgttatcattattcagtctaaagtcttgcctattgctgaaaactttatgcaaaacaagatattgtggttatttatttcttagccattgctttgttgtttacacacccacataattaccttgaacaccacaggaaaaaaattgcaaaataatatttcctaaacacactttgggtttacaaagtgattataaatggcttttaaagaaagtaattcttgttcatttcattgtattcaagcttctctacttaattgtgctgtgtgtgttggaggattgtggtggtaagttgagatatgtagacaaaacagattttgtcatttttttcagtagacaaaattataatagtgtggagatactgtcattttaaaattaatctgaaaaacatttattgagtactttcaatatgtcatcagacaacttcacctgtctttgcgtatgaagtttttgtttgtgttttgcttcgattagttttgtaaaaggagacagcaacccaaggactttatagctataaaaaggcaagggtggttactacaagctaaatatgagaaaaaaacagttttgattcattccttgaatgcctccatcacagagcagtttttagcaatggaagtaagattgtgaaaggaaaagaacagggccctttacagagctccaggaatccttttgtggtactttcagcaagtattggtggtagaaaattaatagatataataaacactgtgaggttggctggcattttatctatcccttgaacaggtttaggaaatataattgacttgtgtccacaaatctgaaatacaatttttttgtgtgtaatagtaattttccctgcagctttggcattcttttttccattaaacgtctcagttttcagtgaggggaatacatccttggtcctactttgtcattttgggatgatttattttaaaattacagtaagggactttgttcggaattccactaggctaatttcaaacccagtttgctgactccaactcgccataatgttccccacctccagcacaccgaacaggaagtggcatactcagatgccaggaacaaggcgattgctcagatggaataacacttggcagtttggaaaaatttgttgatgtaagctgaaattgtaggttagatactgacttgtgggatacatttctgccaattatggtccattgtacagtcaaaaatgggaaaaattacttactgcagctggctttttggcattgaaatcactgatggaataatcagagggaaatcttctaagttatcataaaagatggattgtgacacaggatgtcagtttccagggttatccgttttacctgcctcacatgactggaaagctttttgtttaaggaaagaatcaaagagccagagaactgttgagcactccttgacactgacttgcccaatgataactgattcctacaactagccttcctgtcctgctacttcaggggcctatgtttttaagagctgcagccttgggaagattttttttccgtgcctctcctgtgtccaaagctcctgaagcatctgtaacttcctattccaggagtgtacacattctgtaactagaagcctacagctgtaatgctgaacaccaaaataactacagttgatcactggaaacatgcctaaggctgaacataatttttcattttcattcatggatttgtacatattctaaaaaaaagttcactctgaaaataatatttgcataaaaggaaataagagaaaacatactacccacccatgtagagcaaatgagctacatctctttattgatgaattttaagtcatttgggtttttccatacttatttctcattgaatgctccttttccagaagacctcacagttgtctgactgtgtcctccatcacagtcctcccagtattcaggacagatcttaggattcctctcttgagggtcacgtatccctgctktgtaattcacctcctctgtcctctatttcaggatgctcggctctaaatacactgcttgcctcaaccttccctttggattgtaagttccttaaaggaacttaggcagccgatgtttcagcctccccagaatctgcctcctctttttctggaaatagtaccttaattactcaagagaacctcctctcccactttgcatacaggccaagtggcatcccaattaagattttcttctcgtttctgcctggaggtgatcacatgattcagttgaggctatccagattatctctgccctgagaatttgagctttgagtagaatccctgtaagaatggaaaagagagagatctgattcctcttaggagagttttctgaagagaaggcaggatatcctgctgcttgccttgacttgcctacttcccttcctttataagccccggttgagtagcttcactttagagtatgcgagttgacgcatatcttgccaatacatcttttaattttgtcccagttggcccaaattggttggtttttgttgacaaagtatcctaatacagcctccatcttccagttcctatttatgtgtcatgatgatctgaagcatttcaaaagaatagtgaaggttattgcataagattcagaaagttccagtattcaatgggatcatagatatgaattaaaccaaaaaatattctttattatacaactttatttcttcccagagttttagaaatgtgtgagtttaaaatggagagttcgagcaggaaataactggaaattcatgaccattatctttaaaaatgattttttaaaaattttagaatagttttaaatttactgaatttttgtaaaatagtacagagtttccatatagcccacacccagttctcccactattaacattttacatcagtatggtagatttgtcacaattaatgaacaaatattgaatatttttaactgaagtccatagcttatttagattcctctgtttttccttaatatccttttcctgttccaggatcttatacagggtaccacactacatttgaagtcacatcctttaggctccttttggtgtgatagtttcttagaattttcttgtttttgatggcctttacagtttggaagagcatggtcagatattttgtaccatgcttccgattgagatttgtcatatgtttttcaaaagtttagactggggtaatgtgttttagggaggaagaccacagaggtaaattgccattctcatcatcacatcaagggtgcaaactatcaaaatgcttattgctgttgatggtaactttgatcacctggctgaggtagtgttcatcagggttctctttcttttttttcctccttttacacattgcactctttggaaggaaatcactacactgtgtgtagcccacactaaagagttgkaaggtgagagacagacaggtacaaagaaagaggcagttattaattccaggatttaaaaaaacaagatggcattatactccacctctttaagggtgtagtttgtatatatatattatccataattcttccacacaggagatttatctattttccttttttattttatagcttatttatattaatgtagatacatgaatacttattctataagtactggttataatctagtactagtttatttattatgttgctcaaattgttacagccttggccatggccattgggaactctttcagtggctcttgtgtccctttggcatactcccattgttgtggggttttttggtttttggtcttttttagcccttccttactttctggcaacacaaaatgctcttggcttatctctcatacttcctgctccagtcctagaatcagccatttctccaaggaaccctggttctttttagtggagaatggcattaaaaatatgtatctggtgttagttatgctcattacacctagagtgtcattgcttctaggtcttctcagctgaaagaacaagaagatgtatgtgtgtatactaacccatctgtatacacatatctataagtatttctctgtgtaatcatttgtatctattaagataaacatgaacacatactgatatctccaactctaatctttcaccacattctaactttgtcctcttgcttttctgtaagatcccaatagtgaaaatctggttcccttcacccaccattcattgtccagttccagcatagatgtattgtttcagaattgttaactcatactcctgtggagaacagctgtatcaactagagtacagtgcttatagtgcagttactgttacctttagccgtatagagtgtactcttagtgtaccttattccaaccccctgcagtgacgttgtttcatactgttctctttaaaattatgttttaaatttatccaggggataatgcatagctaaagatgacaattcgtgctgataggcttataataaaaactagcagcccctttctctcactccttstgcacctttacctgttccccaagaacaacactttcaactcttttagcygttcacatcaatttgtctaaaatctaaataatgtactttacagcttgagatatcaattttaaacattatacattgatttcctattattgtaggtaaggatttagctttattgtacctcctttccctgacctatttctttacaacatagttatttcacattttttattaaatcaacatttagtgtttacattgctttcctgtttgtttttttaaatcctgggaccaataattgactctttctttgtacccatttctcaccctataagacttttcccacatgatcaaacttaccagacagtatccagtttcttcttactcctagttcttacttcccaggaccctctgtttactcaggctgcttcattgagtgtatttatgcatagctaggaatagggctgctggtgtctgggaactgaatggggaaggagactaggtgggtggggggttctcattgtcttctatgtaggctttcatttcacctccttgttcttagattgatgtctcacctcacctcaccttccactgtgcccaggtcactaagtcacaagcctttctgagtcacttacagtgagactgatactactatctcctggcattggaaggatgtgggtttcagttgcctcattgggcatgaagggcttagggacctaagggtgtatatgcttttcatactgctttctaaaaaactttctgctttcaaccctatgacttaccctgctttagtggtatgtggtacctctaattcctgcaccttcctaaggttcttcgcagtaatgcatttgtttctctcaggtataccctaagattgccccatgggtacataagttactctagctttactgtgctgagtcagtaagaattcctgtatctgcttgacatcttcattttgtgtggttcagtgttacagatgtctttcgcctttttttttgtgctgttggttgttgtgagaggtgattgtggaaagaaaagggtgtgccaagttaaacctgaagtcccatacctggtctacattttgtatgaccacactaaactcagctcatgcgacctctttggagaaggtactcctgaatcttccaaagtaaatttctttgtctttggcttccacgtcattctgtctgtggcacatgccatactcttgtcattttccccactagacaataaacacatctagggcaggaatcatatctaactaactaacgtatgtgtactgtgaactctgtgctgctgactctactagatatcctcaatgtgtacttacttaaatctaagaatttgctacattaattgtaaactaaaacctctgagatatattatgttgctcaggtaccatctgagaagttatgtgtcaatgttgggctgaaactagaatttcacgttttaaagccttaaactggttttatgtcccacaactatgcggcccctggaaggtattcttgtgtgacctagaaaagattggaagaaattgaggatacttcaattagggaggttccccaaataacttgatttttctaattagatagagatatctttcayatttaaaattttatttctgtgcagatttgctgtgactttggtgtggcctaatctttagcagtaatcactttakcagtgaaatttaacttagaagtccagttagggttaagataaaaaggccacatgaggtaacaaatgagaatatgtactctggagttatacagatctgagtttgaactttagctccttcacttaccaaataaataagtcatcaacttctttcagcctcaattcatctatgttaaaattgggataatagcaatacaaacattattggtctgtatgaagattaaacaatataaaatatgtaaaacagcataatgcctggtatgtggtaagctttcaataartgttaccttcatttgttatatatatcatgacagttaatacaatgctgagcgaatatttgatgattstctgaaataacttgaaaaagtttagtgaaaaaattgggggatggagkggttgggaactgggcacagacaattcagccatctaaggaagcagtggcactttcttcactgagccctattaaattgaaagattgtgttctagcaccagggaagagtagctatatgaatcatttcttatgatctaaagtccattagctactccatttagctgttaatgttgcgaggccattggcggaaataaatatgttatttggtaatggacttgttttcttaacaattataatatattctttccaaatgctgtaatttaattctgccattstgctaattagtcagcygatcagccttcagcattgtttcaatatcccacccaccacatttttatattaaagctcatttaattggtgttgtgggttgaattctgttcctccccaaattcacacataccctaacccctagtacctcagaaggtgatcgtatttagagatatttcatcttgaaaagattaaaattaggccattaagctattagggtggggtctgcttcaatgtgacttatcagaagaagaaatttggacacacaaagggacactaggggcatgcagagggggaccaccttgtgaagagacagagaacaggcggccatckgcaagccacagaaagagacctcagaagaaatcagccctgccaacagtttgatcttcaacttgaagcctccaaactgtgagaaatacatttctgttgtttaagccaccctgtctgtgggattttgttacagcagctaagcaaactaatgtggttggcattgaggagcaaaatttagactggaatttctgatttattttattctgtatagcttataaagcacttatcacacacgccatttgaacttcacccaatcctataaagtaagtgttattattaactcccgttttacagatgaagccattgaggctctgagagtctacacaaacacatagctgctcagggggcaggtggaaattgaacctgggctatttgatttcaatccccctttctttttatgtttctcatttctctccccctttactgtgaatgtagagcatgcacctgttcttttctattgcagttcattcatttgtgcaactgacaggttaccactggtgactgtggattgctgcctaatgctgggctgaagaaaacaacaaatttgccaatctcaaaagagagcatttttatttattgctcagcttccagaacctaatgcctttcaattttctgtcattgttccactgaaagtgaagaatgtaatgttgatatacctcttgttttttctgcttttatgccactccatgtggttagaccaccttttaggtgttcattcattccacaaatatatactgagcacctgttttgagccccgagtttggatgtcatgtttttgaggcaggagttaatgtgctcagcatgaagagctgggtctgcacagaaaactgctgcttcttgagccagggaggtcttcccatgatactatattgcagcttctttgctgtaatgaaaatacagtacacctttccccaactcccaaattaagctttcagtgttcttcattctctgaaaaacttttatagaaattctaagaagtgtgcctcaaaataatatagtaagcaacctgatattactggttttatataatcttagtgcactatcttattcataattaaagttacaacggtgactatgtggaagtatcttggaggagaaagtgaatagatgaggtggggggacatttgagtaataactttgattttggatgtcttctctactatttttagattataatttaaataagttcatgtgtattatattatttcaccaaaaattttactttaagatatggagaatgctccatttttccccgtaagagtagcaataatttttaaaattgtcttttaaaattagattaaattacttaattccagagacctgtgttgttcttgtgtgacaacacagagtatgcaactttaagttactggccgtctaattaaaaagatgtttccaaagtatgaccagcattggaatttgttcagacccatatttataaacagtaactatgacaactcattcctcccaaccatgctcaacccytcatactttcccaactgtctgttttacaagatgacataagtagagggtttggaaaaaagaaaaaaaaatctttggatgataaacgctttttgcaaacagagcctataaagctgtttgttcagcagcatgtgaatcggacagtgggagttcatcagacagcaaggattaaccccctaatttgtttctctcttttggaagagaacagactgctgtgaattccgtgtactcagcctgagctgccaaacatgattgaaaactatttgactgactggtggccaaaacatgaggcagggaccattcatcattttcctgctcttcactaccccatataataagttttgttttgtttgaaaggagtaaatgtatgttacagttttcaaaccaatgtctccgacaacctaaaagcatttcaatattgtacccttttccaatagaatggaaagatgctacatatctgtagcaattttaaccaaattccttctagttacctccatttccaatgcagaaactcctctcaagtgaatacatacacaggttataatatacttgatgagccagtttctttaggatgagtacatacatgactggttttgatttgaccattgtggtgtgcagtgggcttactgtgtccataccagtgtcagaatagtcagtcctctggtgcttgattgggtggcatagcccataagattagctgacttttaaaatcaaagtaataggaggactatgcaatggagacaactcctcaacattgacccatcccctcagtccagttccatatgttccattgggaattaatttcctgcaggcatagaggagtcgtaagagttgcctctgccagagaagccccatctttccttgagccaggagtcagtagaagatagtaggctacaaaccatttgactatacctctatgatctcttgccactgaatatagaaaaggagtataaagaagcagtataaaatatgaaattgaattgtcagtggctagatagttagacatatagtctgggtattcaaagggagtgccttttaaaaatgtgctcaacccccattagcccatgaaatgcctcctttccgttcctacactggcatatctttcaccagaagcatttaaccagattctagaacctgtccattgggaataatttagtcaccttcttcaacttatttttctctttttcccctctcaaatgtcattttttttcacatggctccagtctcaattctcctcttattttatccattgtccccagtaacacactcttctttgtccatctagtcatacatcaatccacctatctattcatccaatcaactattattgagccccaattacatgcatgtgaagcatattctcaaagcaccatttccctggccaagctaggatgataatgagagataagatgctctgtttcagtttggttattcaaagcagaccctataataaggaattgggagcaagtagtttatttgttaggtaattccaggaagcaacagtgaggtaaagaaggagaggaaagggggaaaaaaaacaacaaaataataaaggtgcattaagatgtgagaaactgcttataggcaactgggtttagtcctgctgggaattttttgagaaactttgtagaacgtgcctcagaattgtgcccctgaaggatgagaaagctgagatgtttatccatttacttcagtcctcactggctaagagttatcttgggggcattaaatccctggcattttcaggatgccctcccagtaggctttgcaagccttagtactggagagagccttcaggcagaaaagcagaagacaagggcatgcatagtttctgttcacctaggctgcaggtgaactcaaaagtggatgcagaggttttggttggggtgggggtaggggtgatggtggtgattccatagcatctgcttcaacctctgtgttaccacccccaactgccttaaatggaagcatatcagagtttttcattttctggtaaagagtaccagggtgggcatttactctatgtaatgtgcagaaacacagcactgtgtttagaattggacttactcatttcctgagtatatgtatagcttccctttctctacaacctcttttcagcagatttatgcagacaagaaaaatattgtaacccaaagcgccactgcaaatttccctgtgctgacattaatcatgcccatttgatttattatctatcatttgaaaagaatattttgcaactcttgtgcattgatttttttttaccaagaatgattacatccatgcagcataactcttctaaaggctaatgcagtttgcttttatcacccattcactccctaattatggtgttttcgaaagcagacactatacctggaaagttgggagagaaatatttgattcacccatctttcagagaagaggagatggatttaaaccaggctagatactgtaactgattattgagtatttggcttggggggcttaatttaccagctaccattgaattaattgaaatataaacttctgtggatattaatactttcaagagtcaaagtttaaatgccatctactttggatccgttcaaaatattttcactaaccctttataatttaattgactttttaacttttttgttctrttttgttttaacacagcgatctacccttttatgtaaccccttctgctccacatatcactgggctggggccaaaagtaactgagtgactaatatctgggaaatatttattgaatgagtgaaagaaatccacttgggatttatacccaagaacaaatgctcattaactgtaaattctccttcttttgaggttcatatatagatgctctatatgtgtttatcaaacacctatcaggttatgaaaagaatgcaagaatgcctctcttttctctccatttatccaaatctatcatttaaggccctggcataatttctccttctttaatgaagctgcttcaatttcttccaattcagtgcttcatatacttggctgcagttggggagctgtaaaaaatcctgttgactaggctacaccctagaaccctagatgatttaaaccagagcctttgggtgtggaattcaggcctctgctttttttttttttttgagacagagtctcactccatcccccaggctggagtgcattggtgtgatcttggctcactgcaaccccgtctcctaggctcaagcgattctcgtgtctcagcctcctgagtagttgggattataggtgcctgtcaccacacccagctaatatttgtatttttagtagaaacagggttttgccaggttagccaggctggtctcgacctcctgacctcaagtgatctgcccgccttggcctcccaaagtgctgggattacaggcatgagccaccgtgcctggcaaggcctctgcacttttttttttttttgagacggagtcttgctctgtcgccaggctggagtgcagtggcgcgatctcagctcactgcaacctctgcttcttgggttcaagtgattcccctgcttcagcctcctgagtagctgggactacaggtgtgcaccacaacgcccagctaattttttgtattttagtagagatggggtttcaacatgttagccaggatggtctcaatctcctgacctcgtgatctgcccgccttggcctcccaaagtgctgatattacaggcatgagccaccgcgcccggctggcatctgcatttttaaaagctcaagttattacaatgtgcagccaaggttgagaacaccactgtacctggatgtgattgctctcttctctgaaaacctaggaaacctcgatattaaaagccacctcttaaggacagttgtaattggcctagtattctggcttaagttactctgaagatcaactagcctaaccacccttccaattccaagatacctctgacagccttctggttgtccagttcaaatccttaatactgacatggaacttattcccagtgcagccttgcccatctttgggcagctctgaccagtccagatataagtctgtctctttgtagcttcaagctattcttcctgtctctatcactttggggtggggctgggagtgagggaatctttctaacaagtgttttaaatgtctgaataatctatttattcaataaacgtttatggaatgcctcctatgtattggacactgggctacctcattgaaaagcgatgtacaaattcctaggaggatttgcaagccagtcctcctttcttctttttcttcttcttcctcttcctcttcctcttcctcttcctcttcctcttcttcttcttcttcttcttcttcttcttcttcttcttcttcttcttctcctccttctccttcttcttcttctccttctccttctccctattcttcttcttcttcttctctttttattgtactttaagttctggggtacatgtgcagaacgtccaggtttattacataggtatacacgtgccatggtggtttgctgcacccatcaacctgtcatctacattaggtatttctcctaatgctatccctcctctagcccccaagccccggagaggccccagtgtgtgatgttcccctccctgtgtccatgtgttctcattgttcaactcccactcatgagtgagaacttgcattctgtttgttgttattttgttattaagctgccacatttctgacataaaagaatatctttggctgcaatagtgaaagagaaaatgggcgtaagctgcaacatgagaaatttaggtagcagagcgatgactattaaactttgagaagttttctgtttaacgttgtgaaatctttccttgaagctttaaatatgacatactttcatgtgattctatttatatactgccttgagggcagagggcaatgccctgtgttccttctgagggttccttctgagtgactctaagtctctagatgaggtagccctgaggaagcaagaatgaatgattaagatacttcctgatgatgtttttaggggaaagataaacaaggttgcttcccctgctggctggtgttccccatcgtgcatgcatccagatgaggtctccaaggaaaatcttggtccagcaatgcttgactgtgccagttccctgatgctgatggctttgctgggaaacaaagcacattaagggtggatctaggtcactctggacttcatacctttccaaggcaaggaaaggccaagccccaggggctccattcacattattgtgctcctgaggggttgcgctcctagacttcatcagtgtcactggaaatgatacctcccacagtcatttaatgaggtagtcctgggcatatagcacagtggagataggcaccttgtcaaacaactggtgctgcagaagtgctgaaaaccctatgctgtctcattggagggaaggtaaggggtctcagagactctctcctaggaattagaacatggttccacttactccaacctagaaacacatcagagaggaattttatactccaggaaccaagctaactaagatgtttccaccacctttttttgcctgcttagatttcagatccttctttctttctaatacaccaagccctgagatgacatgggttccttctaatctcagagtgtgaaattttctctctggaatttaattctggtttattcctccaccttgccctgctttatcctgtggcatatgtgatgccacaatgcagttgtgacttccctggatgcatcagcgttaaagcagacacaagcactgaaaatatgcagggccagaccagcaggtcccgtacagctgaagttcatcatggtgttttacaaccaaccaattactcaattcattttatgggttgactgtgcccatcttttactctcatgaagcattttctatcgtaagacagaaagcgagggaaaagtgctctttcagttccaaaccctggggcatttatgcactaataaccttcctcctttgtgcttttccaaagaatgtaaaccaaagcaattaaattaaatggagttaacattggcatggtagcataaatcaaacgtcaggaaattcattattaaggggttatcgttcctttcttatgagctatctagtatctgccttctctgaggtaaaaataagccaaaaatttggtcctgatataaatgaggggactgcatgagagagagacagacagggagagagagaccttgtgtttagcagcagataggcagacttgtgatttgtgggcgaaacatgtttatcagatgcttgtctctttgcctcttaatcaggttcttcttcccatggcatgctaagcaggcaaacacagttaagcagtttacctctgtactcaacagttccagaactgaaagtaaacagccttgtgtgtttaggctgcagccaccgggctgtgctctgtagagctgccagatttctccacatcactgattctcccagtgaaaagcaaaggcttcctcttcattgtgttcacagactgaaagttgcttgcaggattggcttccgaagttcagaccctgatgaaggaaaatgatactccgagtctgagggtggcaaatcagaagaaataatttgtttggattcgggtctgattttaatttcaggagtctggggcctgaaagctttctgctgagtctgaacacaaaccccaaacttctcaactcaggttgcttttaaggaattgtaaactatttaaaacctatatatttaaaaaattataatttattcccaatgagaggatcctctccccagccaacgtctattttgcacatgactttctaatgaactgttaacaagcatttatattaagagcttgctcgggcttttgaatgatggaagataattctgatttacatgagtgatagtttaaaattccaggtgctttatttctgtttattggggtgggacaggggaaggactaaaactgcctacaaagaccctttcaaaggcaaaggaatagaatgtataacattccattttgtcagcatgaggaaggtcttatttaagactctctgaacagatgtgaccaattgtattggtgaggaggaatgttggaagataagatgttctgctctgtttgaatgtgtatttttagcagtgtcctattgtaaagaagttatgcccattatcttttgacttgctttatcagattaaacaaagatgctcatctttctaggctttctaatatgctccctcaatgcaagtctctcagctccaatgctgtgtgttagagtgtgataccccctcctgttactcctatttggctgaatttcagaaatccatttagatactctcacggttttgttcagcattgctcaaaacatggcttctcaccaattctgactgtctctctgaaacatgattaattttttctatgtctatctttacactgtagagtttaggttgaaaatatacttttactgtagtctcttattttcaggaatgtgtacgtaagcacccaaatgaattctactctgagatacaattacccatgtatgcttccaactgaaagcatccactgaaaaaatatagatagagaattcagtagctctgactgttagagcatctcagtaggcaaaagtttccttacagtaattgctatgctttggaaacagcattttctgtgtactaagaactcaagggagagctgtgttcaggtcaaagcttgggtgaggtataataagaaagaaccccagctggagcagtgaaaaaaccaagaggcgagaattttgtcctctctgaacttctcggttagaagattaagagggagatataggttccctgagacatattcagaaactataggggtttctatggcaacagaaatgaaaaatgaaaatacagtctcatcttctcttgttaagatccctcagtttcacatgagcccaagatcaaggagtcaaatacagagaaagtcacagagcaaagagggagccatgtttcttttcgtccagcagatggctagcaacaagaactgcttagaagaccttcacttgttgaggaattgagagaactgttgaatttccttttttccaggtgatttttgggaaagattgaaaagttaatccaaagagttggttgagatagagcatttatctcacttggtagctcccccagtggaattgaagtccacagaattgctgtctcagaagtttcattctttggttagctgtttccaaagtgtaagtgagtccttcacaaacatgattaccaaaagtaataaataaatacatatctggcagtgaggatgattttttttggagatttttagttttaaaccacgtattttactggaagtataatgcacccatttcccagtggttacatggaaagacttcgttcctcttctggttctcccagcaatgacttttcagtcactgaagaattcagaggacaatgacaactcccttcacaggatcatacagacacctgtcatttgaatgcctgggaaaaggataggaatggagatgtatctggttggactccaagataaggaaaaacttttgatgggcaattggaatgtcagcagatttatatctccttgaacttgggtctgtcaacactgccatgagaaggaagatgtttttcccacagagagacatttatggggcaaagacagacatcagtgtgctaaatcttataaaattcctttgcatcatccaccttgacagatggtcttcaggaatgtgctgaacctccaaaacagagggttgggaggaaacycaagagtgttcttcmcctgtcttctgtcaatgactacgacacactgaaggccacattgaccttccatcaaacatacatgcrggcttcaagccacccttccttcttccccgtaagggacaggttgaagcaaagatcatgctattaggtattaggtaacaagcctccacttacagagtatcctagggatgaaaacctttttgccttatagccatgctagcttcaaacatgagataggtaaaatcgttttgttttcaactttctttccatttacttccctttaacttttctattatgccacaaaggacaagtatgtgttttccttataaaaagaagttttggcaaaaaatgaagttttggtcctatagttyatagtggccccagaaaaaattgccttactatttccacaacaccattgcttgttttttgtttttgtttttttatatagtcccacactttcttttgctcctgtttcatttactaacttggaatgctcacgctcctgggcctgatacactcctaggatcacctaggctgggtgaagcttggccttcagaggagtagacagagcaggaaggatgaccactatggtcttagcttcctttagtatgacttccctttcttcagctggagtcccttccctaaacacctgcagccatcctgtggctttgcatagtggagcccagggactaacacgacagtggtctgagtgtctcagacttcgagactattgctttctcctctgttccaatctccaaaaagagttctatgagaataattgcccaaagagaaggtacttcatttggtagggctgggaaaagaggcatcagatagcatcttgatatggtgaaagatttgaacagacaaagatctatctggtgctagtttagttgccttgaatcatcgttacagatccctctggactatttccctttagccaatcagcaacttccccagggagaaacttgagatcttttattctagatttctggatccctaacttgttccaatgttcctttctttttaaaattatttttagttttcaatttaaaattttttcaaacatattttttaaaaatgcagaaaatcagagaaagggcagcatgtatatattcactacccagattgaacggttgttaacactttgctatgttttcatcagataacttgggaagaaargaaggaaggaaggaaggaaggaaatagtgcaaatatagttgaagttttactcagtatttcctgctctcttccctttcttccctatataatttacttaaaagtttgtatatattattcctatgtgcattttgattatttttattacatatacatgttctcataaaccacatagttattgatttttaatattataactttaaacaagcagcatcataaagtatgtatcctttttcaacttgatttttattcaacattattattacatttttaaagactcatccacattgatgtatctagctctagttcatccattttaattatacgaactagagttcgttaaatggtatagttgctctaaatgccactttactatacaaagctgattatgtttcttgcctactcataacaacccagccccaaactgcctttccagtcatcgtgaattacatgttcttggaccctttccccttggtcctcctgtctttcaaaagatgtgctacattatgtgatgaattaattgtctgtgctttgaccccagtgagtacaaacagctttgtgagcagcctctttcaggtaagagagttcatttgagatatgagattttgtttgttcaccattatctttccagcatctaggagagtgcttgattcttaataggtgtgcaatagatatttgttggacaaatgtctgcatgagtgagtagacggctgtggaattgggtttaatgctgtgattccaatgcatataataaggaatkaagttctttcctaaaatactcacatcacactctagcaaccattggcttcttgctagttgatttattctctaagaattgccacaatagattaaagagatgatgtttgtcaactctttcagatggtagaatccttgcttgcctcagagaggaccactgaatgtttgcaaagaactaccacaagccctcaccatggggaattggtgatttgaaaggcctggcagatgttacactcttttgccatctgtctcttggaagtagcttcaatttggctttcagtaggccccagcaaggtcatgaatatcagatttggtgagaaaacgccaagtgtgtagcttcagtcaaagggagacagcttttcccttatgctgctcttctcagcagcccaggcccatttgttcttcctctgtgtggaactggatgctccctcctgtagtaaatggttagagggtccagaatgaaatggaaagtggtcctgtatcatcagcagtagcttcttgtggactttgtcaccctcattcattcaacaattgtttactgaacaagtaattgacaagacattctaacaccgacaagttgtgtttaattcagaggaggagactgaacgctggtgtttccaaggcactaaataaatgctaaaacagggagaggaagcacacagggcagaggaacacttaggaggagcaccatactattctatggtgtggtggtcagcaaaagcttcctgggggaagtgaccttatctgtaaaatgaaatgggattaatacccatgttgcaagatggagccaatgtaaggtaatgtctttaagtttcctgctgcttgcttagtaatagcagtgatgaccatgtggtattgatggtgatgacagtgatagagaagaaaaaaaaatggcttcacaaccagatagtccggtttcaaatcctagctcttcttgtccttagctctgtggccttgagcaaatcacttggcttctctgtgcctcatctataaaatgcgaatagtgctaygtaccgctaccacaactgtaatgattgcagaaaatgttcacaaggaacctaacagtgcctagcacctggaaggcattcagtaagaggtgaaaatgcaacaggagcttgaagagaaggtagcagtaggagccatcagtggatatggagggaagagctctgcatgtggagtctagggacctagattctcatctgactatcactgagaagctgggtgcccttgggcatgtcatgtctggcattctctggagtctcccatcagtgcagagaggcccatccatgaatcaggtaatttttaagtgagagaaacacacaacaagcctaggattaaggatggtagagagattactgtgtgwtgctatggcatgggaagactttgtggaggagaaagccctcgggctggatgctgaaggccaagtaggtgttagactgggggagctaagtgaagagggcattccaggcaggggcatgattgagcaaaaggggccaagtcacgcattaagtatgtcagccgcttccctcatctcctcacctctggggcagccttactcgtggagaagaatggataataggaaggtcttgacttcagctcagaagtttgtttctttgatagtcaggactggttctgggaaaattgtcaagtcattgaagttagtctgtgcgaccattcatcttaatgtgagcaacccacgttttttgcctgcacattgctgccacctgggctaaacaagccccccactcccaccccactttgcaagcctacaaaatatgccctgtagagcagctcctttttgattcttatttccaccctccaaagcatacccagaagcacagtatgtcaaagcttagagggagctcggagttcattattttaagcccccttattttattatgaagggccatacccaaagataagcacttacgggcagaaaaggaacagagacagatcatcacggtctcccagttgtgttctttcttccactatgcagcctacatttctctctaccatacattttgatwacttaacctaggacatcaatacctatgtattaatcaggactcttgggattttaaacgtcaaacacctagagaaacttgtttgataagcagggaagttattggcttgtgtaactgaagagttttggtagggctgaatccargtttccagaagatgtcaggtgtttgcctctccttcacaaggcttaacttttctcagtgtggcttcattctcaggcaagctgcctacaaatagtgtccaaaaggccttaatggcaacaggcttatatcctacaaatagtgtccaaaaggccttaatggcaacaggcgtatatcctaccatcttggcatcccaagaaacatagagaaatgtctctggcataggtcctagatagggttttcattaatttggcttgagacatgtgcctactttcattgtgatggggttatagaactgtgatagtcttaaactaggtcaggtacccaccactgaaaccaagactcaaggtcagtctcacccaawccatggatgactgtggggaagaggaggttcccaagaggttaccaggtttctgtttccaaaagagagggaaatagatgttaagctagtatgtgttcactcacccacacatcaccctcacacaacccaccacaagctgataacagtttaaggtattgtattcctgatagcattagccttttgtgaaggactgtacgtgttttagttgagtataacatggaaatttggggtaccatggaaaggccagtgagggggttagagaaggtggagattttgtatttcagggttttttaggctccctcaaattatagcacaaaatatctactttgtggcatagcataaaatactttacttataaattctgtcctgatgatagccaggaactcagcctgagatgaaaaggtttccattagtgaaccacatgtagacaattgtaagttaatgctaattcattatcctcacacctgggctttccaaatttgtctacctcttttttttttcttaaccatgtattgcttatctttctcatgaacataaccaatgtcttatgagcccaagtcaagtagtgaacatcagataggaaattataattttgtgtatattctttccctcatttttgtggcctttttgtgtagttctcttgtgcctggagaaaactcagggtttgtgtgttaagaatgaagtgcttgcattccctcacccagatgcagtgcagcaatggggtacagtgggaccacattggaaggaggtaagattggtggcaggtagttaaaaggtagcattgtttactgtgggtctaatgcagtatttctggactgaatggaatggaagttttgcctaacatcttttagaaattgttttcaggtctgtttcaattcctaatgttcttttatataatttctgactcatttgcttaatggtttcatttgtgtttaaaaaagcaacatcaaaccttcattatttactttccgtgatgctttaaataccacagaattcagtaaggccatcaaagagacagagaggccaacattaaacattaatttttattactttggcaaagaattcttgagataattcagcacagaggaaccagtacaggtctctgatagctgtaccaagtgctgattaactcaacctcacaaaatctcttgcctgtcaacaattagtggaaacatacagaaatatctaaatatcccaaagatattggggagatatttggaaagtatatgaaaacatttagaaacatcagaagtttgaaaaacaaagttttccacatatatgaatgagactggggaagggagtatggtctgttttcttctcacaattttatcaccctggcagttattggtggagagaaggttctcagtaagcatatgacgtatctattactttatctttaccttgatttctccattcccatagctttaaaagtcattagaggagataaaacagggtcatttattttgtattgtcatatgtatggatttagcagcatgtgatatctttccttccttccttccttcctccctctctcctccctctctgggtattccctcctttccttcctccctttttctttccagtatttaatgactcctactctatgtcattgtctcttatgactgagagatgcataaggcttagtcttgccctcaaaaagcttacagttttttgagaggttacacacaagtaaatgggcaatttcaatatagtataataaatattatgatagaggaagtacacagtgcctttgggtcatttaaggagagcacttaaactcagggaatcaggaaagccttgtcaggggaagtgccatctaatctgagttttgaaggacaagttgagttagccagagctagttttctatggctgagtgggccagatgggaggagcctggacctgaatttaatctccctgctggggtaaggcaggtgtcggtggccacccccagcttcaggtgctcagatagagtccagtccagtagtcatagcatggtagccaaaggattttgccttgagttcataatcaagaaacgcctccaggccctggggagcaagagaggagatagtagtactggaagtctgccagaccttagaccttaggagagacacttgtatgaacatggtcaagtgaaattctagtgtctggagaccatgacacagctcagcctgcacagggcttgggacgtgagctttgtatgcacagtgcagtccaggatccagccgacagtccagttgttgcctatacccgcagtcaattgccatgttttttaggaagcctctgtcgagcgactctagaggtgtttctcccttccctcttattactaaaccttacagaagctaagcttgcttctaagatatcttttaggtttaatattcacaggattacagtgtctgcattccttagacgctcctatcatgctgtgctagtcgggcactgtgctaggcacagggaatgttgagataaaaggaasttggtttgttgtttaaactacccagattgtgcattgttaaaaattattatttttttggaactcttaaaattttgttttgcccaaaaaattacatgacactttcctcttagaaataagttagttatataatacagaaatgtaaaggccaaaacattaatattttccttctttaaattctagcttctttcaccagcgttaacaactgataaccttctcttgtgtatctttttagtccattttctatgcttgcatatccatatataattgtatcagttgagattccagtaggaaacagatggtacattcaaattagaataatttagaccgggtgtggtggcttatacctgtaattccagcactttggaaggccaaggtggaagaatcgcttgaggctaggagtttgaggctgcaatgaactagcatggtgccattacactccagtctaggtgacagagcaggaccctggtctctaaacaacaacagcaacaaaaccaaattaggataattgaggtttagtttaataaagggactatttatatgatgtagagagggtatagggaaagcacaggggatcatgwttatcaaccctaaatctgaaggggcacagagaggaagtggtcatggaaacctggacacagaaagggtgctgcagaaaggaccctctaatgggcactgagacctgtgatggagggatgcagccagttcttagcaaccacaggaaaggggctgggaataaatgcactccttcctctctgcttctaagcgcccccattgactgaaccctatgggaagccaagggaacaagaaaacctattgatgtagtccatataggtcagcccccttagccagagagctgagtggagaaaggtggagagtggatcagaggggcaaacagaaggtctccagtacaaatacatacatagcatatagttttaggagcttttactttctgtgcttccttgttacagaaatgagattgtgctgtagtacgattctgggactttttgttaacacaatttgtcttgaagcctttttgcatcagtatgtatggatctaatttaattattttattcattggctgcttagtatttcgtcatacaaggtatctgaactttttaaaattatgtatatgtaatagttggtatatacaacagaatatgtaccacctatgtgagttatgaagcctagcaataaaacagtcatctgtaaatttatctctcaacctaagatcactaataccatcgaccttagtcaatcaaactacttgacctcagatcatcaggcaatcaggcattagttagaattacctaaggagcatgcatgtgcagttcacaatagggtttgggtttctatgagaatctaatgctgccactaatctaactgacaggaggcagagctcaggcagtaatgctcacttcctgttgtgcggccatattcctaacaggccacagactggtaccagtatgctagctgggggttggggacccctgctatacagtcttcctgtgtcccctcaccccgccaatgctagtctgaagttttttgtgttaattctcttatactttttaaaaatagtttttccatattatgagtatgttgaaacaatatattatatagttactttttaaaaagctttataaaattgccgttttagttgtacatagtcttttacaatttgcttttttaacatagcattcatattgcagtgtgcagctgtgcttcatttattttcatagcttataacactccattgtgtgaatatgccgcaattcacctctccattctactgttgatggacttttgggtcatttccagtttttgctgtttcaaacagtgctgcttatgaacatttttgtccgtgtctcctggcacatacatacaagagttgctctagggtatatacctaggagtggaatttctgggtcacgaggtttacacatacttggctttgctaggtwatgccaaattgttttcaatgggattatgccaatttacattcccattagaagtatgtaagaattctggttgttccttttcctccttagtgcatggtatttgcagaaggcttaactttttaccatcaatactcttttcagggataccaagcaaaaacttaatgagagtctgactctgttatcataataaatatttttctacttttctctgtaaaaatgattttctctttcttgccctattttttttgcctcattgttccctaagtttatgtcatctactaataaattatatttaaaaataattaatacattaaaacaaatctgccaaatgggcctttcaattctttccaactctaaaataaatgtaattctagtagaaatccatatacaaatcatggttcataaaactgaaggttaacattgctrccatatggagaagttagctcacatacaaaaagagaaaaccatcagttctccaaatatttctttttaccaaatttgactttaacagcaaactggattgtgtgtactcttgaaaggaatagtgctccatcttgctctccctctctttcttcatccttccttagttttgttctttctttctttgcttcttttatgtattcattcactgattcactaaaacccagtggagaagacaaatgaattattactgtgtagcctgcaaatgggatgatgaggaatggacagatgtcttttggagtgagagaaggaaacttgacttctgtatttcttgagttcacttcagttcttaagataaagtaggttctactgagtatttgctaaatgaatgaacaaatcaatactctaaaatgttttcagctttttactcattgyagtgtaggaagagctacatggagttgaatttctatcaactagcccatcttttattactggagttagtcttctttggtaatttaatactcagagtacctcatatgatctctttatcgatgccttcaggagacattaaacgttctatcaattaattatacttaaaaagaataccttttggattcattcaagcacttcatcttctttccccaaatcttgggaactggtgtcagctccttaaaatgagccagcatgctttttcaccctcccatataagtaagagcttgtaatcacccagtgtttctctgacctagaaaagctgagaaattcacataaatgaaaacacaggggcttacaaaattgctttcggccctctcccttagaagcatatctggcacttggtaactggctggatggaatgtgggtactacatggagtgccctggtgctgctgctgctgctgctgctgctaggcttatataactttgaaatcagaaagcagattcagtggggtaggggagaactgcttttaacaagctgctgggattggctgaacttgtgctggccttgcactcttactattataaacttgatgtctttctcatttgtaaactttatttgcatgccagagctcagctgaatttgcctgggttcctagtttctttaatcttttgtcctgactggcttgcatgtaaatcagcttcagactttcagctgcccatatattgccctagtttgcactctataaagagttctttctttgtaggctcctgtccaaagcatggcagtatgtcttaaaactgtacaatatggttactattagtagtaatgagttgttattgagtgtcagtatgaggttgagtagatggagcaaccaaggcagcttagaactgagggtttcccagctaacatgctgtggaaccctggaaaatttgccaagctcctccaggtctcctattccatcctgccagaggtgatgtttttctttcctgctaggtatgtcatgaatataactgagaaccatgattctaaaacaattagaatgaaactttgtgattttatttgatgagataagcactgttttcatatctttacatacatactgcgttgttaagtcctattgtcataaccatgaattaaatgtagtcatttttatatttttaaatatagcaatgcaagaaaactgaactgatagagtgataataaggcagataagtgaaagaggaaggtgtttagccattcaagctactgctgaaatagtgaatctctttaatggtaatatatgagctggaatgtttatccttatcctttcctctagagaagattaatttatttggcaatatctaaataactgagaatggtatattcctcattcataacttagagaaacaatttggctacttttgttggcagaacctgaaatagcattgcccttccaaagactgtttaacttgatttcacaagtaaaccacaaaatgcaattatttgatattttaccatatcccattcccttctttcatccccataatgcagggggctgagtttggatttgcaaaccttactccttagcctaagcccttacaattgtttgtatgtaatgccagatgcatgttaaggaaggaatcctatagaggcaggttacttggagcgaagttttcagggtggccagctctgcccagttgccttctttggtcccagcgagatttgtagttttggtttctctgtttgaggctgggttgggtgcagggaccaagcaaatgaaaaacagacccttggggtataaaagaggtgagacataggtcaaacaacctatggctcctctagctgatacagaagatccatcaccaacaacataggtttatggctcagtcccatgacctgggtggaatatccggagcagttctggaaatataccatccattataatcatctgagtgcttgattaaaatgtatattcctttaaacacaaacaacaaaaacaaaaacatgtagattcctgggacccatgctcagattctgattcactagatctggggcgggacccaggagtctgcactgatgcagatgtcacagacaattctgatgctggtgctctaagagccacacttggaaaaattcagtttagtgcctctttgtcattcttccctttggctccttgcctttatttcaggaaataactatgaatatgactttcaatgtcacctctaggagctgcagccagacattcctatgatgtacttatagctaatctagttgagctccatttgagaggattctagatatattacttastagagatctggctttctagaaggctcccactggatccaggtaatgtccagtggcttgaacgatagaaagctggagtcagcagctggccttccagacccatacaaatcctctttctttggaaagcctctagcacttcactgtaaaataacagataatcccaggccagaattttaattagaaaagctgaatgacctgtaagtaaattattaagaatttcaatatcagctaagatcaatggaacagaacagacagccctgaggtgcatctgtagatgcgtgtacacaataattaagtttgttataaagatcctatatactattttctctgtatgtaatggtgggacctattttcatacaatccatagatacaattgaaataatacaaataatacaaatcattgataactgactaccatgggtcaggccttgttctgcacgatttctatatattctgctaatactcataataagcagcactttaagtattattactcttctccttttatagttaagaaaccaaggcacagggaagctaagtaacttgcataatgttgcacagcaagaaagtagcaggctggtcctcttggtttatttaagttaaaatgaaataatggaggaaattaggaatctgaagaaacctccattttcaaaagagtagaaaaatagatacctgaagggcatcgtggggtcataacataacaactgtgagaagtgttgtagctttttgtatgtttgtgaaatttttcaaaaatgtgtctaggtacagtagttgaagcttctaatgcatattggggttaattccaggactcttatcgtcactcagggtttgacaaagtaatagttatttgtattactaaaccttttaggctggaaggttttgtacattaatagatgttaaagatcttactgcagaaattactgtcatgattttggaagccctagtttaacccacattgatcataatatgtctctggcatggtcaagaagttcttttttcctgattcaagtactttataaagcatatttaaaggctggcttcaatctctctggagttatacagcccttctgttagtcctggtacaatccctcttgagaattttttcttttttttagtgttatcaaaaacacagtaagacgattgatattgcttagtactgaatcccggagttctgtctatgatcaaaatatcctctggcccaccagccaagattccaaaagtggtctcattatggttcatacccagttttccatcctacagccttgggttgagagctgcagcctccctccaaagtcccctccaggcagttctgggagttctgaggtgtttctagtctgttcagtccatttgttcatgaccccctgcttctgtcgtctcgttagtatatcctgatataataaaagtttgaaaatataatcaatgctagtaaggaacagagtcctatgctgtaccatttctttctgaagtgtagctttgttattaaaaacaataataaaaaaaggactggtacaaaatttcctgttctggaggtgtggagtttttcatatgtcaaccagctttaaccttttgaaggtttaatgaaatcagcaaatataatccactgtacgagagtggatatgaatcaagtctatcattgttgaacaaacggcattaatttccagtgcacatgtggatctgagttttaaaatattggtttgaaaaatgtcaagctgctcattgttttagaatatttgagcagcttgctagtatactctttttaaacagttgtacttctaaaaggttacagtgtttgcatatttattcctttcaatttaaaaaattcttccagtggcctgggtagtagggaaatacctcgaattcctttttttatggattgtacttcctagagggtattaaaaaaaactccctttcacttttagcagtagctgaagctacaggactcactttacaccccagcgctcatcatcatgtctccgggtgaagttctcttcagtgtccccagaagctgtagaattagattgcttaaagctcgtggaaaagcttatatctcctatgtccagtgtcagccccctaggaagaaaagagctctgggggaactaatgcttgttgagtgctctaaggaaccagggattggatgatgagcaggacggccatgggccctgctctcctggagatcatggttgctgttcagccagggtcagtggggcagagagcacagtcgtctcaaaagtgggtgtggggagatccatgaggatgttggaagcaaatataaaactgagggttttctcattttgaatttccattgttgcagatgtttcataatgcagatagtatattggtattttggtgcatcttttacaacaaacttaattattttgtatacacatacacagatgtgcttcagggctgtctgttgtgttccattgatcttagctgatatctttaagaaggattgacaactatattttaaaaatctaatctatctaatcaggaaattgatttaaacaaagcactccatgccatacaagatttgattgagctgttttttcttttttcccaagatgaaagagtgcctaggagcrtggttatttttgcccctatatccaatttagcacctctttcaagttaggtttgaagttggaagaattacaacatatttctataaaataatctgtttaatgatatgatgtttcatttcttactaaaacaaaacccttcccattaacttgttcgcttgtccccattttatcatatatgcctagggagaagtctccattaactggtttcttcctgctcctaaactgtatcctctttcttaagcaagttctccacactattagtttgctttcaggttcccctgtgtttgctctctgttcaaaactggtgatgctgtgaattgtagtcagctcaagtgacttccaggtgacttgccttcagcagtggctgctcatttcatgcactgcagaatccctgggtcatgctgacctgttgatgataccagcatcacagactgcacatatcaggcctgctttctatgatgctggttttccaattaactttgtgaaaaggtatatccctgcttatgtcttcctggttatccagctcctcttgcatttgatttcatcttcagcactcgtctgtttgccagttttccatagtagaaagatagattttttttcaaaaacgactcttcccttttagttccattccataggacttctaaaacagatacttgcattgctttcatttccaaaacaaaattatttgataattacaaaaataattctagaaaataattgtcatgttagtttgctatattgaatattttttgggacttctagatttaatgtatcacatttcactaattgaaagaaaattattatcagcaagataaatctgtttgggagtgtttacttatttctttaattttctatttttttattatactttaagttttagggtacatgtgcacattgtgcaggttagttacatatgtatacatgtgccatgctggtgcgctgcacccactaactctagttatatctcccaatgctatccctccccctccccccaccccacaacagtccccataattttctaaattaacatgcccctccataattctgaaatccaaattaaactagtatttctggtacctcaagattccctaaatggagcttcctgggtcagtacgccacttaatctaacttgtgaagaaagacttcagcactcaaactcattctgaccctgtggactttgcttcagctgctccctttggctgtagttctctttctcagagcttcatgtggccagctcttatcactcaagtctcaactcaaaccttactttcttggaaagaccgttttctggccgctgaggtctctgccactatctgtcatagaatttgattttattttttcacatcatgtgtcagtcyctggaattatttttgttaacttgtacatctactgtcctccaattagaatgtaagttgagaagaacagagccattgtctgtcaagttcattgctgtatccccagtacatagtatggtggccagcacacagtggtttgataaattcttggtgaatgcatggatataacatttgagaaatgctgcataaaatatcattcaatgggtttctctagagtgagatatattggtacagcattttccaaatatatttgactaagaacatgtatatatgccatgtgccacataatgcagttttgatcaatgactggccacatgtatgaaagtggtctcacaaaattataatggagtaggctatatcatctaggtttgttatgtacaccctatggtgcttgcacaacaaagaaattgcctaaatgacacatttttcaaatgtatccccattgtctcctactattggtctgtatgactgtcattatgtcagtaccatattgttttgattactgtagctttgtaatacatgttgaaatcaggaagtgtgatgtttccagctttgttgttttttcttataattgatttggctatttgtggccttttgtggttccatataaattttagaattgtgttttctatgcctgtaaaaaaacaaacaaacaaacaaacaaacaaaaaactgctattgggattttgatagggattgtagccaagcagcttggcttcaaaaatgcattttaaaactttttttctcctttctcttttctccttaatctcaagatgtaaccttgaagctaactgcagaagcatttccccttaaccttaaaataagacttcatgtccctctctttcccatcattatctaactgtatgctagtatctaattatgtgcttacttaaagttctgggacttaatcttgagacaggcagaccaaacccggaaaccctgcttcaaaatttcagataacctcaaggtagctagtcaacaacttggccattgttgagatgatgccagcccatgctccaggtggaccaagacccaatatagcaaccaaaacaagacacgcagatctagtacttagcgcgactcctgcttgccttccatatcaagtctcccctttttaaatacttagcttcttcctagaaattcaaagtggttactttggatagggaatctggccacttccccattactagttttggttaataaagtcactttctttctaccagatctctctcttgttaattggactctgtaagcagtgagtggccagacctgtgttcagttacaagatgacattgaatctttaggttgctttggatagtatgaacattttaacagtattaatttttccaatttgtgaactgcagcctgtaagttttgatatattgtgttttcatttgtttatattgaggtatttctaatttcctttttgatttcattttgacacaatggttgtttaaaagtgtgttctttaatttccatgtatctatagatttttcagtttttcttttgctattgatttctgtgtcattccattgtggtcagaaaaaatacttggtatgatttctaccttcttaagttggttaggactttttttgtaacctagcatgttacctaccttggagaaaaatttgggggcacttaagaaaaatgtgtattctgccactgctgggtgaaatgctccgtatgtatctgttaggtctgtttgatctayaatattattcatgtcctctgtttccttacttatcttccgtattgatgtcctcttcattattgaaagtgtggtatcgaagtttcctactattactgtattgctatctatttcttccttcagttctgttaatgtttgctttacatatctaggtgctctgatgttggatgcatatatatttataattcttatatcttcctgatggattgacctttttaatcattgtatatgtccttctttgtctcttgtgatagtttttgacttagagtatgttttgtctaaggatagccacccatgcattcttttggttaccatttgcttagaatacctttttctagcccttcactttcacccygtatgtctcactaagtctaaagtgagtttcctgtggagtgcatgtagttgggtattttgtttgttttccattcagctactctatgtctttggattgggaattaattcattaaaattcagtgtaataattgggaaggggaggatttaatattgcggtttcattagttgttttcttttagtcctatagtccttttgtcagtcttttcctttcttactgtcctcgtttatgttttcttgattttttttttttgtattcatatgctttaattcttgttgacatttttagtattataccttttcatgggttttggaattttcgtttgctgactcattttgagtgggatgtttttacattcactttttattacattttttccctttctctgggcttactcttgttttccttgaggttttgtgatcacttttatctggtctgaaagacttccagtccagacccaggttttattatgttctatcagccacccttgccaatggtgatattggggatatcacatactctgttatcaagcgagcaggtggtttgattctgtgcctgggtctgaatcacatctttgtcaacttttccctcacaggcttaaatttttataaaactgcttctcttagtgtgtcgtgttttttgttgttgtagttgtagttttgtttttagcttcttcttmttagcccaacctccttgtttggctttacagttaacctggcttaggtctccttatctccagtgagccaattttagattctcttatcctgtaggagcagaatgcccagcagtcagtgctggcttctaaatctggagccttgcaggttccctgacttcagacttactcactgcttgtgattctaatgcgtttctagtccacagagatgtttatctggttcttggaracaaactataaacatttttatgtttactttttatgtttcatctttaattatcacgtttggaataggaggagttttataatggtgtgaatttgctgaatcatgttgaccagaagtctcaccattacttctgaagcattttaaagcatatttctgtcctaatttcttgtccatagctctgtatgattctgacctttgaagactataataaaggttcatcattttttaatgtacttattgtttatactcatcactgagagaaaataagttacattacacagtagtcgagaataaacttctttaatgggtttatgtgactaaaattgtaaaggtcaggggaattaatgggaaatttgttttaattatgcattgatcacaaaacataatattgttttctttaaggaactgaacttgctggattctgaatcatattttattactaaacagaaacaaataaactcagattgatttattgaccctgctgtatgccaggccttgtgaggaatacatgggaaggaaataaaaaggtctctgtcattagaaaggctggtgtttctcagctgaaggctgaggttggagggtctcctcctcccctctccccagtagaaatctgtgagaatctgaaataggaggctttttaattttcaaactatgcaccctatctccatttcccagccccctaccaccaggggagtgtgtctgttgcccctcaactgcttcagaactactatcagagccacttttaccaagaacatacaccatagcaattggacattatgaaaacaataaaatatgtaattaaattctaaaatgaattaggatgctagatggattgagcatacactggatactaggcaatgcattaggaccttccttacaattgctgttacatcaactctgtggacagatgttaacatccatttttagatacacaaaagagggagcgcagagagctcaagcagcttgctgaggttcctagtaagtggcagaggtggacttcaaatcccggcctgcttgcctctgaaacccagatcttaattactgtgttgtaataagagggagaaagacaaggttaaaatatgtcctactgtattgtggtttactgaaggaatttatggagattaaaattcataaattgttatagagttaaaacagatgaaataatgcttctttgacagaccatttagttttttctttcatctttaaacaaygctgcactaaaatttgtctgtaatggcataaaaaaaaccctgatatttgccttttcttctccattccccatgcttgtcaatcgttacagagattatgctcaaatgtgatatcaggaaatacttttagtccccagcttaagcttctcatttctatgtgaaatatggcagacttttgatgctttctctaaggtcccgttctggatattctccctgtgttcaaggcccttttagggagagagccagtctatggccagtcttgccaactctgtaaatgcaatttacattcttaaaattcgctatcaccaggtcaaaactagcccctggtgcattttgggaagcttcagttcaaacacctgaattcattttcaccaatgctacctggttaccttgtaactccagagttttttagagaggttttgtatatgattgcttgagctatagctttttccctttttgyaagctattattgaaataaaaacgtaacttacctatttcacggtgtatggatgtttttaagtggaataagttcatgctgttttaacttaggttcaccaaacaacatttttagaatattttcacctttctaaataatgtgcttttgattgatactccctctaattcaaactggcagtgcatagtaccctaaaccagtgcccgcataagcagtctgtataaaacatgcttatgcttttcagcttcccaagtgaatctttcctagagagaattgtttttttttttgaatgtttgaggtcatcttacaataattatgcataatcagtaatggaaacaatttaaagagtttacactatgtgcccggaatatgatcatgataaacaagtcatctcatttatttcttacaacacactttttaagggtaggttcgtattatcattcccactttacagagagagaaacaaaggttagagagattaagtaacttgctcatgtcaaggtggtagtgagaaattattgaaagcacccattatgccatgtgagtaagcaaaaactggcagattaatttttagcatactcaaataaaaggtcatgcattagaaaaaaagcagtcaaaagtagcttctgccccatctttagtgaagcatacagagggatatgattgaaatagtcctcagctctgggtcaaactctctggcttctattttcaggccctgccacttgggcaaacattccttctctgtggaaaagtagaatgttggcyacaatctcctaaagtcattctagctttgatagggtgtgattgtaggagcctgcaaaggaatctagaatcattgtaggtttcctaatgtctgtagctctatgcaattaaaaagattgagtaaatcttgggagctgtcaagaaggttcttacagtttatatataacatacaaaaaaatgtataggatatatcatagttttgcttgctacatctccaaaatctagtggaattcaagaaagtttcagaaggaaccaccaaaatggcatgatgagactattataaggggtatagcaatctttagcctgcaaatagagaaaaaagtcttatttagaaatgtctacaaaattatgattgttatgtatttcatacttaagaaagtaattttagttgagataaaatgaagtactgttttacacagtggatgataattttgtggaactttccatctgtagaatcaaaacataaaaaataaatgtgaaaacaggcaaatgtagaaataacagtccatcatggattatcaaaggacactataaagtatggagttctcccctaaaagctggtattgatagggatcttagttattatgccttcctactgtatgtgccagggttccaatggaagttgtcaatacagcatagctccaattcaggaaggcaaattttaagtcataaaaggttctgtttaggatggcagatttccttaatcattaattttattagtagtataatataatgttaaatttttgttttggttccagttgaagagcagcatgatgataggaatttgcactagaaaacaatactaatatcacaggaaaacattaagagtttcttctctctgaatagtggtcataataagcccatccttccttttcatagaggttgatggtgtctttggagatgatctatctcacggcctcctcagggcaggtgtccattgtttacctggcaggtgttccttgcacctctgcttgaacactgcccatatttggcagcttatcctctggggagtactgttcccttgtgggactgctcaggtttattctttactgagctcaaatctatgtgcatatgctctttctcactggcctgattattccttcagggcaagtctactcttcttgcagatgaagcatctagccccttacagtcttctcttctccagtgtaatatattctgctgctcttcaagcagtgcatttctagacactggaaaatcctgwcagttcttttctgaccacygtctcttttccaaactctttcctcaggtgtcctggacggaaacaaaagggagtaaaaaagtgttggatttatttagaataaaaagggagtattacttcacataatcaacagcattattttatttttatcaatgaaccttaaaatctttaaaaacattttcccatgactgagatactgttagctcaatatgcttgtggccaccacctgagtttcctgattgttgccagacagaccgctatcaactcaccctctcaaagtgcagtgtgtgcttcagatttatccccactgaattatcttgtcagttttaagctattatttgtgcttcaggatattttacaatcttgattatttggtccaacatattaatgattcatcttatatttttatcatcttaaaattcataagaatatctccaaggtattgatggaaatgttaaacaagattgtatcaagggccgagttaagttaagcaatgctaacattcaaaacttaatgagaaatataatttagtaagaatggtactttgatgcttgtatttcctttaatcttgctctaatttatagcctattaaaatatactgtttatgctaataaatacaaattaaattttaaaatacatgtttttgtttgtattgttttttcaaaaaatgcacaattgagaaaaaaagtccacttttctttctttttttttaaggttttccacaggttgtgattattcaacacatggctacaatcgactratgagatttaactgatttaatgtatgataatataatctaatgacaagtcaaaataattagggggacagggacaacctcatgagtgttgactttaaaaatctaaatccacaacatgacaataatgtcacagtgtccattgatgaagaaagtgaacagtctttttttaatgatgttcttttattttagttgattgcatttagagagaggacaactaaactattcattctcctttgtggtatctattaagttttaaaaattaccttgtctttctgttattttttttatttatttattatactttaagttttagggtacatgtgcacaacatgcaggtttgtcacatatgtatacctgtgccatgttggtgtgctgcacccattaactcgtcatttaacattaggtatatctcctaatgctatccctccccactcccccaaccccacaacaggccccggtgtgtgatgttccccttcctgtgtccaagtgttctcattgttcaattcccacctatgagtgagaacatgcggtgtttggtttttttgtccttgtgatagtttgctgagaatgatggtttccagcttcatccatgtccctacaaaggacatgaactcatcattttttatggctgcatagtattccatgatgtatatgtgccacattttcttaatccagtctatcattgttggacatttgggttggttccaagtctttgatattgtgaatagtgccacaataaacatacatctacatgtgtctttatagcagcatgatttataatcttttgggtatatactcagtaatgggatggctgggtcaaatggtatttctggttctagatccctgaggaatcgccacactgtcttccacaatggttgaactagtttacagtcccaccaacagtgtaaaagtgttcctctttctccacatcctctccagaacctgttgtttcctgactttttaatgatcaccattctaactggtgtgagatggtatctcattgtggttttgatttgcatttctctgatggccagtgatgatgagcattttttcatctgtcttttggctgcataaatgtcttcctttgagaagtgtctgttcatatccttctaccacttgtatggccatactgcccaaggtaatttacagattcaatgccatccccatcaagctaccaatgactttcttcacagaattggaaaaaactactttaaagttcatatagaaccaaaaaagagcctgcattgccaagtcaatcctaagccaaaagaacaaagctggaggcatcacgctacctgacttcaaactatactacaaggctacagtaaccaaaacagcatggtactggtaccaaaacagagaaatagaccaatggaacagaacagagccctcagaaacaatgccacatatctacagctatctggtctttgacaaacctgacaaaaacaagacatggggaaaggattccctatttaatgaatggtgctgggaaaactggctagccatgtgcagaaagctgaaactggatcccttccttacaccttatacaaaaattaattcaagatggatgaaagacttaaatgttagacccaaaaccataaaaaccctaggagaaaacctaggcaatactgttcaggacataggcatgggcaaggacttcatgtctaaaacaccaaaagcaatggcaacaaaagccaaaatcgacaaatgggatctaattaaactaaagagcttctgcacagcaaaagaaactaccatcagagtgaacaggcaacctacagaatgggagaaaatttttgcaatctacttatctgacaaagggctaatatccagaatctacaatgaattctgttatgtttttaaaataattattccttatggactttcagtctaagctaatttttatttgttctctccagcaggtctatctttataacattcaagctccccctactccttatccttggagttcacttttatggggacaaaagatgagttttctgtgctttggaaagcatgattatgcttcatgttagctttggaattagaagaaatcattttcggaccattttttttgagttgtgatacacaaacattataaggttaatcagcattttggcttattagtggcccttgattcttaggaaactaagataattctctttttcctgcagatgtgacatttgactatgaatattgaagttaaacttcaattcattgtattgtaaatggaaaagaagagtttttcattttaggtatatrtacataatacatatattcttttccttggctctcatcatgtttatattagatacaaaactagttaacatgtctagtctggcatttttcctccaagatatataaattctaataaaaaataagacaagattggggaatggggataatagtattcttttaaacaaggatgcaagaaaatgaaatgtttaatttttgcaacatctcctttctaaaacaaaatatactgatggaaatttggcttgtttcctagagtctcaacacaggagttattaactgcgatgaccgggctaatactatgtgaggtggagtatgataaaaggattaaaagctagaggtactgtgcttggatagcaagctggatgcttgtgcaggcatggagcctttcaaagtaaagttggctccttgacactctgtcctgcagcttgcgctgatttttaagatcattgaaaatcaggtcattgagaagtcttcttttagggatgtctgtaacattctttgactgtcttatgtttaagctagaatttaagcatccaaataaaagttgttctcaggtgtcatcatcataggaagccattcagctaccctaaagttcactaaaaagtcctggaacttgaggtgattgacttctgactccccattgtcagtgtggtccagggacatggcaggcaggagccaactgcttaaggtagaaatgctttgagtaactttcatttaaactgcacagactatcatggctgggtatttttcaaagctacatagggttctggaattttagaaaccattaggggccaagaagaatctktcagcttatagatctaaatgttcaaaatttaagttaaagcctgtttcttttggtaggaagcaccttgactcccattttttataatgaaagattgatgatatctctattagcctgtttaaactgagccataaaagagtctgtaggaggccaggtacagtggctcatgcctttaatctcagcactttgggaggctgaggcaggcagatcacttgaagtcaggagttccagaccaggccaacatggtgaaaaccggtatctactgagagtacaaaaattagccaggcctggtggcacgtgcctgtaatcccagctactcaggaggatgaggcatgagaatcacttgaacctgggagacagaggttgctgtgagccaagatcacacctctgcactccggcctgggtgactgagtgaaactgtgtctcaaaaaaacaaaaaaaaaaaagtctgtagggtaccaaatgcttttttttttttggagacaggatctggctctgtggtacatactggagtgtagtggtgtgttcatggctcactgtagccacagtcttctggactcaagtatcctcctacctcagtccaccttcccctctccagtagctgggactatagacgtgcaccactacacccggctattttttttttttcaatagagatgagttctcactacattgtacaggctggtcttgaactcctggcctcaattgatcctccctccttgacttcccaaagtgctcagattacatgtgtgagccaccatgctcggccttcttcttttctaaaatcccacccacttagcatgacaaaggcctgggacataatggtaagtgaatagttgtaaggaatgagaagttttagctgtgcactgtaccatgcttggatttgattatgggaaagatgatcaatattaacatagaagttacctaaactctctgtgtcttttcccttacctcaggaagttcaaatacaatgttgtaattcagctcttctactcttcctgtcctctcaaatgagacaacttatactgtggttgctgaggctaaatagaggaggaattcaaatacatggttcttctacttaagagaagatcatctccagttgcatcaaatcatgacttctggatgcaacccagttgcctccatttcatgagaatggtttccttccatagacattctctgctgttcccctatcattgtcaaatcaatgtttaatcaattccagccatttcttgcaaatccactgcaatcacattttataaatctacctagtgcttggttttcatgcgccgcagataaattaggtccttcttgttttatcctgagctatcagtctagtaacatgctcacagcatgcaaccaggaataggcatgatctcctttttgtgagtctaatctgagtgtcctttacaagtaagaggggatagtctgagagtggaaacagctcttttcaggaccagctgggtgatccatgagcatttgaacagatggcccatttttgtgggaaaggattctgtatcctacaagctaacacccaacagcttcactgaaaaaaaaaaaaaaaaagcttgaagataagaaatcaattcaagaggaacccacatgtttgctgtgttgcctctgaacacaccctgtatgtcaagagcttagctttattctgtagaccacctagtcagaatcattggggaggaaaatatttgttcaaacatagtcccttttgtctgtgctgggcaatagcacaatacattcagcaaccaccctctgaaagccaaggctttgtctccagtggggattatgaaaacatggatttcttgagaagtgcctgcccacctgtgtttagattttaaattttaggaagatgcttgacagccagaaaagaggtgctcagggaaaagtctgttgagattatagagactttttgaaagaccattacctcctttaaaatgattagaatagaagaggaattcttgaaaactggcatggaatatcgtattagatggaaccttggaaggttttatttatcccttctcttttagctttctgtctaaggcctcagawtgtagtctattttagaaaatctccaaggcaggaaatttttcataacctttcccctgttagtcattttttttaacttcaacaaaagcctgcatcagaagcttcttgctcgcttatatgaccctaacgctcactgctgcagtccaagcctggcttcctttgcactttcttttgctgttcatattcttcacagtgggacctgtcttagctgaagcccattattaggtcactccttggcctcttctctaaggctaaataatgagttatttttttttctccttttttggtacatcatattttttcaaccatttaatgatttttgttgttgaaaatttggggatttcctgtgtctggaaatgcattaggcctcaaactttgtacccctaagacttttcctgctaccttttaaaagacaccaagtaaaattaagactaggagaagacagctgctgcaatttttaaaaaatcacaaaagcaaaaaaaaaaaaaaaaaaaccaaaaacaccgagtagctgtctttctggtttttgattgagcaagatatttgtaaaatgaagcatactttattgtcagatgggcctgttgtttactgacaattgaccaacatgaatgtggtcaggtttagatgaatatctatacaactcacataatttttaatgaagggagttaaaagctaagcatgccaagaaaataagtatgactcaaaagtggccctttcttagtatattggatgtattatggcttctagttaccaagggcctttgaagatgactgggccattattttaatactttttaatatgcttctggattcaattattgcagatttttacaattatatttgatctctagttagtttataaggaggacactatctttgtcaggttttaatatcaagattgtgatagctttgtaagtaaatgtagatattttctatactttttctttgctttagaacagttgaaatagaacaagatcaatctgacatctaatgtttggttgaactcacttgtaaaactgtctgagccccttgacttccaaaggtaggtttttgataattcttgctatagtttaacatatcacacatatggaagactttatttatctatgttcaatctagagaatagtaatggaaggattacacatgttctcaccactgagttgcagaaacagaacactatcagtgtctttgaaggtcactgtgttcccgtacctgatcacctcctcctctctgccctaacccccatttgacataaacacaatgctaactttggtataccattgctttgcttttcttcatagttataccatctttgtatatattattactgaagattatattatttagtttagttgaaatttatattatagaatcataatcttctacttcttttgtcttttttgggtttttgttttttgttgcctatttttgttttgagattcatttatatttaataatgcatcactaggtcattttcagttcactttactactttgtaatagtccattgtatgactattccacaatgtatcgattctactgatgatggacatttgtgtgttttcagtttgagaacttctgaatgtgtctgtatgaccgttttggtccatgtctcctggtattagaattcctctaatgtttacaccaagagtggaattgttggattgtggaatgcccatatgttcaactttataaggatatgtccaattgttttcccttaattattttaacaattttctgcttctaccaggagtggataagaattcctattgctcagcctccttgccaagatctcatttgtgtgattttaaattttttgccagatagttgtaaagtggtatcttattaaggatttaatttacatttacatttccctgattggtaatgaaattggtcaccttttcaaatgcttgctgtcattcataatttcttttctgtgaaatgcctctttatgtgttttgcctatttgctttttgggttgcttggcttttttattgatttgtaagaattctttacccattttgaatataaatcattttgagttatatatattgtaaatgtcttcttctaatttctagcaactcctctcattctatgatttctcttgatgaacataaagccttcattttatgatagttaaatttatacatctactattcatgctttgaatttttattctatttttaaaatctccacactgaagatataaagatatttttctctgttgcacttaaaactatcattatattgtgtttatttattttccatcttcccaccagaatctaaattcaattaaggctagaatatttgcttgttttactcatttcggtatctctagcacatagtgggaactcaataaaaattgttgaaggaaaccatgactgaatgccagagagggtgaaatgttcttcagtatcttgcattagctcattttcctaagaatgcacatcctctgaggctatttcctctccctagtcctgccatatttttcatatgtctcattttcatctcataatcaggtggatccatttggactcagtgtcttcatatgcaccagtaacagaggggcttgtcctcaggctgctgtctgcacatctttgatttcgtccatctccactctcagacctacagctggcctgcaggtggatgtatgccgttgtcattctggttccttctcctagcaggctttcatccagtgcatttctgttcgactgcggtgtattcttcccctattcccaaggccctcattcccaaggtagtcagggctaatttagtctgcctcgcaaataacaaaccctacatttcaaagaactagagttcccattctgcctttctagttgttttgttacagctgctactgctgttgttgttttcagagtaactttttactctatactgcatttggaaaagatgatggtgaaaaggaagttgggggaaaggaattggtcagtgccttgagtgcctcaggatgcagaacacaaggggtagatgggcaggtgcccacttctctgttgattctaggccatgcttttgctcaaaggaatccagatctggcaacagaggcagtgaagggactgtgcattttcctagcatttatcaggtgatatttttcatgaaactgcagtttactgcatttctgggtagtctgtttttgtttgtttgtctaactcagatccaagtttattataactaatgttcttttatgcctgaccctgacataagggagattttcagtagccttgtgcattggtatatttttctgggttatcttttgtgaggtaacattaaggaatgctagccacattccattttgagtgaaacctcctgcactgctattttctaagtgtatgcagaagctcatatatttggaaaattcaagttcattcaaattgctactgaattagaagtatctttttgtcattacctagttttaaatcaatagatattaaaattactactactatttcattgttgccccagtttttttttctgatttaaaaaaatatactaaaacaagctctcataatccagagaatatgtaatcattcttctatagcactataccaaagaccttatcctatgggatatcgcttagtttcctatcattcaaaaaccatctttccaattttttaactaccagtttaagtaacagtaagtagattacagaatggagaaaacataaagaagtatgatcgtaaacaacttcaatttttctgaaagaaatctgaaggataaaataatagcttccttgacttagttgttcctatatattatctgagaaaaagtttattgaagcacatttttacacttttaatccactggaacgtcactgagaaaatgttctgagagtcataagaatgttgactaattgggctgtttgtcccacatgggattacaccactactttctgaatcagaagttcctgctattgcaacatgaattattctttattttttatttttccctcttagaaacaatccatttgggttcattacatagccatttgttagtttgggggattgtgcttgtttgtaactacaatgaagtcatactagactgggtccgtatgtaagtcagtgggagatcgtgcagctgctcagtgaatcattcagtgcaaagggtcaccctaatattttaaccccaaagtcctgctttcccaaagtcatgggtaatttttattttaatcatcaagaagattggttcaactttggtttacttagtacatgttgcacatacatatcaatctgtaaaacttctaaaaaaattatattgaagtataatattctcagagaaagtgcacgaatcctaagtgtatatggtgaacttttacaaactgagtacacctgtgtaactgcyacccagatcagaaaacagaacatgaccagcaccccaaaaggtttcctctaccccctttttgtcacaaaccctcctcaccaagagtaatcactctcctgttttgcgtgtttttatactttatataaatggatttatacatcatgtgttattttgtatctggcttctttcattcttcattatgtttatgagactcatacaattttatcatgaattgtgttttttcattttccatttctatattattgctatggagtgtcctattgataaatacaacacagtttattcattctattgtcagcagacatttcatgagttttctttctttttttttttttagaagggttaggcctattatgaatactctgttatgaacattccagtacatcttttttggttaaagtatacacacacacacacacacacacacacacacacacacacacacatcctgttggatatataacgaggagtagcattgctgggtcatagttttgtgtatgttcagatttaatagataagccagtttttccaggtggttgaatgtacttacactagcaatgtacaagagttccagttgctctacctcctcaccaatatttggcatattttgtctttttcattttagccatctggttcaatatgtattgaatgtggtttaatttatatttccctaatgataatgaagctgagtatcgtttttatgattattagtaatttgcatatctttctttgtgaattgtctgttcatatacatatatatatatgctgaatattttctgtttttcygtgggttaccttttcactctcttagtggggtcttttgatgactagctttcctagtttaaaaaaaaacactctcacatattaaagatcttagtaaatatttagaaaattgttaaccaatgtgtgaggatctcagtagtgacatgtttaactcaaaatgtaatttattatttttttcttttatggcttataatttttgtgtccagtttaagatatctttgcctactccaaattggtgaagttattctatgccttcctctaaaatctgtgtttagatatgtaattcatctgactacatatttgtatgttttataatgatcaagatacattttttttcaaaccaatattctatataccccagcatcactttacttggtttataacttgtttgaaatgtgtccacaaaatttagtttcagtgaatttttaaatattttcttataattactaatatttcctaagaagaattttaaacctgtgatgatttcaaatgtgtaatataatttctagatttatttaatactaatgtcagttgaaatttcccttaaaagttctcctgttcaattggatctagttttgaaatccagctatttatttattcaacatcaatctataatgcataaaacaattttttaaataaattattgttctcattttctcatttaaatcaattcaacacatgtttattacgtttcttctagaatttgggacagttacgaatgtggttgaagtttcaagcttcatttttatatcctttaggttttaagccatataataaatttatcaaatatctgtcagtaataagccaatttcttttcttttttttttttttttttgagatggagtcttgctctgccaccccggagtgcagtggcgcaatctcagctcactgcaagctccacctcccgagttcacaccattctcctgcctcagcctcccaagtagctgggactacaggcgcctgccaccacacccagctaattttttgtatttttagtagagacagggtttcaccgtgttaaccaggatggtcttgatctcctgacctcgtgatccacccgcctcggcctcccaaagtgctgggattagaggcgtgagccaccgcacccggccaagccaatttctttagtagtcaaaattatattaataaagaaaggtacaaagtgaggatttttattactattaggatagacttagaccccttatacaattcctcaataccaagttttccactaataatgacacatatctttaaagacataaaaataggaaagaaaatataaaagtttcatttttatattttgaatacctataaatgtttactctttgatgtcatttttgcttagttttattttttaactttttattatttgttctaggttgtactggtcagtggacatctggacagctgggatgttgggcagggtgccatggatgatggcggtggagcctttatatcatgggaagcactctcacttattaaagatcttggtaaatatttagaaaattgttaactaatgtrtgaggatctcagtgacatgtttaactcaaaacacaaaatacttaacagattagttactayggtatgttcaaagatcctcttgaggtcagttgattcccagaaaagaaacaacttatgctcttaaaraaatttttattcatgtgtacgccagacatctaaagtgtcaaatgttattatcagccactggggaaaatgaacaagcaaayaaaactgaagcaaatgtaaccacaccagctaaagaatatgcaaggaaaatatgatgaaatgcaaagaaaaatcagcagcacctcctacttcctttcccttattcatcttaacacattatcagactattaggacaatggataaaggctggtcgtctttccatcatagaaataaaagagtaacctagatagaaagaatgatttccatagccacaataaggaatccaggcagataattctttgttgcaaggtctgtcccatgcatgataggatgttttgcagcatccctgacctcttcccactagaagccagtagcaccctcccctaacctcaagttatgataacaaaaatgtctccagacattgccagatgtcccctggggggccagggaagcagttgccccattttgagaaccactaatataaactaataaaaatatctaggtaacctgaatacagggtcattttgttaaagaaaacaaactaattggaaatcttacattgtatatacacttttaccataattaccatacatgacagaaaatattttgaccacctactttgctttttataaagcactttgtaaaagctgggcatataggtttaaaggatgtcccctgttcttaagactcttagaatggagtgggtaaccttcacacatacatacacacatagttatcaatatagacataatttcaacatctaattttagaattggggaaggtttgagagagaagttatccagcaaataaaactgaaaatcacacattccttcacagaaaatctgggagacgctatgttaattctctcctcctcttctcttaaaaatattcccttggctatctcttctttctgtttctcatatcattccagaaagaagtgggttctagaggaaagcaggaaaaagtcgaacatttttcctcttcaaaaatcaccgataatgattttggacattaattttatttcagtatgttcaatcagcttgattggaagcacagtggtggagtaaaaagagaaattttctttagacccatttgaattggactttaggtcactttactatattttggtccttaagcaagtcatttgaatgctctggacttcatttttctcatctctattaaactgtaagcttcagagtatttcatttgctctagattggaataaaaattgtatcttctttaagctttgaatcttacttcttcggtattcagcatgggaccctaaatcactgttaattgaattgaattcagttgcatggacaaatgttaaataccatgcaaaagtgaattgagtatcttttaccagttctcaaagtacatcgacttcagttgcttttgatagctagtgaccagtctctttaatttgggacttaaatctccaaaagatttctgaaagtctatgtaaagatatgaatagaactctaaaataaagagtaatatttcttttgagtaggcattatgaggcaccatagtatactgttaaaaacataggattctggagccagactgccagggttcaaatctcagctctgcagtctgctaggtgtgtggccttaggcaagttactttgcctctctgtgcctcaattttctcatctgtgaaatgggataataatagttcctatctcataaagttgctttgaaaattaaataagcagagtatacttagaacatgggctggcccaacccaagttatcaataaatgttaacttttataacttaacttaataagcatgattctgacagtaccatttttttaatataagagaagatgataatttagtttacctccatccccattagtgattgctttgcctcctaacttttagtatattagctatactaatgtaactttagggccagttgctatgtatccctaaaatatcctttccctttactacttaagtcaccatcccttgtatgatagaaacccagtgacccctccactttttttcatttcacactaaatttttagaagtcttaaatttctcctggttacttctatatcctgcttatgtttaatgcccagtatctactctgcacctcactttccatgattgcacccattgagtcttactctttaattttgaaattgtggatttctatttgtagattgcctatgtattttaacatgaagagctaggttcagcatgtgatgtgtatgaattctggatgaaaattgctgatatacttgaactagaaatatgcccttgggcttgaggccaagaaataggttcataattatattacttaattacatggaatccaatctgtttaattggtaaaatgtgaaagctctgtggcaatctctttttccaagaaaaatgagactccttttggatgctattccttggatgatgtgtcatgcagcatgtcagagtccctcagtggagcgtgttaacttgaagagctggtccagtggggatctctgatatttggaaatatttttctaagattcatccttctggtatcttcttctttgtcttcccctctyaccactcttatagattcacttttttgctcaagccttcagcttaaattatattcaattaatctaacagaagagttatttgtgctttgtaaatataatcagtctttccygagtaactgtctacagaaggctgtttgctgtgaagcgtcgttgaatacttttctgtgtctgtggtttactggacttgaaactgtttatttgaaatgttattttctggaatgttctggtgtcagtggacaaagcctatggccaatgatgctccaaaatgctcatttggcacttagaaaataaactaccatccatcccaaattcttccaactgtatcattttctatgaagttagaattttgagtttccaggtctaaagaaatgaaagatatgagaattaacagtattacctggttgttggaatgtggaatatataagaaacatttttccagaaaaaatgtaaatgttgagcctcctgactgtgattactatagagcttgaaagtctatgtcttagaaaaatattttattggtatgtttcttcattcattcactcaacaaatacttgtgcattgactgctggttcatgtatcagatgccttgcactaaagaggaaagagaaatggccctttaagtccttgaagtaggagagacatttaattcaaaaattgcaatgaaattgtggtaagttctctgaatgtaggatgtacaaattactttgggcacctggtaaagaaacagaccaacatgscttggctgggtcagagcaacttcactaagatgttatttgaactttctttcataaagataaatagaaattcctgagatgaacagtgcagaatgaagtattcccagcagagtacagagcttccagttctgtgtgtcattaaaaatgagaagaaaattgttgacagtagcagtcttgggattatagggggagacaggagttgtggaattacaggagaggttcactttttacctgatatatttgtataatgttagatttttgtgtaataagtatgtgttacttcagtaatcaagaaaaagctatcaaatactcctctacccctactcccaaaaaagaaattaaaaagaaaagaaagagttttggtattgtcattatcataaacaccctgttaacagaaacaacacagcagaggtaaggagttggaagagttgtccaggagtcaccaagcctccctggcccagaatacaaccatgaagacagccaaaggcatgccagggctttgatgcaagttccactgtagctagagccttatgcagccatttccaatgcagtgggttctctcttagaaatggggacccatctgggaagaaggttttcttccctaaggctctggtcaagactgtcttggaaaagccccaggaaatgtaattcagagtaacagagaagaaaatgaacagcctccagtgaaatggaagcctaaagggtagagctagagatggctggtgtcctgaaacgaatctgggactagcccagacctacaaaagatatctcctttggaaaggacctccccactgggtttagccataccgctgggtataataaaaatattgagagctagcattgactgaagattactattgtaagcattgtgctaagcactccactgagtacatattctcctttattcctgaaaataaacccaagcagtaggtaactcgtgttatattcattttacagaagaggaaaccaaagcagagaaaagctaagtaccttgcccaagatcaccagctattatgtgaaaaatttaaatctaggcagcctgacgccatgcccaacactcttttttttttttttttgagacggagtctcgctctgtcgcccaggctggagtgcagtggtgcgmtctcggctcactgcaagctccgcctcccgggttcacgccattctcctgcctcagcctcacgagtagctgggactacaggcgcccgctaccacgcccggctaattttttgtatttttagtagagacggggtttcaccgtgttagccaggatggtctctatctcctgacctcgtgatccgcccgcctcggcctcccaaagtgctgggattacaggcgtgagccaccgcgcccggccactcttaagtactttataatattgttttaatggaaaaacactgccagtctgtttctaggaacactcatcctcaggataaaaagagatattataaagaaaggggggaaaagtgtcctatggtcagataagtttgggaactccctcttggtaatttctttatttgtaaataacatttgttgggagagtattcactccgtgggtatagcgtactttggaacacaatgccctgcggcattttttgaggtggcagaactgagtaaggatacaagaatccttacacagatgcacttctggaagtgagtacaaatagccttggatttgttttcattctagattttctaggctacctttgggagcctgagattgccagaatattgacaagctagaaccatatgatgattccttaattggcatgatagagcctattgttgtgtctctccctgaagaacatttgtatccacccaagtgcaaactctagctgacaactaactttttatccacactatctgagtctattttttcaaaatgaacgtagtattattggaaatatttgaaatatgctaatgactctatcaggtttttcatggccccagatgaatcagaatttgtaagatttttattttctagaaggaatttttattttaaaacattccatgaactctccctattgccatgttggatacgctttctgcacaattatttgggaacaaaggaagggagactaatggccctgggaaaggtatcctattaaaatcactggtcctcaatatgtttagtgaataatacatctgcttgtgaagctgtccagtctgaagctgtgttttaagtcttaaatatttcccccaacattaaattttatttttattaatttaaatgttaatgcgtagatgctgcttgcttctttggttctgaattttggtcttgatgttttataattgcacttatcgatgaaagtacctaaaccagtagaagaattagaaacttgaagaaattgtgaagaaggattaaaatggcagataggaggcaggactagtttgcagctcccattcgaacagacagagcagtgtttggagactcacatagtgaacttttgctctaagaactacctcaagaacatatcaggaaagccaagagaatccacagaccctttgaaggaactggatcaccrctgcaggcttcctgagatgccaaaaaaaactatgagtctgtttgctttctcaaaggagaggctcttggtctggggcaagttctcagccctagttacctgttgcctggaaatagattcagtgctgttatgggggcactgtgggagtgagaccggccttcaggattgcaggctgcatgggagcagggtaaggcctgtgactgccagctttcctccacctccctggcaacttgtatgactcagtagagacagccataatccccctgggaatataactccattggactgggatccacaccctcatagcccacagcagctgcagcaagccctgccaaaggagaggctgaactcagacatgcttaccccttcccccacctggtagtctttctctacctgccctggtagccaaagacaaaggtcataatcttttgggagctctatggccctacctatcacctgagaaaccacttaaccaagtgttcctagggcaactaggaacacagctgatacactcttgtcagtgccacctcctggctggaggccaaccaacacaaaaccaacactctaaacaaaaacacaaccaaggaccctcgcagagacgacttcactcccctgctaattccatcagagcaggtgctggcatccatggctgcaagacctgaagacagatcacatcacaggactctttgcagacactcyccagtaccagcctgaagcccagtagctcctctgggtggctagacccagaagagcaaaaacaatcactacagttcagctctcaggaagccccattcctaggggaagggaaagaacatcacatcaagggagcatcccgtgggacaaaagaatctgattagcagccctgaatcccagaccttccctctgacctagtctacccaaatgagaaggaaccagaaaaacatctgggtaatatgagaaaacaagtttcttttacatcccccaaaagatgataccagttcaccagcratggatccaaaccaagatgaaatctccaaattgccagaaatagaattcagaaagttgattattaagttaatcaaggaggcaccagagaaaggtgaagtccaactaaaagaaataaaaattatgggatatgaaacaaaaagtcttcagtgaaatagacagcataaatgtaaaacaatcacaacttctagaaggcaagaaatgcaaaatgcactggaaagtctcagcaatggaatggaacaagcagaagaaagaaattcagagttcaaagacaaggctttcaaattaacctaatctgtcaaagacaaagaaaaaagaatgaaaaaattgaacaaagcctccaagaagtttgggattatgttaaacatccaaacctaaaaataatcggcgttctcaaggaagaagagaaatctaaaagtctgaaaaacatatttgttagaatcatcaaggaaaacttccctggccttcctagagatctagacatccaaatacaagaaactcaaagaactcctgggaaattcattgccaaaagatcatcacctaggcacatagtcatcaggttaactaaagtcaagataaaggaaggaatcttaagagctctgaggcaaaagcatcaggtaacctataaagggaaaaccccatcagattaacagcagatttctcagcagaaaccctaccagctagatgggattggggtcctctttttagcctccttaaacaaaacaattatcagccaagaattttgtatccagcaaaactaagcttcataaatgaaggaaagatagtcttttccagacaaacaaatgctgagagaattcaccactaccgagccagtactacaaaaactgctaaaaggagctctaaatcttgaaacaaatccttgaaatataccaaaatagaatctccttaaagcataaatctcacagaaactacagaacaataacacagtggaaaaaaaggtaatcaggcaacaaatagcatgatgaataaaatagtacctcacatgtcaatactaacattgattgtaaatggcctaaattctccacttaaaagataacagaatgacagaatggataagaatgcaccaaccaagtttctgctgtcttcaggagactactctcacacataaggactcacgtaaacttaagatgaaggggtggaaaaagatactccatgcaaatggacaccaaaagcgagcaggtgtagctattcttataccagaaaaaacaaactttaaatcaacagcagtttaaaaagatgaagagagacattatataatgataaaaggactagtccaacaggaaaatatcacaattctaaatatatatgcacctaacactggagatcccaaatttatgaaacaattactattagacctaagtagtgagatagacagcaacacaataatatgggggactttaatacaccactgatagcactaaacaggtcatcaagacagaaagtcaacaaagaaaaactctacctaaatgataccctacaagtgaacttaacagatatttacatgacattctacccagcaactgcagaatatacattctattcatcagcacatggaacattctcctagaccatatgataggccacaaaacaagtctcagtaaatttaagaaaatcaaaattatatctagtactttctcagaccacagtggaataaaattcgaaatcaactccaagaggaacccttaaaaccatgtaaatacatggaaattaaataatctgttcttgaatgatcattgggtcaacaatgaaatcaagatggaaatttaaaaattttttgaactgaataataatagtgacgcagcctatcaaaacctctgggatacagcaaaactggtgctaagaggaaagttcatagcattaaatgcctaaaccaaaaatctgaaagagaaccaatagacaacctaaggtcatgcctcatggagctggagaaacaagaacaatygaaacccaaacccagcagaagaaaatgacgaagatcagagcagaactaaatgaaatttaaaaagaaaaaagataaatgaaacaaaagctggttctttgaaaagataaatgaaacagatagaccaacgagattaaccaagaaaagaagagagaagatacaaatatgctcaattagaaatgaaatgggagatattacaactggtaccacagaaatacaaaagattattcaaggatactgtgaacacctttacacacataaactagaaaatctagaggagatggatatattgaaagtatacaatcctcctagattaaaccaagaagatacagaatctctgaacagaccagtaacaggcagtgagattgaaatggtaattaaaaaaaattccaaacaaaaaaattccaggaccagatagattcayggctgaattctatcagatgttcaaaaaagaactggtaccaattctactatttcaaaggataaggaaatagagaatcatccctaactcattctatgaagccagtatcaccctaataccaaaaccaagggaggacataacaaaaaaaaaagagagagagagagaaaactacagaccaatatccctgatgaacgtagatgctaaaatcctcaacaaaatactagcaaactgaatccaacagcatatcaaaaagatacttcaccatgatcaagtgggtttcatactagggatgcagggttgatttaagagacataagtcaataaatatgatacatcacataaacagaattaaaaacaaaaatcacatgatcatcttaatagatgcagaagaagcatttgacaaaatccagcatcgctttatgattaaaaccctgagcaaaattggcatagaagggacataccttgaggtaataatagccatctacaacaaacagataacattatactgaatagggaaagttgaaagcattccccctgagaactggaacaagacaaggattyccattttcaccacttctattcaacatagaattggaagtcctagccagagtcatcagacaagaaaaagatatcaagtgcatcccaatcagtaaagaggaagtcaaactgtcactgtttgctgatgatatgattgtatatgtagaaaaccctaaagactcatccaaaaagctcctaaaactagcaaatgaattcagcaaaggttcaggatacaaaattaatgtacacaaatcactagctcttctatataccaacagcaaccaagctgagaatcaaattaagaactcaacccctttcacaatagctgacaaaaaaaaaaaaaaaaaaaaaaaaaccttaggattatacctaaccaaggacgtgaaagacctctacgagtaaaactaaaaagctctgctgaaagaaatcatagatgacacaagcaaatggaaacacatcccatgctcatggatgggtagcatcaatattatgaaaatgaccatactgccaaaagcaatctacaaattcattgcaattcccatcaaaataccaccatcattcttcaagaagtagaaaaaacatcctaaaattaatatggaaccaaaaaagagcccgcatagccaaagcaagaccaagcaaaaagaacaaatctggaagcatcacattaccctacttcaaactaaactataaggccttagacaccaaaacagcatggtactggtataaaaataggcatatagaccaatggaagagaagaaagaacccagaaataaagccaaatacttacagccaactgatctttgacaaagcaaacaaaaacataaagtggagaaaagacgcctattcaataaatggtgctgggataattggcaagccacatgtaggagaatgaaactggatcctcatctcttaccttacataaaaattaactcaagatggaacaaaaacttaaatctaagacctgaaaccacacagattctagaagataaaattggaaaaagtcttctagacattggcttaggcaaagacttcatgaccaggaacccaaaagcaaatgcaacaaaaacaaagatagacatatgggactcaattaaactaaaaagcttctgcacaacaaaagaaatcatcagcagagttaacagataaccacagagtgggagaaaatctttacaatctatacatcttacaaaggactaatatccagaatctaagaactcaaataagcaagagaataacaaataatcccatcaaaaaagggctaaggacatgaatagacaattctcaaaagaagatatacaaatggccaacaagcgtatggaagaatgctcaacatcactaataatgagggaaatgcaaatcaaaaacacaatgcaataccacctcacacctgcaagaatatccgtaatcaaaaaaaaaaaaaaatagatgttggcagggatgcagtaaaaagggaacacttttacactgatggtgggaatgtaaactggtacaagcactgcggaaaacagtgtggataatctttaaagaactgaaagcagatctacatttaatccagccatctcactactaggtatctacccagaggaaaagaagtcagtatatgaaaaagatgcttgcccactcatgtttatagcagcatgatttgcaattgcaaaaccatggaagcagcccaaatgaccatcaatcaatgatgggtatatatatatcatggaatattactcagccacaaaaaggaacaaaataatggcattcacagcaacctggatgtaattgcagaccatcattctaaatgaattaactcaggaatggaaaatcaaacatcgtatgttctcatccacatgtgggagctaagctatgaggatgcaaatgcataagaatgatacattggactttggggactcaagggaaaggatgggggacagcaaaggataaaagactgcacattgggtgcagtgtatacttctcagttgatgagtgcaccagaatctcagaaattaccactaaataacttactcatgtaaccaaacaccacctgttccccaaaaacctattgaaataaaaaaaawttttttaaaagaatttgttcctttcctttttttaattacatgtaaaactaggtttatggccatggggcatctgtgactcctcctctttttctttagagatgatcttctcattttttattctgatatgttatttcctctagcggcaacttatgttagtgaatggcttttctgtaagacccatggcagatacatatttttttttctgctgggaattgctgagagcttttcctaaggtttgaacacatttagaagcttcactaacacactcaacaaccttatgtctcatcagtttacatagacatttctactaggatgtgtaaaaagacaaattgtgtgtaaattgatttgcaaaatacatctgtgagataaagcaagatttgtttacaatgagtcacttagaatgtggtctaccttttagtctggatttggtatgagagattccatagtcattttagagccttaggctacatgaatattgctgttgttattgtatcatttagttagaatatacaatttctgtgcaaaagtagacaccacccagggtatacagcataataatgaccagttcttttctatctgacagtctggaagggtggcagatgaatgctatgagagggcccccttttctacagcatgcttagcttcctccccgatgtatgctttgatttggccttagaaagtgaaggcatgtggttgtaaaggaagcggaagcttaagaaattggtatcatttatcctggagaataagggccatagaaaatcttactaatggtatccttagtgccccagtggatttcctcccacccaagaatggaatacatacaaatccatggtagggctgtctggaaaacctaggctaccttattgcaatggtatcatcactgtatcacacacttggctcacaaggagacgtcttatttcaataagaagctttgactgcccacttcatgtcaggcaaataatatggacaggacacagttccttgcgtcaaggagctcatagtcaggcaacaatggcttcacatggatagaggcatttaaaccaggccttgaaaagttaggaagtggtaaaaaaaaaaaaagaacaaattagaactcatgaaagtacatagtttgaggagtagaagatgtcttcataaatctagagtaatgggtgagtgaggagggggtgggaaacgagtaaagtgaaggatgagagtttgtgaagggtactggatgcaaagctaaaggttggagttggtgctataggcagcaggcaccactgaggattttaagcatgataggacttctttctaaaatagggatatcacattgactattttaactgctaaagtactatgataaatagaatagagatacagaaaaacagagtagggagatcccagttatactgagcctagagaactacagctttggagttgcttagcaaattttatttgctgtggtggatgagccagcttctacttctctatgttaaatataccaaagaggaagtgatggggtttccagggatgctgtgttcttcgcctacacgcttctctgcatcatgctaatgctgcattttgcaaaagctgtggtttacccagcttccaatgaattttgttccagtaaacttgcctaaaaacagaagtctgcaaaaaataagaaaatatgctatgaacatctgatcggacctttatggttaactgggtttttttaattgccgtggaacgtaagggtttagttagtctattcttaggctcctcgactcctgcaaacattctcaaaaataagcactaggaaaagaacgtttctactgggtatgtgacaggataaagaaagtattgagggaagttgattattataagagtacttatttataatcctgctcgtgccctcctcatattagataatcattatcgatgagctgatgcttggcccatgtgcttgcctgacactagcattttcagactacatgtgacccagatctcactgatttttcaacctttaagtcctcctttcttaatccttaaataattcaaaatctctaggtaagtgagaggcagcatggatagtagaataagcatgtgctctatgttagaacatcttggattccaatccttctgtgctatctagtagttgtattttcctggacaaattatttaacattctatcattatatatagattttgaaacagagtctcgctctgttgcccaggctggagtgcagtggcacaatcttggctcactgcaacctccgcctcctgggttcaagtgattcttgtacctcagcctccagagtagctgggatttcaggcacacaccactatgcccaactaatttttgtatttttggtagagacggggtttcaccctgttggccaggctggtctcaaactcctggtctcaagtgatctgcccacctcggcctcccaaagtgctgggattacaggcattagccaccgtgcccagcctaaattatttaacattttaaatctcagttttctctttttacaatgggaacaatttatcttcagttcttgataggataatttgaaataatatacacagtaactggcccctgctaagccatcaataatagtaactattattatcagattctaattgccaaaacagcaggttggatgttccaggagaggttataatcccagtatcaactctcagctctcgagtcttcatgtctgtatcccattgcaaagttcagcttggtcaggggaatcctcacagtgaggaggccctcataataaagcccacatgtgagtttggcctggataagttaactcacaaaccttcaccccagtgtagccaccatccatgagtatacatgaggctagtgtataaggctaattctctcctcactgttgtagtgaagagcacttaatagatgtgtcataaatgttatgcagacttaacactctgaggacatggggatgcacagatcatttttcccatcccttttgctctctctgtgatgtccttaacctaaataacagtgtgtagagaaaaatttataatattcctgaggaaaagaatagtagaaacagtaaatagctgttaaggtcaatataatttactacaaaataagttgtttgagatacagaaaaaaatcaaggcagagaaaacacaaccaaatctagtgcttactatttacaatttaccctggggcctgaattttcaagaaatctttctgttttttaatatagtcacaacaccacaatttttaagcattttcagaagatcctcatgcataaaaaaccaaggatggtgaccactgatgcttgtattattttcctttctctgaaataatggcatcttttaaaaggaatatatttaaaatgtaattgaaattattgagttgttgctctgattaatgtatgtgggaaaatagaagtcaggaaatgtttcaaaagctatatttctgttctcatcgccaatcaccatagaccctagatccatttagccatcccatattcacttgttttaggcaggatgttagaataaagaaatattttatgaagtgcttcatactggaatttactccttttctgaaagagggaagtgtgaatttatcttttatagtgaaataattttacctgaagtcatttcaatgtcatttttggtcataaatgaagagtttggtagaggaatctttgaactaattacctttctgaaaccttacagtattttgttgcaaaaaacaatggttaaacttataaagcagaggtttttggtaaagatgcaaaacatctacctaagaaagccccatgtcctatattttcatttttataatctataaacattaattgaacacctgggagaatggaggagagaaccaatatttacctcctatgtgacagttacttaccatgatctttttaaatcctcaaagccgccctgtaaggcatgtattattaccactggcaggtcattgggcctgtctgggactcagttccttatcagtaaactagatggtaacatgcttgcaggactgttatatggatcaaacataatctaggaaaaacacatgtctattagagttgcaaagatggaaaatacatggcacatgatgttaaagaaaactgtagtggcagtgctgctactaatggtgatcatctcatggcttgaattgaaacagagcactttggtggagcagtgatgtgggatatagagtgacaaggcaatgttcatagtggttgtgataaggaagaacttcaataatgtcctacagcgttttataacagaagcatcattttactaatcacaaatatataacatttcccgatttttttaaataaaagaattggcagtgaatactcttgctttaggacttaaatgaagtagagtcaaataagatttctcatccaggtcttttattttttttctttgatatggagtcttgtctcccaggctacagtgcaatggcacatcagctcactgctgcctcaaattccctggctcaaatgatcctcccacctcggcctcctgagtagctgggactacaggcatgcaccaccatacccggctaattattaaaattcttttttatagagacagggtctcactgtgttgcccaggctggcctcaaactcctggactcaagcaaccttcctgccttgacctcccaaagtgctgggattacaggtgtgagctactgtacctggcctcatcccagtcttcttaaattgatgtgaagatggtagtagattatttcagattttaggatgaactaataatagcagttagcatgcttgaacagactgtatctagttctgagctaaatgctggatatgtgattctcattgagtccaggaggtaggaaccactattactcctttgacagatgaagggactaagactgataatctcacaacttgcaaaactagaaaatctcatatttcttttttgtaaggttgttttttattctttgcccttttttaaactaagaaatatttcaaatattgaaaaataacattgaatatcctccacctagatttcataaatgttaacgaatctggatatttgtttcagatccttagttcagaagaaattaaaagttaccaatacagttgaaacctgttttctacctctccacaatccatttccttctccctctgcagatgtaaccagtgttctgagattgttttaaactcactctagaatatgtatataaaaaatggtatcatatagtttttgtgattttgaatttacataastggtattttcttccatattcaggtttatccttttgtttatttcttctatctttttgaggtaaatatttagtctattaattttcagtctttcttattttctaatgtatacacttaaggccatgcattaccctctaagtactagtttagctgcattttgcaagtttgaaatagtgccttaaagtttccaaaatagagagttattactgcgttactgagctccaattttgttgcatatgagttgtagtgtggtctatagaataccaactttttgttatttattgagagttaactttggctcattactggtcaatatttttttaaatgattatattgacttgaaaagaagatatagcctccctttgctgggaatagagttctacatagttcattagagcaaacttactaactattcaaaagtactgtgtcatttgaaagaagtatattaaaaggccccattaggattgtgattttataaatttctcctttaatttctatcagcttagctctatgtartttggggttttattgctttatacagtttagccaaaagaccttctttatccttaatgatgaattttctctgcaagtctattttatcaaatattaatatcatagaaccaattcttttttggttacttttttttttttttactattccttttctgacttacctcggttgttgtgttttagttgattctggtatattttaaaatatccaatctgacaatagcagttaacagggaagtttgtcatgtttattgtgattacttacattttgtgattttctaacattttctattaaagttgctattttgctcctttttttctccttgtttgctttctattggattcagtggtttttcttaccctctctcctcattttctctccactatttagaaacttatacattccctttcttttttttagtggttactattaaatatcacatgtatatttgtcttaattaaataatatagtaaccacagattgcttcaatatatccccttccatcatatatattattgttgattagtgttttagttatgccttgtttataaactgtccccagatttgttataacatggtcattattatctgctgtggtctgaatgtgtctcccaagtttcctatgttggaaatgttggaaatcctcaatgcaacagtgtgrggaggtgaagtctctgggagctgtttaggtcatgagggatctgcccacatgaatggattgatgccattataaaagggctggaaggagggagttcaccccatttttcccttctgtcttctatgtgaggacagtttctcccctctggaagatgaattgttcaatgtgccattttggaagcagagactggatcttaacctacagtgccttgatcttgaacttgtcaggctttagaactgtgagaaaataaattcctgttctttataaattactcagtctcaggaattatgttgtggtagcacaaaatggactaagacattatttgtttggctttgccacttactggctgtattactttgcaagttttttagatgtgtgatgcctagtttcctcatggatatactggggatcataatagtatctaattataggtttattgtgataattagatgagcttcatcagttcctggcacataactgctcagtgaatttcagctgttatgatttagttagtacttattagattgtcaacatgttcactgatatgtttatgaactattatttctttctcctggttcagttaccttcttcctgaagtaggactcatagtagttcctttaatagagttctgtgagtaataaactatcagttttatttgaaaacacgtttactttgttccatctttgaatgatgttagttgaatgtgaaattgtagatagcagttatttttttcccagaatttggaagatattattttattttttctggctcttatagttgttcttgaggaatctagttgtatcagtgatgatctgcattttcaccatgatttgtttagggacactttaaaaaaatatttccttgctcttacttttttttcttcttcaatctgagaactgggagctcttatgttttttttttaattcagtaatgtcataagctattattgcctcaaatattgccttcctgcattctattctgtccttctgtaatccatacagaataaatctatcattttgtctcccatgtctctcaatctcactctcaggttttccatctcttcaacttgctttacaactttctgtgtgattttctcaggattcatcctttcaatttatttctctttggttgtgtttttaattctatttaatccttccatttagttttttagcctgatgcttggcatctggagaagacaagaacaggaaaatcaggacaatgacctgactgtgtcacccattggcatgaaataatgaggaaggggtgaggagaactatgaaaagcatgaatggcatgttcagtgatcctcaatcagtttaccaacaagttttcttggtattttaaccttttgtgtgtgttttcaaaggcgttgtaaaaaacaaaacaacatataaatttgttaaataataataatgtatctccagattttgcttatcacaaaaatttataacaaccatactttaatttaaatgaccagtgttactgtatcaaattggtattctttcaactaagagaaaagaaattaaatttgccaatttagtttatttggggtaccatctcacccataaagatataatttttctatgttttttagaatacttgaaactggttcatagagtccctttcgtgatcataggtttgtaaacactggcataacattactgattggagctctagaaagcgggaagtcattcttgcctaccatcttttattcagcatttagctactggctgatctagaaactgcatctacagccactgctcattaccttcttgacccaagttgcagcatctacagaagatggagatgcagtttgtaagtggtccaggaatgagtgttggttagcttttagaggatgttgcttggactagcacaaggagtatcatacaaaactctcttgttgccacccttgacaaatgaccctaattttcatatcggattagaaaattcgattggaccatcaaagcaaatgtgttcttttatggtttattagtgattcttcccagctttggtaagtgcaatttatataatcagctctcaaagattttcactatgggtttttatttattcttgcagaatagtgccttagaaaattttatacggatttttttttgcaactattaagcagttttcccttattcccactctctcaaaccccaatgcccagcatgaagaagaaacaaatctctattttcaaatctaagccactcatgacacacccagctgggcttactctgaaattggatttccattgaaggacagtgggcagaacactaatcacttgggggcctggggaaacagtgggagggtgaatcaggaagccatcaggagatgcagccctcttgctgctttatgtagttagagagagagcatatttttagaatggactttgctaggaggataaataatacagttctattatttggacgtttgaatcacacacgtctagccctttaactcatctgatatacccctatgtactattatttttccatagggagaaaaaggcattaagtgagggataggtatattaatgaatatacttagagttactatattgaaatctggggaatatagatacagagaccaaaatggggagtggtgttgatcattgttggctagtggccctgaatggagcagggagtaggttcctgaatgggcacaggtaggaatcatgtgggaaatgggcacrtgtgcatctttcaaatccctccatagggctgctgcctactgcttgtattaaaaggcattttatgttgcatctacttgaagatgcctaaatatgctatactttcacctctcctcattcaacatatgtccatatgttatgtatacttccattgtcagatttgagctcttgaagcatgatttttaatctgtgcatgcccacatccagtgcaaagtaaaaaccaatagtgtctttcaggtttagaactgaccacagtcaagtactttaggacaggaaagtgagagggccagagggaagcttcgctttggggagtaaaagaaccaatctacagaggcccttggtctcccacagaaacacagaaatgataaggaagtataactatgactaaagagaaaggaaagaagagagagagaaagtgaagaaacacagccaagtagaagcagagcctgctcagggaagcatagatgggttagaggagggacatttgggatgcacatcagaaaatcagatgagaagtccgcgtttgtctgttttgtctggtcaccataattgtgctggctctgagtttcaacctttgttaatcatacagccttgtttaaatatggaatcatttttcttttgtccttccttgactccatcttaaacatcacattactgataactcagagaacttttaacctaggcaatcttcatgtgagttccattcagttccttttgatatacacatatttaaagtgacagttatttcctcttatggaagatagattttatttaataattttttcaagcggagagattagttgtggtcacagtagaaaatttttcataattctccaagtactataaaaagtaacttgatggcataaagtgaattsccatgatgagagtcatcctgtcactgtgaattgctgtgatcatctttaaagtgatatatctttccacactgtctgtcagcaactatgtagggtttgttttagattcaaaaatgtgtgagattagttgatctatatccaaagaattcagacactttttgttgtttttggatctagtcactgttcactagttcagttgtggggtagttttcttatgtttatctgtcctgaagttttatattcagaggcagtttttacatgctctttttttcttacccttcacttaatgaagcagggttataggagaaaaataaccttttatctttcctcagtgatattaacttcattgcatttaactttttaataaatcgtatgcctactaatttacagaagccttatttctaaaaaatgtaatatatatgacttaagactgatcaacatcttcccctttctactacatacatattcggagtttttattttgttttctttctgtatatttcagactgggaaaaaatgtactatttgtaagcagatgatttaatttcagtaaatgtttttttatttctctctccctttgatttattgcttggaaaccatgagaaacatccaagtgcagatgctgttttcccactctgacaaaacattgcttgttgacctcgcaaacttagaaagatttatctcctgtgattcaatggtggaagtaataatattagcagttaaaattttctaagacacgatcaggaaaaggagacttcggtcgttctgcttcttgttaagaacagctggcaatttaaaaagcagagacttgctaagggggaaggaggtaaagaagatcaaacagaaatgcctccccctttagtgaagtatgaactgaggrtgctgcatagtagcaataaaatcagattcttaaatgctttcccttgtttagtgtgtatatgtgcttatttttatttagtcttcaaagatgactttccttatatatttattctcttcgcaggaaatacatcttgaccaaatattttttgccaaatacttgttgtatattaaagccagcttaaaatgtcatatttgctgtggctatgttgagactctgacaagattatctgcagtgtgagtgatgtctgcaagagtggcctctcaccatgccttctgcacattgattccactaatctgccaggaggcagaggtgattcctatcattctgagagcttcctatagaaggcagggcctctgcagtctctagaactgaggaactaaatgaaggccaccaaagtgaccattaagttccttaattgtgaggaagcatctttaagaggaaatgattctacagccagaaatatgcgtgaccagttctacaggatgtgatgtcatgtgactggtggagcttgtctttctatcaaaggcttgtacagaaaagggaaaagaaatgggcatgtttcaggtcagttctgaataatggaagaaagaatgaaaggaaggagaggggaggggaggggacaggagcggagggaaggggaggggaggggaggggacaggagcagagcggaggggaggggaggagaggggagtggaggagaggagaggagaggagcggagaggagaggagagaggagaggggcatgtgagctggatttcttcaaaccccaccaacctggacagtgagtcctggaatcaaaataatggtgagcctcagcatctaacatcaaacacccagacttccttctggtttaagaaattccaaaggctctcagctgtgataaaattaaaaggacatattcctatttgttctttttgttattggttctctgtctccccctgaacctttagccagaaatagagatgcaccctttcttcttcagtagctttgaggatcaaagaatcttagttgccagagctgggaggggaatctcaaagattgcctagtggaacaatatgattgttcatgtgaataaactgaaactcagagagaatgtggtctatgcaagacatggcccatagtctgtgtcaaaagccaggttttctgacttgtggcccagggctctctgtagtattctgggccagcaaaatcccgtgtctctccagacacatcttctcttgcaccaaatgggcctccttgctgtgtcctcctcaaaccaccctcactcccacctctgaacctttgctgatgttcacaccctgcacagagtgcccttctcctccaactcctctgctcagcacatcacatcccctaatgctcagcccgatctcatttccaaagttaaggctctgctactcttccagcccaaattgatgtctcctctccctagaccccttcaggtcttttttcattccctgtttcatgtttgattttaacttctcaaccagatgatactttcccaagcctatgtttttgtcttttccacagcagtcctcccagcacctactgccaggccaagtgcttttctctacttcagtcttcttctctgttaaatgtgaataataacacctgctctaaatctaagcctagtggactcccagcttgttgaagggcatgttgaatagtcttatgtactggaagtttgagcttttgggagggtaaaagaagggacagggatgcctaggcacacagaactcaaatgcagttatttgggttttcctctaacttagcctccactggtcaaatgtttttagcacctgcaccagcagccatttccatgtatcccttctccctggagacagtacaaacaagagataattcctatcattgttgggacagaagtctctcaaagcccttaccaatattatagttttgagattcacagtttcctctgaaacttcccctttaggagggatggaaaccacaggatgggcattctggtaaatgctcaacatagatacctatggactgggtagcaggygacccctaggaaaacctcaaatatcctataaggtcctaataagggccagttattctaagcaaaggagcttctgtgagtcatagtgcaatccatagatatgcttgttagctccttatttaaacccttcctgaaacaacagccaagaaaggaaaggactcaaggtcacctctggaatcagaatctactcagtcttttcccatcctagtttgtattcaccatattcagccctcagccaacttgaggcagagtgccttggtagaaagtggttcttagagacaggcatccaggcaatgtagcaaagtagaaagagccctagactagaagtataaagacccaggtttgaggcctgactctgccacctgctgtctcaaaaactgcaataatataaagtctcttaccaattctagcttcagtcttctcctttgttaaatgtgaataacaataatgccttccctgccagtcatggtggctcacacctctaatcccccctactttgggagaccgaggtgggccaatcactcgaggccaggagttcaagactagtgtggccaacatggcaaaaccccatcctactaaacatacacaaattagctgggcgtggtggcaggtgcctcttgtcctggctactctagaggctgaggcacaagaatcacttgaacctgggaggcagagcttgcagtgagccaaaattgcaccactgcactccagcctgggagacagaacaagagtctgtcataataataataataataataataataataataataatgctttccctacatctagctataattatttctttaacatttccttccctgctacattgtcagctgcataagagcagggtctatgtgtatcttgtttaacactgtatccccagaaccctagtaggacatgtactgtattaactggttggttgactgagcaatagggagaagtttagagcaagtgcaagctattattatgatccttattatgtttgatgttgttgttatgtctccctagagtttggtggattttggtttggatttccattccactcyccatcattgagaaggaactgagtcaaaagacccatagtggatcagcagagaccaaccactcaccatggtcataagtaatttcagagcccatagtatctctctgtagattcttccctagtctcagtacttggccacagagtggatggctttgatcttacacagattgattctatatcccttgatgggtgtgtggcagcaatcatcaacagcaaggtgaccttctctgcttatcatgactggccccttttcttctataattttcttctttggtttttgatgtatgagtatttttagtgacaaagataattaggtactttagtgacaaagataattccaatggtactgtactaaatgtggcttctgcctgaggatgcacttgtgtctgaggaggatctagactgtccaagtgagctcttattttaaagcccctcttacaggttggctcttaaggactgaggagaaagcagggcctttagcatcagacaggtctacttttggaagcccatgtagttgacaatctagctacatgggacaatgtagctacagggaaggaaatgttaaagaaataattatatgtgtgaagaatacctagatgtagggcagatattattattatcatttaacatgaggaaaacttagtctgagagaagcaagaagctttgctccaagtttttgagacagtgacacagataaggtgtctctccttattgtataatagggacaataataaagccatcttcaagggatgttgtgatgaatcagtcagaaaatgtatgtgaagttaatgagcaaagagtctggccatagtattaattagtattaatactattaataagtattcaataaaggagagtctcccactttctttccttccactctgttttccataaattaaccagagataaaagtggtggaattagacttcagtcctgtaatggtgcacctgaagtgcttcctctcaattcatatccatcttccagattgcttgttgtacccatattttctgttaacacaaattggagggagtatcatgactttcatttgttgacagatacacaaatgggcagaacacaatgatgaatgtctcaattcagacaggaattgaatgttgcctgtggggtaggctggctctgccacctgcactgacaatacatcatccctggaaattaacccatcttcaccatagccattgaaatggaaagaagtgcttgttcattaaaaacaccttcaaatggaaaggatgaaggtctagcgtagtatatatggtgcattaatatctataatcatgtttaatttgcattagtctaactctgccacttggaaactgtttttaagatattgtgttgcctgaatgggtttgtgtatgcattatttgcttcttgaataagagctgaacagaagctaatagctttatataaaatatagtgattaccaaattcaagagtcaatgtcctgtttcacattcattcttgctcacttttagtacaagcttatgcatcatcaggcatgttgtatacaaaaataatgatgtgggtcctggtctttataggtctaatgggtggtagttccatatttctgtaaattttaaaagcattattactcactaaatatggatcattttaaaataattagatatatgtatgaataggcttcatatcacaaagttttattttctttgttaaggatatgaatcctaatgtctttactattgaatctgctaattcaaataatatctatcagtaggtagatgagctaaacactaagcctgtatgtcaaattttatacacgatattatgcttagatgcatacatagcaaaaccaatatttacaatatattggtgtacaaacaatatattggtgtaaaaaaatgattagtgcttcatcaagttaatacattcaggtatcataattatgtattatttcatagtgtatcaacaaggagaagagaaactagttatttcaagcaggaagtgatttaatttagggaaatagattctataacagaaagaattaatgtttaccaaacactatattgttctcccgttctctcttgctgttaattgggaccctgtgatagtcctggctgaaggactgtgaaggggagggaagaattaatatcccagggcctaactggttaagagcttgtgtgcctctttcaaccctcactttccctggaataaaccttggagctatatgttgaaatagaaaataaaaatatggatgaatcttggtcgtctgagtcaccagatagaggagatctcttgccaatctgcacgggattttgcatgaacaaaaagtcaccttttactgggataagccacagaaatttcagagttttgtctattgagacagctagggttagttactgtaaaaatactagggcctggaaaaatgttggaaggattgagagagggaagatcaggttgcaactactagtatgcagaaaatcataaagcataggaactgcaggaaactgtcaccaatgatctcagctgtctacagcaccaaagtgagtggtcagtaggaagatacttggaagctgttagcaaaagctcacatctggggtctacccaagtccatgtgactgcctgtctcaaaagagtaataatagttctatttatcttttgtctttgaaaccttgcatgaatgagtctaattgtcttaatttaaaccataaccctgctggcagagattctaagaaatgtagttctcatgcttccaatccctataatactaaggagagcgtagaaggagaaaatggtgtcaaattgccaaaaaaaagaacctggcatatagaagtagcccaattattaggtgatgacatgccccagtttgtctgggacagtcccaatttattcctgttgacctagagtaatttttgatagtaccccgtttcaatctcaacatgttccctgcttggacactaaattatatggacatcgacctattaataacatgataaaaatactttatttcatcaaaaaacacttattcaggatatgctaagtgctaatcattgtgtgggacattggtcaacagaggcatttatgaccttggcattcatgaaacttagagtcgaatctagtgaatgatgggagcctaaacaaggcaatagctatgaggatggagcagaggaggcatactcgaaagaggttgaagaactaaatcatacaggtcttgataactagcatactggttaagacccttaggctcttacgtcagactatccaggtttgaacaccagctctatcacttgttgggtattttaacttgggaatttaccaactaatctctgcctcaacttacaactctgttaaatgggaattataataatacttataagattgttgtgaaaattaaatgagataaaaatttataaagtttataagagggcctaaaatatagtaaatgctcaagaaatatcattatagtgaagaaattgtggtggttgttgttttataatggctgaatatgagagaactgttaagaaaatcctaggtttctgacttgaatatcttgatggatggttatgtaaaataataaatgcagaagaagctgatttatgtgggggaaaatagtgcatatagtttgaatggattgctagaagagtaaacagaggaattggcattctaatttaagtgggggaagtaatgcatttggtttgattatgctgagtttgagggactggtgggaaatccaaatggcaaggtctgatagcagctgaatagttagaattggggctcagataaagatctgagctgaaatttagacttgtgaggtttttttttttttwaaaaaaaaacacttctattttaagtttaggtgtgcaagtacaggtttgttacacaggtaaacttgtgtcatgggggtttgttatacagattatttcatcacccaggtattaagcctagtacccattagttgtatttctggatcctctccctctttccaccatctcacaccagtcagaatggctgttattaaaaagtcaaaagatttgtgactttctagatggtagctgaagccaaggaaatttgggagatgaattagagaaggtattcagagtagaccagaactttaaagggcagaggaaaagaaacatatgagaaagacaagaaggaattgccagaaaaatagaagagaagcaggcaagtgatgtgaaggaaggcgaggaaggagagaaagccagaaagaacagggtggacgatggtgttaagtgtcaagcacaaatcaagaagatgagaacagaaatgatttccacagattcagcaattgagggcttttgctgattttagtaagaatagattcagtggagtagggaaggtggaagtcttctcaggtcaccaagggtagaggtaagaatgagaagagagaacatatagatcatgaaatattaatcttcagggtgcttggctgtgaaggaaaggaaagggtcaactggtggctagaggctttttaaaagcacagcctacaagatcctttggtcctagagttgcacaaaggatttgcagaccaggaaaggtttagataacatgaccaccaaagtcttccccatttcaaagtgtttattatttcatgattctctgcttaataagtaccaaggttcagcttttattttcacaggttgttacctgtraagagggtacaaaatctgttttatcctaacaaatttaagttagaatttagtttgatcttacgagtctttagggaaatatattttaggagtcaaaatgtgtatctgtacatagtatatttatgaatattgttcttaatttttaattcagtacctttacaaattattttataattggttcctgttttcaaccagttgcttgtgcttatatatgcaatttgtctatttttttcatatctgttttcagcttctcccaaagaattatcattaggtcataacaytgggggaggtttactgaatgatcattcttttcaaagactttaccatttcccccagagccttggttggtttattgactagagcaaagcagttagtttgctattagtggaataaggtaggcaaagcatctggaaatgttctaccaggaggagccagtggccttgttttcgaaaagtcccaggtctcccatcactccctccagtcttgctagggcatgaaagaatcagaatttataactgcatcataattctgtactacagcctttcatctgggatcttctgtttggaaagtctcttcaaatgttttcttagcctcaagggaaaaatttctcccagagatacctcaattttgatcaaaagcattcacaagtccacttttagttttttctctaccaattaaagtcctcttagcttggtagattaaagctcataaaactggttccactggtttattagaaaactcactttagctagaagagtcgaagttttgatatacacagaccctagagagctaggaaaatcttacttttctccaaaggattcaagtcctattatttaattttcatctgattttggccaagttcagatttttgctgactgtgtaacatagcctattcatttcagctacaaatagttctcttttgtttccatttacttagaaattaacaaaatattgccatcattttatgtgttttcataaatgtatttaaagccttttataattatgatatttaaatattctgtttttaaattccaaataacattagttgagagatgcatctttgacataaaaaaaaatttcaggagaaaaatttcttgtaaaagcttctcaatgagtgtatacattgatcataagaccattctaattctagaaacattaaatatgaaaaagtatacttttggaattgaaaagatatggcattaatggtcatttcacttgacttgaggcttcccatgtgtgggattcatcattacttcatatgcatctatctaatcttcatttatccattcagctcacagttattgagaacaatattaagtcttaagctcttttgctaagcaacggacaatgaacactccctggtgctagttagcatccgaatttgtaaagtgagccatttgttgtatgttttaaccttttaaaaaattcagcatttttctctaaatattttgaaatctaactcaagaaaaataaaaatcacccagtggctttttcacataattttaatcacctttattcttctgcttatcctgtctcctcagtcttacattcccctacactatgcagcaacctgagttgatagctatcataccacgccatgctactctcatcatcatacggtggcatgattaagacagagaagacttgaaaataagtatgcttaaaatcttcagaaaataaaatgtgaataacatccactaaaaaataaaaacaggagtttatgaaataacaattaagtggtaatcaaattagaacatgcagattcaaaagacaaccgattgaaatgattagaaataaaaatgtatagtcatttagaatttctagaaaaaaatctaaataaaaggaataaataaagagaatgctgtcaaagggagactttataaattggatcacggaaattagaaattaccaaactgtgcaaaacagagaaaagagaactgaaaatataaaagattttgtaatgcaagaagttctattatatataagtaaatagttccagtgggagaaaatagagaaaattgctgaacagtttctagaattaaggcaagatgtgagtattcatattccaaaaaggacaaatcatgccaagcaagatgaaaattttaaaacctctttctatatttacattataatgaagctaaagaacatcaagggcagaatatttgcttttctgaatggggagatatgaaatatcattgaagctttccttgattactagaggtttattcctgcattctgttgtgataacactttcttctatgttgatttagttatttgcctgctgtaacttctcatgcagtcattgtactggcctccagctcacttttgtttactgctgttctatgctatttgctggacaaaccaaaaaactgcctttgttaaaagacttacaataaacaacaatagcttattaaacgaagaattggctttaaagaaggtacatgatactagcgtagcaaaagctaacattaatcaggtgttttctatctactagacatttttacaagatttttctcacttaaccctcacaatgtccccatgaggctggtattactctatcacccccattttacagatgaggaacctgaggcttagttagagaaactgattcacttgcccaagatcatgtggctttagcaagtatgttaagtggtgcctcctagattttaacaaagtcaaattctaagcccaaaatttttaaatactcctttttcttatcctttttttttttttaacttttattttaaggtcagtggtacaggtgcaggtttgttacctaagtaaacctctgtcatggggtttgttgtacaggttatttcatcacccagctattaagcctagaacccattagttatttttccttgtcctctccctcttcccagccctcatcctccaaaaagccctagtgtattttgttcccctctacatgttcatgtgttctcatcatttagctcccacttataagtgagaagatgtagtatttgtttttctgtttctgtgttaatttgctaaggataatggcctccagctccttccatgtccctgcaaagaacatgatctcgttcttttttatggctgcctagtattccatggtgggtatgtaccacattttctttatcgagcctaacattgatgggcatttaagttgatcccatgtctttgctattgtgaatagtgctgcagtgaacatatgtgtatgtgtctttataatagaatgatttatattcttttgggtgtatacccagtaatgacattgcttggttgaatggcatttctgtctttaggtctttgagtaattgccatgctgtcttccacaatggctgaactaacttacactcccaccaaaagtgtataagtgttcctttttctccacaaccttatcagcatctgttatttttgactttttaataacagacattctgactggtgtgagatggtatctcattgcagttttgatttgcatttctctaatgatcagtgctgctgagcttttttttttttgtatgattgttggcttcatgtatgtcttcttttgagaagtgtctgttcatgtcctttgcccactttttaatagggttgtttgttttctttctgtaaatttaagttccttatagatgctggatattagacctttgtcagatgcaagtttgcaaaaattttctcccattctgcaggttgtctgtttactctgttgatagtttctttggctgtgcagaagctcttaagcttaattagatcccatttgtcaaattttgcttctgtggcagttgcttttcatgaatcttcatcatgaaatctttgcccttgcctctttccagaatagtattgcccaggttgtcttccagggtttttatagttttgggttttacattgaagtttttaatccatcttgagttaattttcatatacggtataaggaaggggtccagtttcagttttctgcatatggctagccagttattccagcaccatttattaaatagggaaacctttccccattgcttgtttttgtcagcttcgttgaagatcagatgattgtaggtgcatggccttatttctgggctctctattctgttccattgatctatgtgtctgtttttgtaccagtaccatgctgttttggttactgtagcctgtagcatagtttgaagtcaggtagcatgatgcctccagctttgttctttttgcttaggattgccttggctatttgggctcttttttggttccatgtgaattttaaaataaattgttttagttctgtgaagaatgtcaatggtagtttaataggcatagcattgaatctataaattactttgggcagtatggccattttaaagatattaattatttgtatccatgagcatggaatgtttttccatttgtttgtatcatctctgatctctttgaacagtggtttgtagttctccttgtagagatctttcagttccctagttagctgtattcctaggtattttattctttttgtggcaattgtgaatggaagtttatttatgatttggttctctgcttgcttattggtggtatataggaaggttagcgatttttacacattgattttgtatcctgagactttgctgaagttgcttatcagcttaagaagcttttgggctgagacaatggagttttctagatataggatcacgttatctgcaaataaagataatttgacttcctctctttctatttgaatacactttatttctttctactgcctgattgccctggcctgagcttccaatattatgttgaataggagtggtgagagagggaatccttgtctagtgaaatctgattttcaaggggaatgcttccagcttttacttattcagtatgatgttggctgtgggtttgccatatatggctcttattattttgagatatgttccttcaatacctagtttattgagattttttaacatgaatcgttgttgaattttatagaaagccctttctgcatctattgagattatcatgcggtttttgacgttagctctgtttatgtgatgaatcacatttcttgatttgcatatgttgaaccaaacttgcatcttggggttgaagcctacttgattgtggtggataaactttttgacgtgctactggattcagtttgatagtcttttgttgagaatttttgcatcaatgtttattaaggatactggcctgaagttttctttctttctttctttctttttttttttttttttttttttgtatttctgccaggctttgttatcaggataacactggcctatagaatgagttagtgagtagtccctcttcaattttttggaatagctccagtaagaatggtaccagctctttgtacatctggtagaattcagctgtgaatccatctggccttgagctttttttggttggtaggctatttattactacctcaatttcagaactcattattgttctattcagagatccagtttattcctggttcagtcttgggagggtgtatgtatccaggaatttatycatttcttctagattttttagtttatgcgcatagaaggttcataatattctctgatggttgtttgtatttctgtggagtcaggggtaatatcccccttatcgtttttgattatgtttatttgaaccttctctcttttctcctttgttagtctagctagcaatctattttattaatttcttcaaagaatcaactcttggacttgttgatctttttaatggctttttgtgtctctatctccttcaattcagctcagattttggttatttcttgtcttctgctacctttgggatttgcttgctcttggttctctagttcttgtagtggtgatgttaggttgttaacttgagatctttctatcttttggatgtgggcatttagtgctatagatctccctcttaacactgccttgtctgtgtcccagagattctggtacgttgcatctttgttcacattagtttcaaagaacttcttgatttctgccttaatttcattgtttacccaaaggtcattcaggagcaagttattcaatttccatgtaattgtatggttttgagtgaatttcttagtctttatttcaattttgattgtgttgtggtccaagagactgttaatatttccgttcttttacatttgctgaggagtgttttactttatgtgatttattttaaagaaagtgccatgtggcgatgagaagaatgtatattctgttatttttgggtggagagttctgtagatatctatttgatctaggtccatttgatccagggctgagttcagatcctgaatatctttgttaattttctgtcttagtgatctgtctaatattgtcagtggggtattaaactctccagctattattgtggtgcagtctaagtctccttgaagttctctaggaacttgctttatgaatctgggtactcctgtgttgggtgcatayatatttaggacagttagattttcttgttgtactgaacaatttactattatataatgcccttctgtgtctttttgtttatctttgttggtttaaagtctccttcgtcagaagttagaattgcaacccctgcttctttctgtttcctatttggtagattttcctccatccctttattttgagcctgtgtgtgtcattgcatgtgacattggtctcttaaagacagcataccaataggtcttggttctttatccatcttgtcactctgtgtcttctatttggggcatttaacccattyacatttaaggttagtatttatatctatggatttgatcctgtcatcatgttagctgattattttgcagacttgtttatgtggttgctttatagtgtcactggtctgtgtatttcagtgtgtttttgtagttctaaacccaaattcttaatgactactctatatcttttttagtggaaaaaaagactttatttcttaggaccccacacactataagcccctatatatttctcttgaagcctgaaagtcttgacttattcttcagctgtaatcagctgtggtgtactttggggacccatcactagatttgcactgtgaggttacctatgctccatttctccagtggcctggtgctatctgactcaatctggagtaatatgcatgctttgccaagtgaatttgatgactgaagggttccataagggtctaagataagcatagatgcatattggcatcatctgcttggaaggggcctttaaaatgtcaccattcctcactatgctacaccaaggaagkggggataattatcattgcttgtggtaggtgaggcaggatggtcagagcacgtactttgaacctcatcattctgctaagtactactatacgttatttttttgactatcattatcactgacatctaggatataagcacctgtctttactaatcagacttagtaagacattttggtatgtgttgagaaacagtaatattgaacatataaccttacagatggaattacattttggatttaactatcctgacatctttttctttaactctcctaattgatttccattatgttgaaatccaagtccatcctttgaaatgttagcgggaagactgaggattgaaatgtgtagatagaaaaatcacagaatttaacttaaagtacatgaaaaaattccaatgaaattataaccattaatatccttaatacataaaatattcatacaaatcaataataaagaatccccatgactgcaataaataaataagtaaaggtccaaaataaataatttgtaaaaaaaaaaaaaagtttaaaatgttaaatcccagtagcaatcaaatacatataattcaattcaaaacactgaaatgacacttgtastcttttaaattagtgattttaaaaaaacaaaacaacaaaaaaacagaatattggtaagagagcaatgaaaaatgagttttcatacactgtgggaaaataatttggtaccaactatttaaaaagcaatttggcaatactgtatacatcaagagctacaaaattaccctttgactaattttacttctcataaattatcctgaaaaaaattcaaatatctggaaaagctttagttcaaagctaatcattacaatgttatttgtaatgttaaatatcagaaataaatgaaaattactaaaattgaaaaacagttaaagtttacttcatccttaaaaggaatatttcacagagaatacaaatagaaatacagagagactgtgaaatagcacagataaatgtctaagctttaatgtaaaatgaagaatatacatatgtaatggatcaactataagaaacttaaaaatatgattaagaaagaaagattaaacaaaaataccaaaatttcaacaaagattatctcttgttaatggggtttgactatttcttttctgtgtttcccaaatttttatgatgaatgtgatttattctattttaagagggaaagaaaatttttttatgaagaaaaattgaattaaaataaatttttatggggctgaagaaaaggcctctataaatgtgacttgattgggaagcttgtgaattttttctgtaggaactgagtatttatgatctttttttttttgagatggagtctcactctgttgcccaggctggagtgtggtggtgtgatctcggctcactgcaacctccgcctcccgggttcaagcggttcttctgcctcagcctcacaagtagctgggactacaggtgtgtgccaccacacctggctaatttttgtacttttagtagagacaggatttcaccatattggccaagatggtctcaatcgcctgacttcatgatctgcccacctcagcctcccaaaatgctgggattacaggcatgaggcaccgctcctggcctatgatcattttatatggactgatttaaaatctgttttgaagccaggtgcagtggctcacgcctgtaatcccagaactttgggaggctgaggtgggataattgcttgagcccaggagttcgagactacccaggacaacatagggaaattctgtctctataaaaaataaaaatacatttaaaaaatcaaataaaatctgttttgaatagccatcaaaaacaacttctcctacactaacatttaagagcgtgaaaggtggcaagaaaagttctatcatagcttagatcctaaactattctacgcaagtttttgatgggctctaacatgttaatagcatatatgtaacactaattacaaagaaacctcatttcttcattgaaaaggttatcagtttaatgcagtgaaatctgactatgtgagtgtgagtatatacagttgtgctaatatcagtttgtagtcgttcaaggctaatcttcccactccagaggaaatttttttatcatatatgcatacattgctgcactgaataatgggaacctaaaataaaaaagatcattgcctattttatatgctccataaaattcactgacagtaaccaccaacatcccaggtatcgtctgcagtttagaatcctgaatattttccccaaaaatgtccgataagggaagcaatttaagcaaggcagacagtgctgctaacagagaccatacagtttcagccagcgagtctgctgactgaaatgaagtccttggacctgtggtttttttgtggggttatttgctcttgtagaataaggctctcagaatttcaataaaagggtgaaaacagttttgaaactgagaagactgttacactgcctaagaggaatagaggtgtgattgagatgtggtgaaagaatctgaaagttgagttgtttttttttaagtctcttcccgtgtctatgtcctgccatttcttagatttatacaaacccgacccaaaaaagggtgtcaggggcttgaatccagcaggcactctcatacaggtctgttataccacttcaccttttatagtcagtcgacaggacagggggaattacttagtatacaaagaagtgcaagggaaataaaacctatgcaaatcacatttgtagccttctaaatatttgacctatatgaaaaattccagctttgatttcttagtccaaattgcaaatcagccaaacgtagctgattctgtcctatatgarttggttattactgtctttccctttcttagaacccctgggaacaaacaagaaaaagtaaggaaaacaaaatacttattaaaatgtaaatacagtggctggttccctgatatgttatgctgacaacccttgctggcaacccaggaggacccaggtgcaccaggaaccgacttatctggtcacagaacatcgggggctggaaattgacagcctctgaagggggccttttgttacttgacttctgtggcaggttgctggctcattctcctgcatggaagagttgaaactcgtctttcaactaaatggagtacatgagggcagagattcttttttggtttggcaacccaagtatattaggaaaaaataggcactgcaaaatagcaggaaagcatgaagaatgctttatgaagaaacataaaagaaaaccagaggaaagcatattcagcctcagtcattaaaaagcacactactgttcccagtcttgccttctccaaaagtttgtttgtttgaagtttcttctgcagaactctaagcaggtctccaatataccgacatctttaacagcattctggaatgagaggagtgtctattaagggagacatactcctctatttcatttggaattttacacaacagttttctgtgtggcttaatttttggcatcaaattgttttaacagaagctgtgcttttcagttagatctttatctttgagttctagtgtcctcccacgatgcccctaggagcctatcaaagcaggccaaccctgcagaaatgcctagaataaaataacatgcaaatgccactaagaacttgcttccctcctgactcatattttagtttctataaagtgtctgttttcaaaactgacagtgtctgtagcctgttaatggaagataatgatttgcacaccaaaatgggagtaatcacagggctatttgacactgtccttagaaaaattccttacttactcaaaagccaaagcaaagaactatttctaaaatgacaaatgtgtgtaaattttcaaagtggattgtgatttcacccaggaaaacacaggcagccagaacacagttatgctttagtgtatatggtgatctaattcttgaaataaaactttattctgggcaatagcatgcatttctagatgagaggagaaattgttattgctcataataaaggacgaaatgtttttcttatttgggaacttcagggggatgaagtaaggaagtgggctgcagaacactgggataaatcttatttatttaacatttaatgctatagtctgttaggaaacaaactcactgcggtataattatttaatactggacagtaaaatcatctgctaagattagattaagtagttgactcaaagtactccccaggttcaaggctcaaaaatgaataaatcaacatgcttactgtacagagcccttgaacattatgtgtgctgggatggtggcttcctgaactatcgcctcttgtttgggtctgttgtgaagtcaaggcttgaggacatgacctgacctctttatttaaaaaaaaaatccatttaatatcagttatcacttgaagaatttaaagacagaattatttgctcagaaaaatttgatgctttgtgctattaaacmctcagtacacagaaatagatttaagcaacatggtggtgaatcaagccaaggagagctgggaagctggaattgatggctcagtattctctgtaataatgtgtcaatttatgcctggacattttaggatgtctgtttatacaaatgtgaacaaatgtacctttgacttgtagccagggtgaacccagtgccaaaagaatagctcttctcttagactgggtttctcatttttttcagttttgtgactggcctagggtgtattttccttattggagccttgtgttgttgtcaccttcatccatgccaggttctcataggactaatccccaaggaagtcatccccagtctactgggcacactgagggaatccacgtgtacaatggaggcttaagctgtgagctttgctatcaggagaacctggctttaagtcctgtttctgcccattattatatatgtgaccataagtgagttgcttaacctctctaagcctcagcttcctgatccatacaacaggaaaagtactagtacctgcatcctgtgttactgtgaggttcaaaaagtaaaggaactaatgcacataaagtgtttagcatattgcctggcacaggatagggactccataaatgccagctttctttatacaaagaaaaacgtctttgccctttagttaatgttctcctgtccatgtcaaggtcagcatgacaccatggtagtctgtctagcttgtatttgtgtctgctgctcacataattgtttcttcacttgctgacctggttggctgaagttttggccatgggccaccctgtctgtgccccctggctttggatcccatctcgtcctatccacaatgtcaggagcaaagccacttctttacatacgtggcagaatccagccagacactctgcatcagcaacgtctccacagccagttgcttggtcttcagcctgtcaggcgctgagcacttgttctccatctgaaccagctctgtgctggcctctagcaattataatgcacctgctgatgcctcagagagccaggccagactgacactttcctctcggtattctttaattctatgcttgaccagttccagcattctttcttcttggtcccagacactttccacctcatctcctacatgtcacatctgatttgtccttattgtagaaggtaggtgtaaggcctaaagagtgagtgtggtttgttgtcagctgctccaaatggggcagcattggcaggaggtgcaggaactgatagaataagatttctatatcttttcttgagtttgtgacagtgctgtttatggtcaccagtttttatttgaggaattatccatttatgcaaaaaatgttttttattctatatatcctttaaaaagacatacaggttgccctctggaaatgagtcttaagcatgtctatagtatagctatatcatccacatcttgagtcattttgctcagtggattttcttaattctcaattaatttgtattctgtcagacagtctagtgagggagtaacgagtggtaagttagaaggtgacaattttatccgaggtctgtgcatagggtacagtggaagaatggagacggtgatgcctcatggcctcagcttacagtgtgatttgtacattttctgtgatttctataagtaacaggctgacagtgttggatttgctgtgttgtgctttgtatctacctttgtactgcctcttttttcccctcccacgctgactttatctcattccttgttttccttgagaagattgcactggaaaacttgaagaggggttagaaggtggggccatagtagataccagtaggaagacttcagaacagaccctgtcccctgctgtgatgatgccttgtgacttaacactgatgaccttacatggaggatttagtgaaagttatattagaaagcaattcagttacttccagattgttattgaagtccagcctctgtggtctayctatgccattagtatttgtcctaggttatttttgctttcgtatgtcagagaatggtctcaacgtaagggggtctgagtcagggtggtctagttgaaaaggtatgggcattggagtaaaaatataaaaaatctggattcatatccagcctctagcactgaatagctctgtgacattgtgcaaattgcttacattcttttaacttttgtttccttatctgtaacttggggatccagatataataatactgtcaggtattatagaattattgtgaaaattaaatgagataatgtctggaaagaacttagcacagcgtctggcatagtgttaagtacccagtaaatcctgattctttctctcccccagcctcactgcctcaccagctgcccagctgtctctaaacacagcatcagtggaactgtaaatactttcacagttatgtaatcgctctccacaaattcactctttgatcacctttctgccctccctccagatctattcctaaactcaattttgactctccctctggtataatctccttctctctgcagagaacagtaagaccttaatgtttaaaaaaatcatttcttcttaaaacttaaaggccctaaaacatcattttgagtttttgtctccagcagggtttatttctgacaacaaaattaatatatttatatttaatatttggagcttttattttacaatcatcttgacagtaatatttttctgatatttgaaaagccccatgatttttctgtgcagagaatgcattttgttaatttatctaagtggctgctaggcttttaaggttttaggttcattttttatttttctggagctcagtcccctaaaatgcaaatgagtcttgagcagctcttccagaagataaattattcttcttttctgtctcctactgttcaaagttagtgataatttttagacccagcagttgaagattttgacattcctgttgatataaatgtggacattccaatgttgttcaacttctgactgtcttagggactgattgcttatctctatcagccaagaaaatgccctttgcattggtctcatctctcacccacaccaaccaaacacatatatgcaatctaatgtctataggtcacattcttgccactttatctctttaaaattggatagttttagatggaatttgcaggtgctaatatggaccactgggtaacagggatagatacagtagcattgttagattatattctctaagttgagatttttcacctaaaaagagacagaagaagatggaggttgcacagtactggtcagatcttcccatgcagtttatcttttggaagggcaacagtataaagcagttaagagcattaattggacattaggcagtcctaggtttgaatcctggctctgacacttattggctgtataatactggtcaagtgacttaatttctctacctctcagttttattatttgtgaaacaggatgacaatattacttgctttgcagaattaaatgaggtaatattttgaaaattatatgagctattatctaaaaacatttagcacagtgactggcacagcayagagtgcccagtcaatcttggtcccttctccccagttttgccctgaatgttggccagctttgctgcagatgctttctccactatgccattactctcatccaatcctttcctttattagctttcttccctagccctcacttcttctcttggacccagtgtgcgcgctctctctctccagaaaaataataattttaaaaaaatcagttcttcacatgaatgcaaaacacctactacaatgatgtgggtgatggtgatgatgataagaataatgtgggaactttttaccctttttgtcctctggattgtaagtttcatgagttcaaagataatgatttcttcagcaccaaatgccttggttcctggaccaggaatagttggtgaatggatgaatctgatattcagagttgcaatgattgcggcatttaatcttttttatttctgcacagttaatccaaatgagtatttattgatttgtatatatatttactacttctattgcaaaattttagtttcttcttttatgaaatagaattcttaaatgcatgcttgtgcatccaagaaggacagtgatgatgtgtttcaatgtattaaatgttgaaatttaaatgttggggcatgttcttgaaatggtgactacacaggggaaaaaaatttaatagattggttttaaggtttgaggacgggggtcctgggaaagtgctgagaatggaggcatagcattccttcccacactcagcacataactctgcatggatttggtttcatttcaaaaacggagtgttcacagactgaatacacctctgtacacttgaccctaggagggcagcagataaacttggggagtcttttttagacaatattcccctgaggttttaagtaaatttttacaagctcctagaaatacttttaagaatctatataaaatttctcccttaccttaacagcttttacttagaagatatatcaaaatgaccccaaaaagcaaaagctctataaggtcagctaatccattaccttagcaatgtgaggtgcataaaatgtgaaccactgaaatttcatgtaaacacctcgcagtttgctctaaattttcttttatctcaaggatgcaaatgtgtcttgtgcttcccataattgaagaatgaaaatgtttgagataaatagcccttcccctgagaggccaaatactttccttgaagaaatgccagtcctatgtccctgtgggtagggttcagtatttgtagagtcrccaattataatggcccagatctaataggaactcaaggattccagcctatttccacctaccccacctgcccaagaccagccttatttccaggctttactctcccttaggcatatgtggtggcaggcacctgtaaccccagctactcaagaggctgaggcaggagaatcgcttgaacctggggggcagaggttgcagaaagccgagaccatgccacagcactccaggctgggcaacagagcaagactccatctcaaaaaacaagtaataacaataataataataataatattaatgatttaatgttcaaaaatatcctatgtccaaaagttctttttataaatctgatccatatcgctattgttgcagcttaaaattctgttacacgtggtaatacatacattaacaaatacgtatagggctccttgatttaccaggggctgtgtgtgaaaactacattaatcataattaactgccaaatggttagaacagaaaataacagctttgaagtccagagaaaggagagagtggagcaggaggaattggagctggatcttgtaagatagttgagatatgcataagttgagagaaaaagaaaggacaaaccagatggcataaatggtgtgaggaaaatcacagaaatggaaagaaagtgaggaggccaatttacatggaaatgaggcttttggaaaagggagtagttggaggtaactcttggaggcagatcggaatctatctacatagggccttgaatgctatactaaagaggatggtctatcccatagaccagtggtgtccaaagttaggaagtgtgtaggaaaatacatttgtatatagaaaaagatgtattctttatatagaaaaagaaatatattttactaataatttcttgtattgacaatgttgtatatgtgtcatttatatgtaaatatgctatgtggtgatccacactcaaaattgttttattgatagagatacatgttcaaaagaggttggaggcagatgactgctataggtgataagggatgattaaaggttttcatgcagccagtgacatgttcaaagcagtattctaagaagatgaatctggcagcagttataccgagaggattggtggaagcagttagttggcgattgcaacaattcaaagggcttaaattatgatagccacagtaggaatgtaaaggagggggagagttccagggatgttcggataatcttattatttgcatggtgagattttcctttagcaagagtattcagcaatctctttgggggctgagaatagagcagtgctcaagaaggtgagtttttgtttgaaactgatttcaaaagtgggttagtggtcaggcgcagtggctcacacctgtaatcccagcaatttgggaggccgaggcgggcagatcacttgaggtcaggagttcaagacaagcctggcaaacatgacaaagccccatctctactaaaaatataaaactagctgggcatggtgacaaatgcctgtaatctctggaggcagaggcatgagaatcacttgaacccaggagtcggaggttgcagtgagctgagattgcgccactgtacaccaacctgggtgacagagggagactccatctcaaaaaaaaaaaaaaaaaaggattagtactaccccaaatgtactatggtctgaaaacctaaacttaaatgtgaccaataattaaaaattacattaattactggtcaaaaacaatataggattaatcctttaattgagtatagataacttcataactaattttatacacaaggaaaatctttgaaaatgtagataacatcttctccaccataatcataaaaaggagcatgataacagaagtagcttaataatggttcctgcattatattaaaaaaaacttatgcttcatatttgctgtttggtgttgaaaagggatcccagaaattttctcatctcagttgcttgttggagatgcattacttttttataatacatgattcaagtacaaacagttgtttttcctcacacagcttgatcttcacaaaaaataaaatttawaaaaccattttggtaaatgtaaatttgtaaaaggaggttttggtacttgtacttgatttaccatcattttctttaaaattgtactgttgtttaacttctcaccagttgatgtttttgtaaggtagaactcttaacaaaagtgtgattcagagttcaaatctattattagccaggcttctcaatttctccttgcacataaaaacatggtaaataatgatagagaaaaagaaatagcatgtttgaaaatgccaactagatcaggcttgtgattcctacatgatactagcattatcttagacatgtgttgataaaagagccctactatcaggcaatttaaattaaaaaaaaaaacaaattcacatattttaactcttgccaggcatcggatataaacttaacaattatctcaatcaaggtaaaatagactatagattgtgtgtgcatatgtgtgaaaatgaacagaatatagtgtagaaaaatagatacaatatgacacataaaaaagaagataagattttaaagttctacattaagcaaaagtaacttttctcaggcattgctggtagaaatataaattggtaacctttctttagggcattggtggcatgtgtcaagagccttaagaatgtttatactgtttaaactcagttctatatttctatttttaagaacttgtcccaagaataaaatccttaaatgcccaataataagggagtagctaaaataagtgaagaaccatttttgaacattattgattataataaggaccatatgtgccctgactttaagtggaaagggcagtagaaaactactattgtttacatacatttataatttttgtacgtacatatttgtatacatacatttgtttacaaaaaatgtaaagaagtataacaatattcttacaagttgttttggtttctaattttttgtttctctcaattttaaattttaaaaaagatatgttgctatatattgtatttatattcagaaaaattatcaaaataattttaaaaataaaataattaaagagagctcccagagtttaaaatgtaaatacctatcatttaattcagttagctgatggaaaattttggtgaccattacatatttatttaatgacttagtcaacaagagctgttgatgtattaaattttgagtagacccagctgtgctacaaaagtaggtaatgtaatggcaactaaagcaaatgtcaaagctgaagcacatttaattatcttggctactggggtgttttaacctgtgttacttgtgctttggtctcacaaaaatggcatcttttaccaactttctaaactgagtaggcaatgcatgctttagattaaatgaaaaggtggtcccttttatttatatttatacaaatatattcattcagtcaatcaaataaacaaacatttattcagcaattgtcaaatgtcaggtattgggccagattatgaaaaagggaaatgagtatcagaaaattaatggtctaatgggaagatcaacatttaagggtggctgaaaatgaaaatagagttatgcatgcagttctagaggaacattgagaaaggggcagccaactctgcctttgagttaggggagccttcccagagaaagtattatagagataggctttgttcaatgaataggagtttcctagatggaaaaggtgaagaggtattctagataggaagaagagcatatacaaaatgtcaaaactctgagataacatggcctgttcagggactggtaggaaatatggtatagctagagcttaggatgagaagcagaagcagatcatgatggcagaccagaagcaagactagattgcagctgtcactcggatggacagaacagtgtgtggagacttgcattgtgaacttttactcaacaatgactgcaggaatacattaggaaagccaagagaacccatagaccctctgaaggaagcagattactcctgcaggacctgggagacaccccaaatactgtaagacaccccaaaaaactgtagaagtgggaaaaggagatcatctgcccctgaacatatatccccactggagagggaacctgaagttctagagtacgggagaagattccgaccttacatgcagctgagtcaatgtagagggccgagcaaaatatggggttagaggaagcaggagaaaagtccctgtgggctcgctggctcccctagcaagccacttctgcctcacctcacaggggtccttgaggaggggtgctagaggcactgggaaaaggccacagggagaaggaaacctccagctgaactttgtaacaatttgagctgatcaaaaagtctcctggccagaactggggggagggcatgaatccagtgtgcagactccacaggcaagggaagaaggaaagccctacttacttttgcagctgggaggcaagtagcctggggcaagttctcagccctgctcacccaccacctggaaacagacttggtgctgttgggaggggcacagtgagagtgagatcagccctttgggttgcctgggagctggatgaggcctgtgactgccggctttcccctacttccctgacaacctgcattacacagcagagagagccataatccttctaggaacataactccattgacctagaaacttcaaccccatcctccacagcagccatagcaagagtctgacatgcctagccctgcccccacctggtggtccttccctacataccctggtggctgaagacaaagggcatatactcttggcagttctagggacccacccaccacctgttcctccccatattaccacagatgatgctctcttgaatgtgccacctcccagcaggaggataaccagcycaaaaatagtgcactaatcaatcaaagctaaggtatcctcacagagtccatttcacctccttgccgcctccaccagagcagatgctaatatccatggctgagagacccatagacagttcatcacaggactctgtgcagatgaccccagtaccagcccagacctggtagacttgctgggaggctagatccagaagagagataacaatcactacagctcagctcttaggaagccacatccctaggaaaagggggagagtactacatcaaggaaacaccctgtgagacaaaaggaactgaacaccagcgttgagccttagaccttccctctgacagagctgacccaaatgagaaggaaccagaaaaccaactctggtaatataacaaaacagcgttctttaacatccccccaaaaaatcacactagctcaccaacaatggatccaaaccaagaagaaatccctgatctacctgaaaaagaattcagaaggttagttgttaagctaatcagggaggtaccagagagaaacaaagcccagtgtaaggaaatccaaaaaaatgatacaagaagtgaagggagaaatattcagtgaaatagatagcataaataaaaaacaatcaaaacttcaggaaacaatggacacacttatagaaatgcaaaatgctctggaaagtctcagcaatagaattgaacaagcaaaagaaagaacttcagagcttgaagacaaagttttcgaattaagcaaagacaaagaaaaaagaataagaaaatataaacaaagcctccaagaagtctgggattatgttaaactacaaaacctaagaataattggcattgctgaggaagaagagaaatctaaaagtttggaaaatatatttagaggaataattgaggaaaacttccccagccttggtaaagaactagtcatccaaatacaagaaactcaaagaacactgggaaattcatcacaaaaagatcaccacctaggcacattgtcctcaggttatctaaagttaagatgaaggaaagaatcttaacagctgtgaggcaaaaacaccaggtaaactataaaggaaaacctatcagattaacagcagatttctgagcagaaaccctgcaagctagaagggattggggccctatcttcagccccctcaaaacattttatcagccaagaattttgtacccggcgaaattaagcttcataaatgaaagaaagatacagcctttttcagacaaacaaatgctgagagaatttgccactaccaagccaccactacaagaaccgctaaaaggagctctaaatcttgaaacaaatcctggaaacacatcaaaacagaacctctttaaagcataaatcacacaaaaatacaatttaaaaacaaaaagcaaaaaaccaaagtatacaggcaacaaatagcatgatgaatggaatggtacctcacacctcaatactaatgatgaatgtaaatggcctaaatgctccacttaaaagatacagaaatgcagaatggataagaattcaccaaccatctgctgccttcagagacacacctaacacttaagtgctcacataaacttaaggtaaacggatagaaaaagagattccatgcaaatggacatgaaagtgagcaggagtagctattcttttwtcagacaaaacaaactttaaggctctagcagttaaaaaagacagagggtcattatataatgataaaaggccttgtccaacaggaaaatatcacaattctaaatatatatgcacctaacactggagctcccaaatttataaaacaattagtaattgacctgagaagtaagatagacagcaccacagtaatagtgggggacttcagtactctactgacagcactagacagttcatcaacacagaaagtcaacaaagaaacaatggatttaaactacaccctggaataaatagacttaacagatatttacagaacattctacccaagaactgcagaatatacatattctattcatcagcacatggaactttctccaagatagaccatatgataggccacaaaacgagtcytgataaattcaagaaaattgaaattatatcaagtactctctcagaccacagtggaataaaactggaaatcaactccagaaggaaccttcaaaaccaggcaaatacatggaaattaaataaactgctcctgaatgatcattgggtcaaaattgaaatcaagatgaaaattaaaaaattctttgaactgagtgacagtagtgacataacctatcaaaacctctgggatacaacaaacgcggtgctaagaggaaagttcatagcattaaatgcctacatcaaaaagtctgaaagagcacaaattgagattctaaggtcacatctcaaggaactagagaaacaaaaacaaaccaaacccaaacccagcagaagaaaggaaataactaagatcagagcataactaaatgaaattgaaacaagaaaatacaaaagataaatgaaacaaaaagctggttttttggaaagatagataaaattgatagaccattagcaagattaamcaaggaaagaagagagaaaagcaacataagctcaattagaaatgaaagggacatattacaactgacaccacagaaatgcaaaaggtcattcaagggtactatgaacacctttatgtgcataaactagaaaacctacaggagatggatacattcctgaaaagatacaaccttcctagcttagatcggaaagaattagatattctgaacagaccaaaaacaagcagcaagattgaaatgataattaaaaaattaccaacaaaaaaagcccaacaccagatggattcacccagaattctaccagacattcaaagaagaattggtaccaattctattgacactattccacaagatagagaaaaagggaacagtccctaaatcattctataaagccagtaccaccctaataccaaaaccaggaaaggacataaccaaaaaagaaaactaaagaccaatatccctggtgaatatagatgctaaaatccttaataaaatactagctaaccaaatccaacaacgtatcaaaaagataatccaccatgatcaagtgggtttcataccagggacgcaggaatggtttaacatacacaagtcaataaatgtgatacaccacataagcagaatcaaaaacaaaaattacatgatcatctcaatagatgcagaaaaagcattccacaaaatctagcttccctttatgattaaaactctcagcaaaatcggcatataagggacatacctcaatgtaatgaaagccatctatgacaaacccacagccaacataatactgaatggggaaaagttgaaagcattccctctgagaactgggacaagacaaggatgcccactctcaccactcctcttcaacatagaactggaagtcctagccagagcagtcagacaagagaaagaaataaagggcatccaaattgggactcccgctgtctgctgatgatatgattgtttgcctagaaaaccctaaagactcctccagaaagctcctagaactgatacaagaattcagaaaagtttccggatacaaaattaacgtacagaaatcagtaggtcttctatataccaatagygaccaaactgagaatcaaatcaagaactcaaccccttttaaaatagctgcaaaaagataatataataaaatacttaggaatatacctaaccaaggatgtgaaagacttgaacaaggatacaaaacactgctgaaagaaatcatagacaacgcaaacaaatggaaacacatcccatgcttgtgaataggtagaatcaatattgtgaaaatgaccatactgccaaaagcaatctataaattcagtgcaattcctatcaaaataccaccatcattcttcacagaatttaaaagcaaacaaacaaacaaacaaaaccagtcctaaaatacatacagaaccaaaaaaagagcccacatagctgaagcgagactaagcaagaagaataaatctggaggtgtcacattacctgattacaaaccatattataaggccatagtcaccaaaacagcatggtactgacatgaaattaggcacatagaccaatggaacagaatagagaacccagaaataaacccaaatacttacagccaactgatcttcaacaaagccaacaaaaacgtaaagttgggaaaggacaccctattcaacaaatggtgctgggataattggcaagccacatgtaggagaatgaaactggatcctcatctctcaccttatacaaaaatcaactcaagatggatcaaggatttaaatctaagacctgaaactataaaaattccagaagataacattggaaaaacccttctagacattggcttaggcaaggatttcatgatcaacaacccaaaagtaaatgcaataaaaacaaagataaatactgggatttaattaaacttaagagattttgcgtggcaaaaggaacagtcagcagagttaacagacaacccagagtgggagaacatcttcacaatctatacatctgacaaaggactaatatccagaatctacagtgaactcaaacaaatcagcaagaaaataaacaatcccatcaaaaagtgggctaaagacatgaatagacaattctcaaaagaagatatacaaatggccaacaaacatatgaaaaaatgctcaacatcactaatgatcagggaaatgcaaatcaaaaccacaatgcgatactaccttactcccgcaagaatgaccataatcaaaaaatcaaaaaataattgatgttggcagggatgcagtgaatagggaacacttctgcactgctggtgggaatgtaaactagtacaaccactatggaaaacagtggggagattccttaaagaactaaaagtagaactaccatttgatccagcaatcccaccactggctacgtacccagtggaaaagaagtcattaaatgaaaaagatacttgcacacacgtttatagcagcacaatttgcaattccaaaaacatatatatatactgtatatagtatatatatacagtatatatatactatatatagtatatatatacagtatatatahagtatatatatacagtatatatacagtatatatactgtatatatagaaactgtagtgtatatatatacactatgtatatactatatatatacacactatatatatatatactatatatgttactcaaccataaaaacgaatgaattaatggcattcgcagtgacctggatgagactggagactattattctaagtgaagtaattcaggaatggaaaaacaaacattgtatgttctcactcatatgtgggagccaagctatgaggatgcaaaggcataagaaagacacaatggactttggggactcagagggaaagggtgggaaggagttgagggataaaagaccacaaattgggtgcagtgtatactgctcaggtgatgggtgcaccaaaatctcacaaatcaccaccaaagaacttactcatgtaaccaaacaccacctgtaccccaataacctatggaaataaaaaaataaaaaatataataagcagaagcagaggatgagagtggaaaactgggctaggccagaaatggcctttatgcacttggagtcataatgtttctgcttcaccaatgattaacagtgattttcctggctaatagaatcttaatcattataatgaggtaggactgttgcctttgaattatggaaattatagctgttaagacctgttccacaaacacaggttatacatattatcacatctctttaatcttctttacagttaatcacccaagtctccacrgggcttattagcaggaaggctattatctcctcttgagatccctcccactgcccctgaattgtccatgaatcctgactttactcaggccaaatgggtcagtcctcctgcagaagcccatagctggatctgtctgtgactgctgccctctctggtgtctgctatatggcaccatttgcacatccgtgtcacagggtacccattttgggtgacaaggttacaactctctttgtttacatttccatcctcagccattgttccctaaatcataaccactgtgccaggctggctggtctggaggcgcttctggagttggcctcatgctagtctgaaattagtccttctcctagaatctgaggccattttgttgagcccagatcaacagcccagattccgcccttctttaggatcactttatttccatggcttccaggaccttccctgctccgggaccttagtcagtgtcatcctgacccaatagatctctcatccccggcctccagttcgaggaaacggggatgaagacactagggcttccctccagaaggccctgggctcctttttccacacagattctcctcctgccaagtgtgcagattgtttctcggggtggctcaaaaggtagcagtttgcaagatggagtttaaaaaacagtttgttgccctgccctaatgctcccccaaaatgcctaattgctttatatttacataactaagaaagacaccaagggattcttccaaaaacaaagatcttcttcaaggtgatcttctgttctgcctttaaagagaagtagttgcagtttacttcactaaaataattaatttttgtctaaccatgtccctattttatcagtgataatgtgctcataaattatacgacagattatgtaatttgcccaaagcagaaagaggtctcagaccccaaacccatgcatttaaccactctgctttactacctcttgtcattcaattcacatgctaccatgtcattatttacttttatgtctcggatactgtactcttattagttaagtttattgcaggaatataaatctctttaagtgtaggcactctcttctgggctgttgctgaaagagagtgggacaacaggtgtatttgtgaactagtagaaaatgagtatatttactgcagaaggaagttgtgttttctctgcaaagttagatcacagaagggagaatgatacttatctatagttctggagggttgaaaccgaatagtaaatgggtgttaggatcaatacatattgttaagaaacagtgttctataaatttcatgatttaggaaagctgtctacaaagctggattaatctttttctgctgagggccaagtttactttgctctgcccctctctgtgcaagtgtaagacagtcaactgacctttcagattatcagcttaatgatagttctctctcagaattctttaaatttaagaataatgaaaaaaaagtccaaagagatctttttcatcatttctcttctccctattattattactctcctcaatgaaatgaaaatgaaatgcctgtgtatcctatttcataaaccaaaaccaagttctgacacattattggaagtttatgttgctttagaggaaaaccatgttggctataaactgttgcattatctggaaatcatactgtagattccaggaggtcaaggcgtctctggcaacttctatatatttataggagaaccgactgcctctcctctaacaaaacctcaatgagacctgactcctagccagctaagactcggcatggtcctccctgcgtcttcaaattctaggactttccctcatgtgcttgccttggactggagctgcaagctaccaagccagtgccagactgggggccaggcttacagcagagcttccacttaccccaaatctgccacagaattaattccctacgtttgacctcatattactttgttttgttactatcattgttactgctttagtattgttgttgtcgttgctttcctgtatatatttaagacttgtggcttttaaaactagtttggatttaagatacacaataagttctatcatttgaaaatgataaatatagatgtccttacatcaattgtcttcagatttcggatatatttagccttttgactttatccaaaaactaaacattctgattggccctcattttaaaagggaagaacctgtttctatttatttagatttgtatatgctctatattgggatgagggagctttttgtactgaaagaagttatgtattttcctacaggttagataaaatctgtgttttcccttggctaggtttatgcatgctgtataaacaaaggtgttctggggctcctaaggaagcggtctgaggaccatgtgtctcacctagttctcccacatgctctccctggtgactgttggcactgaccagaaaggtctagagtggtggagagagaagctaataaacaattcttgaaaacctactatgtgccaggactatgcttgatatacatttgctttgttttatttaactttcataacaatcccagcaggcaattaccattttccttattatatagatgaagagattaggtattataattaatctaatctcacagagccagaagtggcagagccaggagtaaaacacagctcagactccacagccaatgcctttctgtaccctacaccgtccatcatggatttaggtagcctggggacctgaactccccactaggtttaaggtctaattctygaatgaaacctcacgcatttctcttaggttcagggacaatcagattgtcagagtagaaagagactttggattcaacatttgctaacccactggcttcctaacttcttcctaaggccttcactctgtgaagtaggtgctagggttccctgctaatgagtactaagcttctcaagggcttgagcaggcttgttagtctttttagggccagctgtgcaccaactatgctgttgttgtgttgaggccttagcattcctcacttcaaatcaattacttctttattaccttaatacatcactggccatgtggctgatttggaatgtaaaggagactaaccctgtaggataataactttcacttggcacacaaaatctatacggatattcagagcatttgcttttaaaaaatgaatattctgtagcctgtgctgcctgtttattcttatttagagaatttcgtcattttaataatttggtaatattttactggtaggtgcggagatatgtaaaaaaaagtgtatttttttcttttcttgtggatttaaaaaatgtttagaatttttatttgcagcctataaacaataatagtactttatcctttcttatttttgcctatattacaagcaagtaatttcatttaaattgactttaagcacattcctttgaaagaaaccgaagattgttatctttggcaatcctgattagatttcttcctcagacaacagtttattaagtttgtgctatgaatgtgggcaggtggtttgactcggtggagcaagtagtgggcactctagaattctttttctccaagtactcaaaggcctttggaagaatttcctctctgagcatttagatgttccttctactctgtgaggtgaaagtgtgttatgtggttttatttttcacttattgaatgccaattacatgccagccccagggttgtcttacatgtgttatcatatctcatttaatctgaaaaaggattatggcataggcacataatattatcttcatctttcagataaagaggcataagttcaggtaaatacatatcccagtagttacacagctagtgcctaatgatagcaggatttaccagatctgtctgcctttttcaaatataacaccttgcctgggaatgagctagcagaagacttttagaagatgagactggagaagtggcttcaaatttcattctaatcaagacactaagctttgcatttatttattccttcattaccatttattgggcacctaatgtgtgtcaaacartctaggaattggcgacattacaatgaataaaaagcatagatccctgtcttccagaagtttacttctggttattggaggttttgagccaagaaatgacatgatctggcttagcttttacaaagaccctcctggctacagtgtgaagcatcacctgaagagaggtgagggcttcagcagcaagcccagttaggaggccactgcagcaatccagacaactgcggggcttggaccacagtagtggccaagatgagaatttggattttatatggacttagatggaaacaccaatgggattgctgaggaactgaatgtagaaattgcttgtccatgttttaactgcaactatggtcagcctgcatcctaaacctatgctttttaagttatgttaacatgctgaagtacaaagtgacttcacaactatattcaatttcatgaaaaactgtagctcctccttttcagctccttaggcttaggaaaggagagtgcctcttggagcctggaagaggcaggagagagctctgtgtcccagaagcatttgtcatccaggctgcagttagccagctggctccttcaaaagccacacacctgggtggcagcacatatgtggttatacctgagatatgtggtgtgtccatctcagagccactcaaagtccattttaacccttccctatggctccccatgaggaggtgggaaaacgaatcctcttaataagatttaagcacagcttcacatttttctgtctttgttatttctcagaaatgccattatcagtctgagtcagaacagatattaattcttggtcacaaagtagcacttttggcatactctcaccatttttttaacttcagaaacagcttccttgtaggtaactttcactgagctgacattgtcagccaaaaatggttctggagccacttcatctgccataaaatttaataagtccaggatacaaatttgtgtatcacaagtcaataaaattgccaccaagctgtttgtgtagtaataaggtcaataaatgtcatcctcattcaattaattttcattgaccttaaggaaatgaccttctatttccaagtaggagaagaaattggccatggagaagcataactgttgcatctgcttttcagttattacattactgaagatagcatgggcatctagctatgcttgtatattcagactaaaaagtaatctacatggcttatcctgaagtagacccaaatgatttaattacaattaagatcattgaaagaccccacaatatgcttggggtcatcctaactgcatcttccagatatgatctaatatctcactgatcttggccatccattgggttctgctgggcaggatatcaagttaaggatgtgatgagaggctctcactttctggcctgcaaactgcatttgtcacaacccctttctccattaacctggcctggagatcagccctgaagttgctcctttgctgtgctggccataccctgaaggagacaaccacaccagtgagagttgaatgcctctgatttcctccttcctccacaaggcagatgagggaccctgccatttttttataaaattcaaaatcaactaaagtatcacttttttattttattattttcccagggctgcgtccaaagaggactctgcggctggtgctctggactgcagaagaacaaggtggagttggtgccttccagtattatcagttacacaaggtaaaaacccagctgtggattgctaagcatttgtacatgtaatatacaaaaatccctctcattgtccatttaagacttcaataatactttctggtcaactggccctaggaaacacccttgtatgagccttctccctccagccctgtgaatgagaatgcactggtaaaccaatgatgctgtggtgtagagctgagggcttttcttcttctacaccacagtctgaggccaaagaaaaattccaattgccatgctgccatttttttcaagtctacctagttctgctgtattcatgtatgtcagagaaatagttataggcaaacattccctctccccaccgagcctatccccatacctcaatgcccgccatattcccagaagccttggcatttgagagccaggttccaagtcattgagtctgccaagagcattgccatgatggtggtggaaatggcagcagccacaggcctctgtcccaggaatgtggaggacagcttggtttgacaccagctgtcattacacaagtgtgaagcttgaagcaggaaggttattgtggatggtcatgattagaaatacaagaccacatggaagagaggggatagggagattaatatcaagagcaaattttgagacagcaaaatatacaagctgagaaatactctagatcaagtcaaatgttagttcaaagaggaactccaaaatcaacgcgcatatgctggcaagcagtgatggttgcccagagaggagcatttggtctgctgctgctgctggatggtttcccctgaatgtccagatgagaagaagcagatcttgcaagcttaaattatccaaatcggagaagggtttcttttgtgaattgtgtgtatgttatttttgaccttttttttttttcaaagtcagtctctattaccctatttcagtcagttagagtataatgagttcaaagtcatgaatttggtcactgaatacaattatttactgtacaaaggacaacttatgacctatgccctactctttcaccactttagttcttttggcctcaggtgatcctggggataacataattcaagacaagtgtcctttggttggtaggtcagtaacatcattttctatgtgttgtggtagaccacaacatcatataagggttgttctagattcagcaacattcaattaatattttctgaacatgtactatgttccatacaytatgttatgcattaatgttagcatcaaaaagatctaccctgaccttacaaagcctacattctaaaggacactgacgattaacttgaattataaggtgttaagtctttctgggaaagaaattacatctaagctgagacctgaagactgagtggaagtaagctaaggaaaatggagagggagggaggaggtgrgtactgcaccttggcagagggacctgtgtgtgcaaaggcaggagatgagacagaggaaagcacaccagagaaatggaaaggaattcagagtggctgctgcatagaatgcaagatgcacagtggtaggagggtggaacagagacgtaaacaagagcctgaacaagaagaacatatgaatcatatttagacgtgcggactttatcctcgaggcaagagagtaacttatttttaagaagaagctctaaaattctatacatattggactttatataaaaaaaagaatagttaaaagaactattctttttttttttttttttgagatggagtctcactttgttgcccaggctggagtggagtggcaccatcttggctcactgcaacctccgcctcctgggttcaagtgattctcctgcctcagcctcccaagtagctgggactccaggcgtgtgccaccacgcccagctaattttttgtacttttagtggagatggggtttcaccgtgttagccaggacagtctcgatctcctgaccttgtgatctgcccgcctcggcctcccaaagtgctgggattacaggtgtgagccaccgtgccctcttttattctcagtaatacactctactccaagaaaaatattggatttaaattgcaattgatctggctaaaaattttatcatcactgaaattcctagaatgtgaaaaaagaaggtttatttttctgtaatgtgagtttcactgtagcctatcaaagcacatggatgaaatcggaaatgcctaaaattctgaggttggcagaaatacacacactcaaaggacatgcaatcacataaacagaactactttatcttgacagcatccaggctgcctccatacaaatgtagcttcatgttggtggctagtctgcattgcattttcagagatagaaagaagaaattccagaaagggaaaacattggcattttgttttacagtaactctttacctcgcctttaaaaagacattgtgcatgctttacatgatacagccaatttcaaaggacttattctggattcttatgattagcatattgatattgacattactaagactataatcatttcaaaagtggctgagtttaacttaaaagttaatataataagcaagtcacaaaccacaagggtaaattagattgtctttagacttctctgtggcattactgaatgccagcagacagtccaacaatatccagttcactccagtcacaacagagagatcatctgttccaaataaggttatgctaactgctgaaacaaataataggtcaaatttcaatgacctaacataacccagaaatatattccttgctcacttaacatccaatctacagtagggctctgctttatacaggtattcagtgatccaagctgacataccctttaaaaacatggctttaatatgcctttgagtattgacatccagctggcaggcagggggatagtaggaggtttttatgggacagttctagaagtggctgacgtcatttctactcacactccattggcaagaactagtcatgtagtccaactgtgtgagaggctagggcatacaggcactggctgagcagccacttcccaacaacagctctatactgtaggctgggagcattctatagctatattctctatctttggcagaaagctgacccactctagggtcttcctttcacttcgttctggctttctaaacactttagctgcacaagaggccaactgccctgaggtctttacctcccatggtgctcaaagttgagatcagctctgtgagctgcctaaaagtactcatcttcaccactaccaggatgcctttgtctagcaacacacaaaaagaaaaggagtcacagtctttgaccagaaggaccttacattttacttcaaaaataactttaaatgcacacataagaaagttagtataacaaaccatatataatgaagttttaaataatgtactaaaagtattttatttttatggatgatgctatcattgacaaagtgccaaatggtgtaaaggctgaacagagtaaatggaaaggatttagaaaagggagaaatcactatggcatgttagtcgtgaggaaggaggcaacacctaatccttgcagagcaagtggatttcagccagtgatcaagaggggagagaagggacagcagctcccctttagatggatgataatggagtctcgaggtctgcctttggcattggtgtgggtgataccaaataagaacagaacttttatggcgggggtggggagatctattttagtgattgtagaaataaaaggtgtgaactttttaaatgactctgctaacatttttatgatacagttatggttattagtgatctatgtcaggaatcagaaaattatagctgatggaccaaatccagcctgccacttgtttatgtacagacttcaagctaagaagttttttcatatgtttagctgattatgctacagagattgtatgtggcccacaaaacttaaaatattaactatctgggtctttacagaaaaagcttacctacttctggtctataatgataaaagtcataaaatatcatcacattatttgtatacaatgatctctttctcgtttgtatgacctaaaatataattttgtaaattttgtttcgagcctaatattagcctatgtaagtatattgtaggaagatattattgtaatgataaaagcttgcatgcacaatctttttttttttttgcattcttatctggcagtctttaataataaagttggctaaacctacatggcactagctagggagaaaaacaatacgtagattattatttcttctttttgtttttctgaatgtaacattctttcttccccctcacaaagtcttttcaacagcgaaagttctacaaaggctattttaataataaatcagtttgtggaataatgaattattaatattcattatcctttccttagtaaatatatctttgtttacactgtactctaattaatatatgcagaaaatataaaatagttattttaaattgtgggtaaaatgtattgctgaactaattttcaaaattgtagttggattaaaagctacctttacttcataattatgctttcttatgacatatcagctcaattattataatacgtgctagaatttactaaatttactaaacaatttattaaattataaaggatgtgaggctatttatagcttgtgtatacattttgaaattcatatgcaactttattataatgtctaaaacacttcaaggaaacaaactttggcaaaaatggtctataagcattttagtagcagttactaagtaaataactcaaacaggaagtgttgaatatctcactgtagtactatacactagaatataaatcattcctgagatccattcagcatgcctctaacagttcatagcggaaagtcccataaaagatttctcttcttaagaaaatgcaagttcacatgtttcaataagttgttaaattttctctccttattttaaagtccttttcaccatgtctttgattgtcttggtattagcacataagcttgagaatgacttatatggacagtatattgtttgtgctttatttagaagcttcttttagaagcaactcatttttcttgctgttttattgaagtttaattagcatttggtaaatgcacatatcttaagtacacagcaaaataaatttggaaaatgtatacccctatgtaatcatcccccagatcaaggtatatagcattcctattaccctagtaagtttccttatgtccccttcaaatcaacttctgactctaccaaagacaactactatgctcctttgtaactccagattggttatgtctgttcttaaacttcatataaatggaaccatacagtacataatcctgagtctgacgtctttcactaaacagtatggttttgcagtttatccatgttgttgcattaacagtagtttgtccctttctattttttttttttttttcgagatggagtcgtgctctgtcccccaggctggaatgcagtgtggcacgatctcagctcactgcaacctccgcctcccgggttcaagcgattcttctgcctcagcctcccaagtagctgagactacaggcgtgtgccaccacacccggctaatttttgtatttttagtagagacagggtttcaccatgttggtcaagatggtctcgatctctcgacctcgtgatccacctgcctcggcctcctaaagtgctgggattacaggtgtgagccaccacgcccagccatccctttctattactgggtagttttctattgtgtgaatataccacagtctctttattctccagaacgaatgaagcaagaatattctgttgatggacatgtgagttgtttccagttttagctattataaatgaagttaccatgaacatttatgtacaaatctctgggtggacctatgcatttattttcttttctgggagtataattgctgggtcatatgataggtgatgtttaactttaccagaaactgctgaagaggtgggaagttgtaccattttacatttccaccaacaacatgtgggagtcctagttgctccctatctttcccagtatgtggtatcattagcctttttatttttagccattcttataggtgttatgtgtttwtatttttcaaagtacagttctgaagagttacaagaaaaatcctgactcctctcctaatggccactattcttttgccctccctgcttcttcttgccttaagactttttgtttgtttgtttgtttgttttgttttcttttgtatttgagacagagtctcgctctgtcgcccaggctggagtgcagtggcgcgatctcggctcactgcaacctccgcctccagggttcacgccattctcctgccttagcctcctgagtagctgggactacaggcgcccgccaccacacccggctaattttttgtatttttagtagagaccgggtttcaccgtgttagccaagatggtctctatctcctgacctcatgatccgcccaccacggcctcccaaagtgctgggattacaggcgtgagccaccatgcccggccgccttaagactatcttcatttcggtgttctgctttatgatttcagggagaccaaaggcctttttaccctgcatgaggtttgtggggctgttcatggttggagggaccttatttcaatttagagaaacatcttggcaagaggaggacatagaaatgccgtcctgctcataaccacggccgactcccaagaacacatgggggctgttgaaactcaactggagcccaaaggggaggacgattccctcaaagggcatgaggaggaagatttctcttttatgcccagaaaagaggttattctagggagaggggaaaagtccagaaaatgcctttatgttattctttattgataaattacattttttaaaaatatgaactctattggttaaatttaactggcattcacttaaaaggaaactttaccacatagagaagcatgttattgcactctagtgaataagagtttcattataggagtggaatttgactttgaaatttgaaaatatagatgagtttattgaattttcaaatcagtgaataaagtgagggttgtccaggtaccatttgcctaatctgcttttcatgggaataatgttgctgtcttctcttctcttctcttggaaggagaacaggatgtcatttctcatgtcctgaaatggacaaaggagaaaaaacatacctagcttcaactggatttctggcatttgttaatcttttccattttaaggaaaaatatgatctggcataattataatgagtaaggtaatctggccttgagaaagcctcattacacaaggtaatcaaataaaatagattgatatgtcttattctggcatgaaaaatattttaaccttttcctgatttattgcacaaacttctggcaattgaattacagggataatgaacactgttgtgttctggtagtcattaataagggcaatattttaaataggctttattaaatgagggatgggatgtatggtcattccaaatacacgaatttatctgaactctagccaactctaaaactgaaaaagcaaaattgaatattttgtcacaatttcctgttttgtcatactgaggaacaaaaattcctctttatgtatagaaatacactaaagtgttagcttcttttagcagtgaagttcttgccagcttcccaacctgcattaggtttcatgtttcactctaaaataaaagaatatgttagaaatgcttttgagacttcttcgtgctatctgggcaaatgtgtttctttggcatttttattttactaactctatttcctctatatgatgctaatttagatagagtgacactgctagagtaagggtattatactcatgttgagctctggttatacaaataatagagctgatgtactcattcagcataattgtgtccggactatgtctccagcacagcctttcttatatctttaatgttctgtgcagtatagacgtactaatcagaggtgattgtctcaatcattactgctgggcctttatgcatcctgtatttttctttcagtgcctagatattgcattagtctctcaagcacatcacaaaactggtttaaatttcatttgtctcagtgttttcttggtctggagcctttgtagttcctatattcacatgatttatactgcacacctgggagctcttaagggtcttattagaatttgtggattttatttttgtaaaaaaaggaaaggattgtcttttgagtttgctttctcctgtgtagaattccattatgactaggggacttctgaatcttatgtacatatggtaattatatatcaatgtatgccagtctaggcagagctatcaaaatatcccctttgatactaggagaatcatataccaccttgcgaataaacatgagtaggtttcaactcatctctttgctttatcgctctttagaagggatccttcttaactggcttttattatatttttctatataagagaaaacagtttaaagtaaaaagactatgacaactagaatggaattttttcatgtttctgggagagcaagaccttgcctaccattctgagataattttgtttaattcaatgccttatggtttcagattatagtgaagtttgacttgagtgttggttttagcccagtacctttaaagaaaagagaaatatcccaacttttctgctaccattactaacctaagtaaaacaattgccttttaaagttactcctaagaatgttgtgccaaaactttgaggtttcttgtcaattatttggctggcatttattctyccctcctgaaaccgtgaagaatggcttcagcttgtatctagtctgttttaccagcttacaggagagtgccttctggcacaaatagtttctgcctcagtgcctccctactcctaaccaggtcatgacctgacccagaaggacccataggatatctagtgcatgaacttcctgaggaaatcaagttggcacaccaggatgcacaaatctgaactgaggcatcatgccttgggctcacaagtgaactgcatgggtcagaggctttgggactaaattatctcattacatgtactggggccttactaagttacagagtcagcaaaccacttttcaatcaccagcactattttatttggcctgaagttgtcttctgcccttttgttttctaaatcaggggttggcaaactttttttttttaacagtccagataggaaagattttaggactgcaggtcatatggtttctctactcaactctcattgtaggcagtcatgggcaaaactagacaaatgagtatggctgtattccaaaaaaaccgtatttacaaaaaaaaaaaaaaaaaaaaaaaagaataaaggcaggtcagatagtttactgacgcctgttctaaactgttacaaggcagaagtttagaaaactttcttctgaagccttttcttatatcacggtcacagcttttagtgaaagagatttgtagcacatagtggaattctaacgtttagagattatgtcttggtaggctaataataggactgttggtaagcttagcatttacaaggttgcagttgtttccctgtaggtatttggccaacagaggccaacagaacacaccatcaccagatcagtctagtgccttacttatatcccactgagccacacaacaggcataattaccttgttggaggaagaagttaatgtacttcccgagtatttctaaaagcaagaacagaaccctttataaagatagctaaatgtgtactggaaaatatattttaaaggatatctattttaaatgtttacacatatagaagggtcttttagagaaatgaacattccaatacattttggcaatttcactgtttaaccacatcctagttttgtccattggtttgcttacactatttcttttttattttttttaatatttcctttcctttttaatattaaacaattgtgattcttttttttttgagtgacttcttttattattattattattatactttaagtttagggtacatgtgcacaatgtgcaggttagttacatatgtacacatgtgccatgctggtgtgctgcacccattaactcgtcatttagcattaggtatatctcctaatgctatccctccccactccccccaccccacaacagtccccagagtgtgatgttccccttcctgtgtccatgtgttctcattgttcaattcccacctatgagtaagaacatgtggtgtttggttttttgtccttgcgatagtttactgagaatgatgatttccagcttcatccatgtccctacaaaggacatgaactcatcatttttatggctgcatagtattccatggtgtatatgtgccacattttcttaatccagtctatcattgttggacatttgggttggttccaagtctttgctattgtgaatagtgccacaataaacatacatgtgcatgtgtctttatagcagcatgatttgtagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccaatgatggtgagcattttttcatgtgtctgttttctgcataaatgtcttcttttgagaagtgtctgttcatgtccttcgcccactttttgatggggttgtttgtttttttcttgtaaatttgttggagttcattgtagattctggatattagccctttgtcagatgagtaggttgtgaaaattttctcccattttgtaggttgcctgttcactctgatggtagtttcttttgctgtgcagaagctctttagtttaattagatcctatttgtcaattttggcttttgttgccatcgcttttggtgttttagacatgaaggccttgcccatgcctatgtcctgaatggtaatgcctaggttttcttctagggttgttatggttttagttctaacgtttaagtctttaatccatcttgaattaatttttgtataaggtgtaaggaaaggatccagtttcagctttctacatatggctagccagttttcccagcaccatttattaaatagggaatcctttccccattgcttgtttttctcaggtttgtcaaagatcagatagttgaagatacgtggcattatttctgagggctctgttctgttccattgatctatatctctgttttggtaccagtaccatgctgtttgggttactgtagccttgtagtatagtttgaagtcaggtagtgtgatgcctccagctttgttcttttggcttaggattgacttggtgatgcgggctcttttttggttccatatgaactttaaagtagttttttccaattctgtgaagaaagtcattggtagcttgatggggatggcattgaatctataaattgccttgggcagtatggacattttcatgatattgattcttcctacccatgagcatgggatgttcttccatttctttgtatcctcttttatttcattgagcaggggtttgtagttctccttgaagaggtccttcacatcccttgtaagttggattcctaggtattttattctctttaaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatggggttttctagatatacaatcatatcacctgcaaacagggacaatttgacttcctcttttcctaattgaataccctttattttcttcccctgtctaattgccctggccagaacttccaacactatgctgaataggagtggtgagagagggcatccctgtcttgtgccagttttcaaagggaatgcttccagtttttgcccattcagtatgatattggctgtgggtttgtcatagattgctcttattattttgagttacgtcccctcaatacctaatttattgagagtttttagcatggagggttgttgaattttgtcaaaggccttttctgcgtctattgagataatcatgtggtttttgtctttggttctgtttatatgctggattacatttatagatttgcgtatattgaaccagccttgcatcccagggatgaagcccacttgatcatggtggataagctttttgatgtgctgctggattcagtttgccagtattttattgaggatttttgcatcaatgttcatcaaggatattagtctaaaattctcttttttggatgtgtctctgccaggctttggtatcaggatgatgctggcctcataaaatgagttagggaggattccctctttttctattgattggaatagtttcagaaggaatggtaccagttcctccttgtacctctggtagaattcagctgtgaatccatctggtcctggactctttttggttggtaagctattgattactgccacaatttcagagcctgttattggtctattcagagattcaacttcttcctggtttagtcttgggagggtgtatgtgtcgaggaatttatccatttcttctagattttctagtttatttgcgtaaaggtgtttgtagtattctctgatggtagtttgtatttctgtgggatcggtggtgatatcccctttatcattttttattgtgtctatttgattcttctctcttttcttctttattagtcttgctagcagtctatcaattttgttgatcctttcaaaaaaccagctcctggattcattaattttttgaagggttttttgtgtctctatttccttcagttctcctccgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttggatgtgtcccagagattctggtatgttgtgtctttgttctcgttggtttcaaagaacatctttatttctgccttcatttcgttatgtacccagtagtcattcaggagcaggttgttcagtttccatgtagttgagcggttttgagtgagtttcttaatcctgagttccagtttgattgcactgtggtctgagagacagtttgttataatttctgttcttttacatttgctgaggagagctttacttccaactatgtggtcaatttttgaatcggtgtggtgtggtgctgaaaaaaatgtatattctgttgatttggggtggagagttctgtagatgtctattaggtccgcttggtgcagagctgagttcaattcctgggtatccttgttaactttctgtctcgttgatctgtctaatgttgacagtggggtgttaaagtctcccattattaatgtgtgggagtctaagtctctttgtaagtcactcagggcttgctttatgaatctgggtgctcctgtattgggtgcatatatatttaggatagttagctcttcctgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccagtttgccagtctgtgtcttttaattggagaatttagtccatttacatttaaagataatattgttatgtgtcaatttgatcctgtcattatgatgttagctggttattttgatcgttagttgatgcagtttcttcctagcctcgatggtctttacaatttggcatgattttgcagtggctgctaccrgttgttcctttccatgtttagtgcttccttcaggagctcttttagggcaggcctggtggtgacaaaatctctcatttgcttgtctgtaaagtattttatttctccttaacttatgaagcttagtttggctggatatgaaattctggtttgaaaattctttcctttaagaatgttgaatattggcccccactctcttctggcttgtagagtttctgccgagagatccgctgttagtcttatgggcttccctttgtgggtaacccgacctttctctctggctgcccttaacattttttccttcatttcaactttggtgaatttgacaattatatgtcttggagttgctcttctcaaggagtatctttgtggcgttctctatatttcctgaatctgaatgttggcctgccttgctagattggggaagttctcctggataatatcctgcagagtgttttccaacttggttccattctgcctgtcactttcaggtacaccaatcagacgtagatttggtcttttcacatagtcccctatttcttggaggctttgtttgtttctttttattcttttttctctaaaaatcccttctcgcttcatttcattcatttcatcttccatcactgataccctttcttccagttgattgcatcggctcctgaggcttctgcattcttcacgtagttcttgagccttggctttcagctccatcagctcctttaagcacttctctgtattggtcattctagttatacattcgtctaaatttttttcaaagtttttagcttctttgcctttggtttgaatttcctcctgtagctcggagtagtttgattgtctgaagccttcttctctcaacttgtcaaagtcattctccatccagctttgttccgttgctggtgaggaactgccttcctttggaggacgagaggtgctttgctttttagagtttccagtttttctgctctgttttttccccatctttgtggttttatctacttttgttctttgatgatggtgatgtacagatgggtttttggtgtggatgtcctttctgtttgttagttttccttctaacagacaggaccctcagctgcaggtctgttggagtttgctagaggtccactccygaccctgtttgcctgggtatcagcagcggtggctgcagaacagcggattttcgtgaactgcgaatgctgctgtctgatccttcctctggaatttttgtctcagaggagtacccggctgtgtgwggtgtcagtctgcccctactggggggtgcctcccagttaggctgctggggggtcaggggtcagggacccacttgaggaggcagtctgcccattctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcagggctccttgagctgtggtgggctccacccagttcgagcttcccggctgctttttttacctaagcaagcctgggcaatggtgggcgcccctcccccagcctcrctgccgccttgcagtttgatctcagactgctgtgctagcaatcagtgagactccgtgggcatagtaccttccaagccatgtgcgggatataatctcctggtgcgccattttttaagcccgtcggaaaagcgcagcattagagtgggagtgacccgattttccaggtgccgtctgtcacccctttctttgactaggaaagggaactccctgaccccttgtgcttcccgagtgaggcaatgcctcgccctccttcagctcgcgcaygacgcactgcacccactgtcctgcgcccactgtctggcactccctagtgagatgaacctggtacctcagatggaaatgcagaaatcacctgtcttctgcgtcgctcatgctgggagctgtagaccagagctgttcctattcagccatcttggctcagtatttcttttttaaacctgaattattttctgggagagaggctcttcccaagtgacccaaagatcattaggtctttgggtattcagtagcccttctggaagttcatcttctacttctggttactgtgattttctgtgcttccacgacactaacacgtaaacatcaaagagtggtctctctaagacagcttgaggagtgcacgagcagaagtactggcagggctgttcataaagccaatgccagaaagcagctcctcgctggcacatccactttgtactttgagacgcagtatccagaagccaggatgggcaatacccaaactatgttactttaagggctgaagatcaggcagggaactgagccccagaattgttagacattgttgtgagtgcaaagtgagcacttttgtctttctttctgctactcatcttacttgatcattcctgagtatattaaccaaatcctgtggtgtcttaaagataccatgtgtgccctgagaggctggtctcggtctagctttctgatttccttatcaattgggtcacatctgtattttctgctgactcacttatgtgtgtaaaaaacacaaaggcatacttttttttttcctaagcagatcggaacttctattccttttttttttttccagaagacctctctcgtgtactctcatcaaatgcttgtcctacatttgtaattattcattctagaagctgaggttgcccctagcaaccagcagttttgtctaaactgttttggtttcagggttgtcttaaaggagagtttctcaaaatccatttccaaagagcttttataccccacacagcaaaacatgtataaacaacaattcaaatttagggagcttaacaaggcctttcaacaaaggtttaaagtggtttcatcatatgatttatttaagattaaacagaatttctgttactagttaaaacgggagtgtaatttgcttttatggattcctatagtttcatttaataaaactcatccaatcagatgcactccctcccctgtgaaatcagaggcagtgccatatttgtaaatgtgtttcaggcaactctccaggtagtaactgagggctggaagaacgtacagcatccacctgccctcactgccatagctggcagtgttttttcccctccaaagctctggaaaatactttattatamctcacagagccaaatgagaggcaatcaaactgttttgtcatttgaattaggaaaggtcaaagggaaaggaacataatagtagacagacagaaaagtgctttgtgaaaattacccattttttccamgtaaggaaaagtaatttgttttttttcagtgctagagatttttgttttgatagatttacagagagaaaagaaaccaccaagaattttgaaaggtcccatttcccaaacaaatatgtaacaagttcttaccatttaaaagatggcattataatctcttgcatctatgtgatcatttataaattacgctttcgtggacatcaagtcattgatgatagtaatgaccctggtggtygccagaccatgtactgttttccttatttcacacatgaagaaacagaggctcaaagaagtgaagaatgtacccaagtttgcatagcacagcccataaggtgcagagcctgaacttggacttcagccatgacttctatgaccacatacttctctgtcaccatcttaaatgtagatatctactaatttgtcataaactgaaggacatacatagcagcatatttaggaatgctggataatcagtaacatataaatagatgaaaggagaagttgcttcaaggtgcttagtttaaaacacatatagcatggtatcaattctatacaatggccaaaggatattgtgtaaccatgcagacatcagttgtcactagtaattctcaatgttttatattcacactttcttggtataaaaataaatatttgtatttgttcacgaagttaattctataaatcctgctacaatgagttttaaaaaaataaccaacaacacttcacttcagtcatctgtgtaattttcctttagtttggggcattttctaggtaaagtttyagctaaacaatacagaaaaattaaaaagttcagagatcttttaatgatatgaaaaactgtttctaataataataaatgttaaaatcatttcactattcaaaagactgcgttcagagcggaggcaccctaacatactactctaggacatttctcactgccttcatcttcaaataaaagtgagaatagaaccctaacctttgagagatggaaataatgcatgtatatgtctgtttttatatctttcccatgtgtatagagcttagacactctatatgtgaagaccctccaaaaatcaagtctggctttcttctttcaggataaccattcccgaaacaccaaggacagggatacatcagaatggacccctacctgtgctatatttaaagatctccaaggatagagattttacgtatgtcagtattttttaacactatcagacaatgagaatattcctggccaggtccacttagtgatttcttcattgaaggatacaatttagaagattggaggarcaattataaaagaaagtaatacaatttagaagattgggggagcaattataaaggaaagtagctgtaggtctccaaaagttaaagtcccttaatcccagttgccttagtagttcttgcatgaaagcactaaggaaggatcaatgactgggagatgggatgaattctgaattgcaaaagagacatttaaatattacttgcaaactaaactcaaagcacaaataatttaacactgttttgttttagtttctaaaaaagtggactctaattcattctttccttgttcaggagataaaactatttgtaacctttaacatgttcttttcttcacagttgagagctcagtttgttaatactttctttcccaaactgttttctgaatgtattggaaaactgcacctgccagaatggattggtgtttgttcttcttcaatgaaaggtggctgtgatcaggagctgccccttttagagagcttaagctgccaaagcctaatacaacagaggtggaacggaaaatgagaatgaaggacatattcaaaaatttaacaaattgttggtgcctcaggcatgaagcccattggtttccaaagaatttggcagaaagatttctatcttctcatcttgtaggcaattaccttaatatggcacacttttgtgatggctttcattgaaaggctctgtttaaacatctttttctgaatcaccaagataagaatggagcaaatgaagggaaaaaaaatattcacttgtacacaaagctgctaccttcaattctctgaaattgtagttaatgcctaattatactgacattcctattgtacaaaagtgttgagaatgcaaatataatttcccagctaattatttcattacatggaagtgacatgagtgaagtaataaattagcatcgtctttataagaaccagcaattctggactttataatattgaaattttcaagtggagtgaagtgcttttttcttatgactactctgattaggtgaaaaatgccttttaaatttatgtgtataatacacctccttccttcagcagatattttaccattaatataggacagtgatatttatgtgagtacattattactgagaaggagacccaaaggatgtcaaagggcagagctgccagctgcgacagtctggcttgtactgcttttcttaaatgtggttcaaagcaatcagattatgaattgcagtgaaataaacttacttttatttttaaaatacaaccaccattaacagctccccagttagaacaactgaatgtcaaataattgyattctcaaatttaaactagaaaatagtagagcttgaggaaggggagtggaaactcaatagtgacacattgagatgggttagaaggtattcagttctccatttctttgatttaaggatcgtcaattgttagtggtgcgattaaaattaatacaaattttcaggaaaaataaaactacattaaatgcacaggggtttttaaactgacaatatcatacagtgcccaacacttttgtttttagaatcaatccatgtctaaaataccttcaatccagagtctgcagatgtctctgaaccctttggtcattagcagtgaagcattggcattaaggtgccaggccactttgtgtcacccatgctccttgttttgacaaggtgctaaaggtgtacccttgtggttggcagcctattacaaggcatattgaacacgtttttcctctgtactttcaatttggccaagttttttacacttaatttttaattttaatatttctgtaagccatatagcttctcctgaaactctaagggagcttttggcaaattgcttagtacctgagtgggaggcctccatgattcatggctggctacaccagtctttgctcaccttgaacactctagagtctattctgaagatttggcgatttctattgtttttcattgttttgcctcacacatgaaaatcaatcttctgtgtacatcaaaatataatgaagaattttaatcaataattatggactgtaatttaaaatttaatgatctgtgttgataccagtgtaaataagtgaagtgtaaaatacattatccagggccctttctgtgtgatgaagtttgcatgtggacaaacaatgacaatgaatatatgaatacaatacaatgaatatgtttgtttatttgcctagaatttggtaactttcttatggaatgcatcaataacaagatacattccaatttccaaaatgctaaaaaaggagaatactgtgattcttacatttagggaaatatggtattttatcttttgaattttatactggcagaaacaggagatgcaaaaaatcagaaaaacaagccagacgtggtggtgcacatctgtaatcccagctacttgggaggctgaggcagaaggattgcgtgagcccagggtttgtgatcagcctgagcaaygtagcaagaccccatttcaaaaaaattagaaaaattgtgcttaagtagccttttggtcctgatttgcttgagagtccagcttgtacccattgtcctgacataatcattaatagaatcccttttcactctcaaaagtttcctggcctacatagcaacttaagtaatggttactctacttattagtcacttttgttggtaataacaatgcctcgagagaacagaatagcttggtatattatagcccttcaaataaatatattaaatttatataatcctcagaacaaccctattaaatagccctttctttttgatgaggatatgaagctcagtgagattaatggttgccagggtcatttagctattatgtgacagaaccagtactccaacccacaggtccagggcaaattaattccattgagtttaataataataacactatgaatgatcatcataatcaccattactaccttactaataaagctaccatttgcccaacagaggttcttgaccattgctgtgccacaggccactttggtaatctggtgaaacctatggacctcttttcaaataatatttttgaatgcataaaataaaatgcatagtattacaaggatatgaattttattaaaatatagttaccaaaaattttaagctaaatttgcartatagttatatatgtggttttccaaatgaattaaacaagatcttgaaggattatttaattatgactatgatatcaaagtaatgatgaacataaagaatacttagagatttctgcaacaagtctaatgtgatatgaaaagatctatgatttctaccagcaacaaagtgacaggttttgctaatactactgaagtttgttgcttacattcataagtaaagaaaattctaaattttacatagaggttagtaaaaataaagatgtaattttttcccattcaagttcacagagctcatccaagtgtatcaacccccaagggaccccgattaggacttgctgccttggaataaacctgcaaaacaactattattcccattttacaaatgagtaaactgaggctcagagtaattaagtaacttgcctaatattatttaccttatggctgagaagtgcatcaaatggcattggcacttgtacatcacctccttttgctccccagtggcaagcactatagaggtgggtattgtagtgtccacccctctctgagactgacaaccttttcagcatggttgccctagtcacttgcacatcctttaaacaccaatgatgcccttgatggagaacacagatatccaaagagaaactggaggagaggtctgagtgtctgactaatgctttttattcaaccctccttgaggatttctagtgttcagtatcccgtcagtggtcctcacatggctccccagaatgatcattattcccgacatatttgctgctattttctaccatagctattttcctcttctacctttaggtgattattgctgctacttattactattctcagatgaaggaaattgtttttcttcacctcccttagttcaatacaggtacctatttggattttttcagtaattgctataattccttagcctctctttatctaaactatacccattaaattatgttaactcttctcaaagctaaattgcctcatctgtttattattttcctcatcttgcctgaatattttaaaacttacaaaatatgtgaagcgattgttaaaaatctaagtagtcccaggacacatttattagttactgtaattgagtcttactgattacacatgcattataagcctcatgatgtgctaactttagcacaacaaagatacagttttaaaatattatatatttaatattttttaaattctatgttgtcagttcagttactgttgctcatctccttctcctcctgagtaatggccaagttattttggtgagtctaacatatgggagtctcatctttgatagcaaaatgatgatgacatatagtctactgagaatatattcagccctgttttcacctgagaaggaggagattttgccacctagcctccaaaataagagcatcttattccattattgaagggacctttgaagtttcacttgtattttgataatttatggccacttcttaaaaaatcactatcactctatatatcctcctggaaagcatttgttttagcacttataatggatgttgtaaacatttgtatattattaagtgctttataacatacacagtaaagattcagctaataactttaattgtggaactgtaggttttcttgagaacatttttttaaaaaggaaaacagattctgaaaaactgatgttattttatcaccaacatgagtaaccacatcatcatcatcaacataatcattatcttcaccaccaccaccatcatccaaaatggcatctagttacatgctcgcatgggttcacatatacaaatatacacacatatgtgtttaaacacacacatacatgcatatatttattcattcagtcagcacatgtttactgagagcctactaagtgccaggcagtgttttgaggtctgccctcatcttgcttccattctagtgaatcaagactgataataaattggataaataagtaaaattgtatgttagatgaaaataactgctaaggagaaaaataaaacagggagcagagatagagtacatgaggagggggctgttttaatttttgatagaggggaacaaggcagactttatggaggtggtaatatttggttaagacctgaaaggatgaagaggagagccacgtggatacctggaggagagcattctagcgaagatggagagttgttccaaaggtgctgctggaggccatgcttgacattcaggggatagggaggaagccaatgtgcttgaaatggagcagtgaaaggaaagcagtaggacaagaagtcaatataaagaagcccaggcagagtcaagccccatgggccattttctctgagtgaggttggaactatgggaggcttttgagcataggagaaacatgatctgaatcaactttctaaaataatcattctggctgcttggttgagaacagactaaaggggaaccagaatggaagaaagataatagcctaggcaagacaagagtgtagtttggaacaagatgatagctgtggaaggcatagcaagttgtcaggctgcagataatattttaaggaaggagcgaacagaatctgatggtggattgcatatggagtatgagagaaatagaggagtyaagcataaactgacagtttggggcccaaacaactgaaatgaggggagttaggcagggggaaaagggggagataaggagtatgggtttgaacmtgttaagtttgagatatcagactttcatgtggagaggtcaagtaggcagtttggtaaaaagtatagagttcaatgaattgacatttctcaaaagaagatatacaaatggccaacaaacatatgaaaaaatgttcaacatcactaatcatcagggaaatgcaaataaaaaccacaatgagataccaccttacccctgggagaatggccattattaaaaaatcagaaaacaatagatgttgtcgtggatgtggtgaaaagggaactcatacactgctggtgggaacgtaaattagtatagcctctatggaaaacagtatggagattcctcaaagaactaaaagtatatctaccattctatccagcaatcccactactaggtatctgcccaaaggaaaagaagtcattayatcaaaaagacacctgcacatgtacatttatcacagcatggttcacaattgcaaagatatggaataaacctaactgtccatcaatagataagtggataaagaaaatgtgttacatacataccacggaataccactcagccataaaagagtgaaataatatcttctgcagcaacttggatggaactggaggccattattctaagtgaagtaattcaggaatggaaaaccaaataccacatgtcctcacttataagttggagctaagccatgggtatgcaaagacaaacagggtggtataatggacactggagacttagaaagggggagaatggcaggtgaatgaaggatgaaaaactacctattgkgtataatgtatactattcgggttacgggtgcactaaaatcccaggcttcactgctatacagtgcatccatgtgaccaaaaaaccactgtacccctaaagttattgaaataacaaaatgttttaagtatagagttcaggggggaagtctacagatagccataggcatggagttttcttcatataaatgctccatctgaatggaaaataatagttaccctctcacaacacccctgtccccctgtccaatggaagctcagcttctatgttttcaatgctgtgattgttggttttgctctccagggaatatagtgcccttagaggctctgtctcttcatcttgaagatcccctggtcctagggtctggattctccacaagcctcctttatcacatcatcatgaycctcactggaatcagtctctctgaactgttttcttcctcctcctgatgtctcactcccctctctcctttctccagggctattgttgccaccagttcctaaagccattggttgcaccacctttccttcaataagtcagctgatgtaattggatagagatggttttgtggctaactttttcagccttttgaggttcaagtccatattctgtagacaacttgaggcttctttagtcataaagccaaataaataataactcaactctcaccttcagattctccctgaccaagatcatttctcccattttctaaataggctgaaggaaggcaagggctgaaacggagacaggatgctactgcagtactccasgtgaaggctggtggtcgcttggactgagtcagaacagggaaactgatgggaagttgtcggagagtaagtctatgttgaaaatagagccaacaagatttgttgatagattgcattttgggtgtacaagcaagagaggagttccagaagaaaccaactctaccagcaccttgattttagccctgtaaggcttatttcagacttacaacctccagaactgttagagaataaatttttaggccgggcacagtggctcatgcctataatcctagcactttaggaggccaaagtgggtggatcacctgagcccaaaagttcaagaccagcctgggcaacctggygagacttttcctctataaaaacacaaaaaaattagctgggcgtggtggtgcacctgtagtcccagctactcaggagactgaggtgggaggattgcttgagcctgggaagccaaagctgcagtgagccaagatcatgccactgcactccaggcttggtgacagagtgagaccctatctcaaaacacacacayacacacacacacacacacacaaattgtgttgttcaagtcagtgactttgtggtaatttgtgacagcagcaataggaaactaatacacaattagacatctaagtggaggtactgagtagctgtgggatatgagtgtagaattcaggagatgcatgaaaatatgaatttggaactcatcaccatacagatttatttaaaaccatgagcctaaataagggttccaacacagtaagtgtgatagagaaaagaagaggcctttagtctgtttctgagcaccccaatttctattggtcaggaggatgagaaaaccagccaagaaaaatgagaaggatcatccagtaaagcataaaaagagccaagagtctgaggttccagaagccaaggcaagaatgcatttccaggagtaaacaaatgtcaagtgcagctccatcacaggtttgaaatttggtgctcactaatggtttccactttaaattttttgctaatgcctacaaaaattctaggagggacaaccaatgtttgagagtgagatactctacagaacatgcttatatttatccttttagagattgcctaagctctgatcctctcttggaaagctacattctggacattagttggatgcttagaataaagtcatctgttcatttgacaagtattttcaagtgcccgttagctaggttctgagaatatgctgatgaactaacaagatccctgctctcatgggaacactttcagtctagggtatttgctgaggccaaacatcacctcttttatcaagcttttgccaacatttttcagtagttgctttcccttctttgtacatattcatagaactcatcacatttaatgtattagccagttattgcctctgctggtaaactctcccctcctttaggaaagcaaccctatcttagtcatcttcatatatagataccctcatatgtaggttggaaatatgatttattattaaaaccaggaaatgtctgcaagagaaaggaggctctgttaattaacaccaagacaggggatgtaaactgggacttcctagggcaaacaaaaatgtatagtcaccctatcactcaagtttacgtcaaaataactgttgaataaatacattttgcttcctgaaaaaacacatttactgaaatgtgacttaatattttgcttttggctttaattgaggatcaatatgtaagaaatagtgttaggaaaagtgtttctgcatcttttgtaaaactgttattggagactgtgtccattattttgtccagcgttcctcatataaagagccatgtaattactccccttagaactgagcgctagaaaaaaatattgcttttttcaaggagatggtggtgcactttctcttcctagataatgagagctcagtaatacatcaatcacgctctcacattggcagccacaagctagagctaaattatatcctcaagttgcttttaaggctgtgtcaaaatgttccaaattgtgacttttcctttgccttaaacatttattgttcacctactatgtgcttagttctgttatttaatctagagatatggcagagatccacacacgtgattcctgtgttcatggcattttcttggttctagcacatttacctactcttttagtacagtatttggacattttcttgtagagagccttaaatttttgcaggagcaaggcaggcatttaaaaaaaattgaatgaagtgcaataggccaacaaattagggaggggtatggacggtagtcacagaaggcttgggcagaagtagggcatgaagtcacttgagcagaccaaggagccctgaagttcatattttggtacttttgtttttcataaggtttcaaacctgctaattttcttttgaaaaagaagaaggaaaggcccgcctaagaaaatataattatttctaaagttgtggttagcatctttactaatatttgtaaagagtacttgatcaaataaggcatatggggatactgtcacaatccagaaatgctgaaagtgcttgtctgtaggctagagaaagaaaaacccacaaattgggttttaatatgatacaccctatacaccctaggattgagtaaatatttgggttctagagtatagcgtagtctatttttgcaggacaagaaaatgatgagtactatttttttaaaaaataacctgtctacttatgggtagatgaacttagcggtccattataaccttagaaagggacttgaagaagctgctgcagtcttcccaaccaagagaaggacattagaggtcaaccagaaagcactatcttggctggaacaacaatgccatcaaaaacaagaaacacatctttatgtgttggtttatttagcatgtcacagtgttaagggaaaatggtcaaatgaaggaaaggttcttcaggcaggcaatttagttgttaccttttgaacctggagaagaatagtagtgtggtgggtataacaggaaagactgacagataacctgttagaagaggggactgagagggatagagaatgaaaaaggcagggaagtctgctcctacaaacccagctatgttggcactttctcttctacaactgcatactgaaatgaacgtgaaaccagtagcatgaaacacttgaccaatacatagcattaaaggaatcaaaatttaattgtgagctcttgagtcccactacttctattattattatattgcttccacatgaaagaataaaattagaagctgaaatagatatcaatttgctatgtaagcctttttttaagtcatatctaccgaatatcctggatattgcattttttaaaaaagcatatcaaatgcagtcagatttgctatataatacaaataaaattactctttttagctaatgtttatgccacatttttagccttctggctcactgttatgaccgtagtgtcatttatgcagggttcgtgtgtttttggtaagcttaagagttatccacggaccttaacaagcacaagaggagaattcactaagatctagagtgcttcaaatgacattgcaaacattggactgcctgaaaacataggtttgtctcagaacagaatacctctgtgcacacacacagaatgataggtctggaaagggatctccartggctactcattctgttcctgtctccaggtacgatggtggctaaaccatagtaggagtgcagtgacaagatggttagatccacagaggctcctgcatgtgttaggtttcccgctctgtctgcaattttggtactaatgtaacttacccaagactgcccatttccccaagctgcagccagttgagctatcaaataaaataatttatgttatcatccctttcctggctctcccttgggtgcccaaagctgttcaaaactgagtgctggagactgaaagtaaaggtcaaaaggaaaagtctgaacttcagggtagatctgaccagaaaataaaggctgtctttctaccttgcacagcagaggaaccttctttacctatcatccaatcatgttagttgtttgagctgaagctctgtaaagaaatcaccttcatccacagaaactgggaattccagggtcactggcagaactgcaaaacaggattgcagcaactcagcacacacattgtaagatgatttgcttttgagaacttgttttgagcctaccacctgaccaaacagcatcaccaccattatctgtaaaatatttacatttacagggcaagaaagagttactaaaattgattgccctgtgtcagtgtggagtttacttctttgaagaataaattgaggaggctacatgattaattcaaatagttaggagtctcttttctttccacttgatcttgagacttcaatgtcactttaagtcaaattcaaagacatgttgagaaacatgagaaaatacgtttatttcatttatttttccatggtggtctcataagttattttttctaggttatgagaagataaaaaacttttaaacaaagaagccaaatttggagagaaaggagctattattgaacttgggtctatgtttctgaaaagtagcctagaattttataaaagcaaaaaacaaaaacatcatccttgtgtttatattaggaagtattttaaaacatgcaatatgtattttaaacacttttcttttgaatcttgcgttgcacccaaagaatgctaatggtaaccaaattgttctttggcagagtagcctgacccttaaaaaaaggaacagaagtgttacagcatgtgattgtagcacaagacaattatgaatcctcaaccctgagcagatattaactaatcctatgatctgaccataagaggttaccttggagcattcctctacattgcattatgtatattacatggtaatgaatgwcagttttcatggctcctaataatgagcwgcttctctttatttagagaacaaaatagggggtttacagataatatctgagtttatcattgagctgctcagcctcctcttctatgtgcctcagcttgtctcaatcagtgctggttatctcagcaataaagcattcagcctctagaagttggtttcttcctacaccctataaacaagaggatgaatatcttgttacatgtgctaaaatgagttgggtgaaatgagcattactctgctccctgtcactagctataatcagcttttcaaatctatactgagtgtgtccccacacatagcacactaaggaataaggatgttcgtgacaatatattcctgagaagcagcagttctaacatcccagtgacagctattcattccagtttctttgtgcagagacattgtcccaactccttcaccatgtgctaacaattagataatgactccataaatgtagagaaaaagcagtgtcatggacggtgggtrgtttgttttcttagttctttattgaaaacatatggagatgtttatatataaatagaaaacaataaaacgctgccatcatgtaagcagcaacttaaaaagttctacacgaatagaaatcaaacatttctatacctatgccagaattctggtttactgatatctacacatcctgtcttatttggcttgaaaagatgttttattattttaggctttttatttatagttggaagcaaattgtggagcaagagatttttgtttttgttttcatttctttcttggcttaaacaaattacttttttagcaggaacaacaacttctgtccaagtataccttgtgttatgatcatgaaaaaaagtttttaatgtatacatttaactacggtctttgtatttctgaattaaaagtgaggacttgtggcctgacagaagtgactttcaggagacccagcagtggagaggttgagagcactgcttaggaggtagaagcaattcctctgggttggaattctggctgcaccacttaactagctaggtaaccgtgggaaagttagtcaacctgactaaacctcagttacttcatctgtcagatgagaaatataagagcacttaaagaatgatcatgcacactcatgggatgagctgtaagacgttacacatagtgtctggctcgtaggaaacatcacagaaatgctgcctagcatcgttgtaatcagctaacagaagggcttatattgagaccatccttgaaaatctgagaagtgttgatgctcagtgccaagaacagtaacaacagtaatgctactgtttaccaagtgctagttatgccctagcctttacaatgtactgtttttgacaattccatgagctgggtaccattatcatccccattacagctaaagattggttgatgtgagggtcaaacccagtctggatcattcagaagcccacactcttgatctctctgctaaaatggctgccacatatatagcctagggcacctttgaaaccttctttatttacactattctctatgttcctgtcaacatcctgtgacattgcacaatggcattcacaaactgtgaagtcccctgtccctaggacatctgttcatttgtagttaaagaggaccaggaaacacttaatgaacacattattagaagccctggttttcaattcatgcaaccatttttgctttggtttaaaggccttttctttaaaggtgcttgaagcttcatatggacaggctcattattcaagcttttgtcccaacctacagatgcagaagccaaggaccaaagtaacatgacttggggacagagggagaggccattcacctgccttggtagcccagtgtatcagttgctgaatcaggaatacaacagactgagcccagggcagtgtccaactcatcaggctgctcattaatgttgggtctaacagccaaactgctaactagctccactttttaaaaacttctattttaagttcaggggtacatgtgcaggtttgttacatagggaaacttgcctcctgagagtttgttgtacagattattttctctcccaggtgttaagcctagtacccattagttatttttcctgatcttctccctccttccaccatccaccctctggtaggttccagtgtgtgttgttcctctctatctgtccatgtgttctcaccatttaactcccacttataagtgagaacatgtggtatttggttttccatttctgacttagtttgctaaggataatggcctccagctccatccatgtccctgcaaaggacatgatctcattatttttgtggttgcatagtatttcctggtatatatgtaccacatttcctttatccagtctatcactgatgagcatttaggttgattccatgtctctgttattgtgaatagtgctgcagtaaacatacacatgcatgtgtctttataatatagaatgatttctatttccccttaactggtatatacccagtaatgggcttgctgggttgaatggtaattctgtctctaggtctttgaggagtcgccacactgctttccacaatggttgaactaatttacactcccatcaacattgtataagtgttcccttttctcctcaacctcaccagcatgtactttttttagtttttaatagttgccattctgactggtgtgagatggtatctcattgtggttttgatttgcatttctctaatggtcagtaatattgagctttttttcatatgcttgttggccacacgtatgtcttcttttgagaagcctctgttcatgtcctttgcccactttttaatggggttgtttttctcttgtaaatttgtttaagttccttatagatgctgtatattagacctttgtcagatgcatagcttgcaaaacttttctcctgttctgcaggttgtctgtttactctgttgatagtttcttttgctgtacagaaactcttaattaggttccatctgtcaacttttgcttttgttgcgattgcttttggcatctttgtcatgaaaactttgctagttcctatgtccagaatggtatgcctaggttgtcttctgggtttttatagttttgggcttcacatttaagtctttaatcaatctttagttgatttttgtatggtgtaaagaaggggtcaagtttcaacttctgcatgtggctagtcagttatcccatcatcctttattaaatggggaaccgtttccccattgctttttttttgtcagctttgtcaaagatcagatatttgtaggtgttcagccttatttctgggctccctactctgttccattggtcttgtgtctatttttgtaccaataccatgctgttttgattaccrtaatcctgtagtataatttgaagttgggtaacgtgatgcctccagctttgttcttcttgcttaggattgccttggctatttgggctattttggggttccatatgaatttaaaatagtttttctagttctgtgaagaatgtcattggtagtttaataggaagagcattgaatctgtaaattgctttgggcagtatgaccattttaatgatattgattcttcctatcatgtagctccaattttaacctacacagtacatgactagaagcactttgcctgattttcttgttggaagaatgggatctgcctgcaatatggaaaccctcacaaacaagatgactcrattctgttttcatttgcaagatatattgtgaatgttcttttctcctttttgcaggagagggaaagggtttagggttgtgggtgtggcagggcatagaagggaagaggcttaggactgccaaattacatgtcaacctgctgacttagcatcagtgtactagttaaatgagccctgaatgtaagacattaatgcaaatattttgcatattattaactctaatgatgctaccataatgcagtatcctcagctgaaagctgaggtggcattttttattataaatgccctgggtctttcactgaaaatcaccatgaagacaagtcccttagaagtgagagcagaaatatgaacagagttctgcatcgttaaccttctcatcattaacaataacaaaaaatattggtgtcccagggccctgcattcagtaaatgccggcaacatctttctttagaaactatcactgctcttgcccttataactacaatatacttccaaagcaaaaggttaggcaatcattgtaaaatggaatctgttttagaaaaaaatactatgcaatccccaaattgttatgtaggtggaaaatcattctaaatgcagaacaagtattgcttaccctccagtgccatgctagtgatggtagtgtggagtcttggaaagcagagggtttcagagccagcgctaccatttgccagctgtatgacattgagcaaatcgcttgacctccctgattgtcagatcctttcctataaaacagcaacattaataatactgctttgtctattttatgagttgccaaagaacaccaaaggagattgcaaatgtgaaagctctctggacgcaatgtacaaatgttattattgattttttactaggtgagtaatgaggaatgagtagcagtgtttgtccaaggatagcttgggaataagtcaaccaaggtggcagttggtaggtcttgaagatgtggttggctcctgggaaacagatgagctggccagtttgaaggatcttaaagttgcaagttttcgggctgggtagcaatttaactgtgcaacctgtcaagagcctrttatattctaaatttgtgccgtgacaatattggctacatgaaataactgtgtgctttcttaccagactttatttggaaagagtttatgaactagtggcctggcagcgttgcctggaattaacagtgctgtggttttacaccagggagagaagtgtttcatgccttgttctattacctccctccctggagattcaacagatggaacaacaacaaaatcagaaccccaagacaaacctgtcagcttgatgcctttaagcttcggcagaactcacaattaagataagatagaatatccatttagaggaaagaggtgcaaagaaataagttcacagagcataccttcttttgtctgagcatggctaatactatctggagatccctgccacataggaggaattgtatactggaacacagtgaacacttaagaaaattagttgaaagaatattattgctagtagaaataactgaacatctttaatatggggctttatatttcccttcattatatttttttaatcctttcaagccaactcttgagtttggcaaatcctaggctgagtaattgtgcatctcagaatggttagataatatgcagagcagaccttaagtcaggcacagcaacatgtgttttggcacagccgtaaggaggtaaagtatttggtaattgttgtttgatagttcccaaggagaaagcactgaagcaacagataagaaccaaacaattttctcttgtgtttaggtaaatatttccaactacagtctggtgatggagtctgacgcaggaaccttcttacccactgggctgcaattcactggcagtgaaaaggccagggccatcatggaggaggttatgagcctgctgcagcccctcaatatcactcaggtcctgagccatggagaagggacagacatcaacttttggatccaagctggagtgcctggtaagaccaaaagatgaagttgtgttccytatatattgccaacaatttaaaataaaatttctgttttaatagagcacaatgaatactagyaggccaggttgtccacggaaaccttaagcttttgttcaaggtataatctgatgatttcyaaaactgggataatagtcctcaccttgtatttgtttacccatctgtatccctccactctttctaaattataagctcctcactcccagagattctgatttagtcattctggaattgggcctaaaaatccattgttttgttttgttttttaaggaggtatctttggtgattatagcacaaatgatctcataaccaaaatttgagaaatagagtagaaggcaaatattactactaatatccttctagttctagtcctgtgctagaaaaacttccttgatccaaataattccctattaaaacactgtggtatctgaaattttaccattagagatagattccttgagggtggggtactttcttttaatcatgttttaccttaatgcaaagactcctgtgcaagaggttgagcataaactaatttaccctgggcagtgatttatcatgtgaatatcctgaagagaagtcctaagtccctggggttcagggatgaaattatgaaatgggagcggacatgaggaggttacttacagaaatacaagctggaacagctggaacagtcttttttttttttttttttttttttttttagacagggtctcactctgtcacctgggctggagtgcagtgacatgatcacagctcactgtaacctccacctcctggccttaagcaatcttcctgtctcagcctcccgagtagctgggattatgagtgtgcaccaccatgcctggctaacttttgtattttttayagagacagagtttcgccatgttgcccaggctggtctccaactcctgggctcaagtgatctgcctgccttggcttcccaaaatgctgggattataggcatgagcgaccatgcctggcctctagaacagtcttaaagaagacaaatgtatactacttcacaaagttacctaagcctggccattgaaaaagtttactgatattgtttgtgacccgaggttgcttcctcaacaccattatatccataatccaaaaaagttaaaggatccatctgcaaattgttctgtatttgtactatacacataggatgcctaacatttgaacagttttaacattgctgtattcagaaatatttctgtggctacaaacatttcagaggtactaaaacagtgtctctggacctactccactccagatttttttttccaggctgcaaagtagattttaccaatagtaacatactacatagatttaagatttttaaaaagcttattcttgcaatactgcagatttttaaggcatattttaagttttaaggtttataataatctttcataactaaaaataaaaggagcttttctgtactctaatagaaagaccaaaattattttcctttgttctttgttctgtgtatgttaacatattttgaaatctcttaaagcaacatttccatttacaatgctgtacttctctggacagatccaatactatctacatatgtgtcattgataaacatgatctaagtgtaggggagagagtctgccctttaaattatatagaatcatttgtatgaaattctagattttttctgagcctgaaatatttcaacaagaacttcttaaaaattgagaaaccctgaataagctgctgtgtggtagctgtgaggaaaagmctggtagactgtgggtgaatgagagtgcagacggggggtggttcaaggtgaggtaaggagctgaaacctaagacagaattgggaacaaaaacttgtccctccccatcccaggtatttcttttttgttgtgtttgatcattgagacttggctctagcttttttccttcacatgtacgtgttgtataagaatggttctgtttggagtgatcaggttaatttgattcttttcacctaaaataagaaagcattttctgtctttgccatggtttaagatgaggtcagatttgatttctacctaatagaatggagtggggagactgagcccattatggttgtataagaattaataagaggccgggtgcagtggctcatgcctgtaatcccagcattttgggaggccgaggtgggtaaatcacttgaagtcaggggttcgagaccagcctgaccaacatggtgaaaccccagctctactaaaaaaatacaaagttagccggatgtggtggtgcaagcctgtaatcccagctaactgggaggctgaggcaggagaattgcttgaacccaggaggcggcagttgcagtgagctgagatcatgccactgcactccagcctgagctacaagagtgaaactccatctgaaaacaaacaaacaaacaaaaaagaattaataagagttaaaatgtgttgaactcctaatgtgtaggaagtacctaggctttttgcagacactgttttatccatacarccatcctatgaaggaggtacaattatcatratccctattttgcagatgaagaaacagactcataagggttaaatgacttgcccaagactatactgcccttagggcaggagtcaccctgagaasaggccattttggcttcaaggctggtggcccttttctcacaatatgcaacaacactgaggggtctggaatgctgagaagcctccaaatctccggcagtgtctaaaatgtttatcttactcagctcttgcttatgcaaaggatttcagtccattcctgctccacagtgatttacccctgggagaaaggagtttgttattgtaaataactacttatatcttctcacattctttgttctactcccttctttaactctgaaagatcagaaaggtttacataaagtcagtagctcatttagatgactctaaatgtttccttgaatgctrttttatttcctttagagcattagaagacagaaccaaattactgctgtcttccttttattacttttgagttatcctttgatatttcaaatttgggctattcctggaagaaacaatggtactggttataactcttgtcacctattgaaaatttcaggtacctcactgtgtgcagtggcttacccctgtaatcccagcactttgggaggctgcaaggtgggagaattgcttgaggccaggagtttaagaycagcctgggcaacacagcaagacccccatctgtctctmaaaaaaaaaaaaaaagaaaaggatgaagaaccatatttgggttcttcatcttttttctaaaagatgaaaatgaatttgtctgaaaaagaaaaaagtaaaaatatatcagttgtgtaccctatatttgtgaaggcctgacaaattatagcttaaagctaagggtaggattctaaatactaattaagttatcatttaaataactgctcacctaacttctaaaaaattaatgctaaataatatttctaaactccatccttttttctttctttttttctttcacggattcaataaacatttattgagtccctaccatgttctaggcctattaaatttctataatttgaggtgactgtatgatgactagaccccaatattccatgtatactatttaccaaaatactgatagaactgtatatctatcacacagatagaattaaaattcaacattgctttcattaattatagaagacaaaaggatcaatttataatacggccatctttgggagagaaaagatgatatcctttacccatctagatgatatctataatggacagaataactgtcaacattaatataaggctttggggaaaaaagattttctttaaaagtatcttggatgtactttccgcataaactctttgttctagatcttcagattccagccttctcccatgtccacctccttccatattcctattctttctctctaaatcctcagtgctctttaaggctcattctgtattcactggtgttcatgaatccttcctgagtccgtagtgctctattgcttttccaaatttctaacgcgcttcaagtctttgtcccacaacctggcatgtgaattacaaactatgatattgttcttggaacactaggggcttatgtgcatcctgctgcctatatgcagtgatcagttctttgaggttaaggtcaataatttctcattctttgcctgttccagagctgtcggtttaattttaggagacatttaaattcttataaatctgacttagcagaaacaaaaacattgaaataattattgtctagacaagcttttagatacttcagtttaagaatatgaagaaaataaaggatactaagagccaaaaatgtataaaaaatattgggagaatgatataaattgggaagcctagagcaataaggattatttctcttaaaggagcaaagactgagagaagatgtatctttcaatactttagtgattctcacacataaaatggtgaattgctcttccctgacaatttgaaagacaatacatgacttaaagtgacctaagagggatttaagctagtctctagtcactccagataatagagaggctttaaatctcaagtttttgcctgattctcctatatgagctccaggttaggatgaaaggagtctatttcattctgagtatgtcaccaatgaggtataatccatggttcttagatgtccctaagtgcatccttcttgaatatatttcttctttagaaactctttcacaaaatatacattaatgaaagaaaattaaataccctcttactgtgacctgagagaatgagcccactcttactctatatctgccaagaagagtttactcctctgcttcagaatctgaaattcaactttttgttgttgttgtttttagtgtggtggcttgtggtagacggtgtattgcaaggagttagaggacttgagtgtatattctgacttcaaaacttctaactatgtaggcaaacagtgtaatttttctaagcctcatttatttgttattaagcatccttattaatcaactattgtatggtactggagaatcagtagtaagaaaagacagataagatccatgctctcacagacaacacagactagtaatgagacctggttatttcatctgcaaaataagtctggtaacctatgagtcrttatttctaccaggcctccacttgtgttctcctcctcctctgtcccctatctcattagcaggcactataattcagaaacctcaaaagcacccaggacataaagccaaatgtttacaagtcctgtttactccaaatccctgctatttcttaaacccattccctcctctccaccccacagaccttgtctcaccaaaactcactgattcctacagcagcctcctagtaatatcccaacctgtgtttttaatcttctttcacctaattggctcactgcttctagaatgaactttctaaagtgaaaatcagtatatcaacctggatgcttttggctgcaaaatgaaacagaagacccagtcagaatggcagtaaggggatgatgtttttaaattcgcttaaaaagaactttgcagcaggtgttacagagtgcataatttggccatttgaccacttcagggaygttggttctttacatctttccatgttgccattctcagcatgtagacttttgtcaggcctgtctctttgtggtcccaggatggctgcagttgctctaagcagcacattctcatacattgtgcagtagtggaagagagaatgtctgtaacagatatcccttttgaagagtgaggaaatgttttctagaagccctaaaacaagtttcttaaactccatattattggccaaaattgtgacatatgtctgtggctaaatcatgcagaggcgatagagtggaattacctagattggcttatactgatcaaattttacttcctaggcatagggtggggcccagtattcactgaaaaacaacttcttgagaagctgtttgagaaaaattgggattctttagggaaaagatgatgatatctattgggtaaataattaaaagtagctgcaatatctgatcatccctgctccttgcttccaatcctccagcatctccctgctgtctccagagtatgtatgaataaagtgttcaccaagtatggcattcaaggccccaaatctcagaaatcaccgctaaataacttactcatgtaaccaaacaccacctgttcctcaataacgtatggaaacaaacaaatgaaaacggtaatttaaaaaaaagaaatcggggcatccaaatcggtaaagaggaagtcaaactgtcgctgtttgctgatgatatgaccgtatacctagaaaaccctaaagactcctccactcctttctatccatctctcagtcatacaagtctaattgaagttccaggcacaccctgctgctctcatacttccttgccactggacctgccctattctgtctttttcaccagttaatttctactcactcatgatgcagctccttgttctcctccttctcaaaccttctgcaatctgctacagtctgagtaaatgtcccctgggtacactcgtacaatgccctgtgttcacctctcctcttagtacttatcttgttctcctaattgtgatcaattgtgaattcctcagaattctcagtgcctacaagtgcctggccctcgacaaaatgtccatgactcaaatgctgaataagcaggatccatgtctgtaggaagagtaagataatgccaatgaggtttattaactataatgcaagacacaactgtaagttatgattamtttagtaacgacatcactcattgagctgtcctctttcattgcatattgtgttgttttaaaaatcatattttagtttatgtcatcttttctataatagttcagactccacgttgaagtaccaaatacacagattactcagaatttcacgtattttccatcttgcttatttctgcccaatacctcatatggcattaagmagaactaaattaaaactttccatttctacatttgcaaaggcctttcctctaaaatgttctaagaaaggagacctcaggacacaagtagaaatggtactgtaaagtaaattgaaggttcagcctctggacccaggactcctgcgttttccaatcaccagatggaatagcgcagcccagcggctctatatcccctgttgtccctaatttaatggtgcctcccttatggtgaaaacactgtrcagtgatgtttgaagggattgatgctccatggtaagcagacttcgccctactgggaacatgaaaaggaacctctctgatttgtggctgtaaycctcaagccctcgtttaaatagccagggcagtttcatttaatcaacaagcatgtgttgagtgcctgctgtaaaccaaacgctgagacactgaggagagaggatgaaaaagactcaacaggtctctgatcttgtggagyttacattgtgatggaggggtgggacactgggaagatacagactataactaagaaatagattaagaatagagaaaaacagtagacattgataaaggctatacagagaattatagtaggtggttacctcttacctctttaattcagatgagtcaaagctcttgctattcactgactgctatttgcttgacagcagtgtatgacatcctcatcaatattgcattcctggaaattgttcatcagaacatcttataagcttcttctgctcttccctcttgcagtagatctgcttcagctcaaacagaaaccactgggtatcttgcccaaagcagacctggctcatgccttctaggataattaccaagtaggagaagagcaaattgttataccattgggcagttagtcatgcactgctttatgaagtctcttctattgttgccttgaactgttttttaaagcacacactttaactttaaagttaatatactttgtactttatctccttaactggattgaggatgaagagactattttcttcttgttcatatacccacgacacccattattacttggcatataaaatgtatccagtaaatgtttactgattagatgtattgatttaaagatgaaaataagctaaggaacaataaaaggaagtttttggtatagtaccaagataaataacacatgcagaataactgcaggggcacataggtcagaagacaagaaagacgtggaagagaggagcttgagctggacattgaaagatatgtagtataagaatggacaggccaggcacggtggcccacgcctgtaatcycaggactttgggaggctaaggcaggcagatcacctgaggtcaggagttcaagaccagcctgaccaacatggtgaaaccccctctctactaaaaatacaaaattagccagatgtagtagcgggtgcctgtaatcctagctacccgggaggctgaggcaggagaatygcttgaatccgggaggcagaggttgcagtgagccaagattgtgccactgcactacagcctgggtgacaagagtgagactctgtctcaaaaaaaagaatggacagaagagggtagagaaggacattcctgatgagataataatatgaaaaaggcaggtgtccctgtggggccggaaaggaaagtgacaccactttcctaattcatcttgcagggcagtgggcaatgagaataggtgagtacctctaggccagatgaaaaagagtcataaatgtcaggtgaaaactctcatagctgatgcgaagataccggaacgctttacaaggagagggattaatcaaagcagtgttttagaatgtaaatccctaaagcttgtgcatgcctagagcatccaggtcacactcaagtagaaggctcaaagtaagaasacttaaagggaacgaggagcttgaggaagtagcaaagggttgaaaacaattgctttagaaaatcagataatgacattatgatgttgctccattgtatgtactataatgacccataaaacactattacttaagtctctgtaccattttccgtgccttctaatgacatagcctagaaaagttttccttttctatcttccccttttagggtctcaagattagctcttctgagttccccttcttatccataggactttccatccatttcactttacaagttctctaatttatttcttatgttacactttaatcaatgggtagctacagtgtatataaattatggaggatacaaaaatgagatatggacccttctctcctggagctcacaattgaaaactgattttggttagcttaataatcgtgaagataagaataaagacttcatcacagaaaactaaataaagctacattaaaatttctaagaaaaatatctaaaattacttgaaaagccagtggagtataaagaagaaggatttcaaaatatgttttctccttgtcagccatgtgagatttttctctctctgctttaaataattaggaaatgtagaatttattttgacttgttttaatatatgaagtgattttaaagtgtgattttttaaaaatgctattaccaaaactttcaaatgtatacaaaactaaaataatatcatgaacccccatgcacccaccactcagcttaaggagtttttcactcatggtcagtcctatttcagccacacagcagctactctcctacacccagtttattttgaagcagatctccaaaatcacatcatttcatttataaatattttaatttgtatttctaaaaggtaaggacttggttttatttgtttttgtttttgttgtttgtttgtttgttttttgttttttgagatggaatcttgctctgttgctcaggctggagtgcagtagcacgatctcagctcactgcaacctccgcctcccgggttcaagtgatcctcctgcctcagcctcctgagtacgtgggattacaggcacacaccaccatgccaggctaatttttgtatttttagtagagatggggttttaccatgttggtcaggctggtctcgaacacctgacgtcgtgatcctcctgcctcagcctcccaaagtgctgggattacagtcatgagccactgagccctgccaaggactcatttttatttatataactacaatactattattctacctaaaatattttacagtgatttcttaatatcatatccaatatatggccagttttcaaatattcccaattgtcttcatacttctttaaaaatagttttctaatgtaaaccaggattccaataaggttcaaacaatgcagttggctgatatatcccaagtttcttgtaatctgtaggttctacttccatcttttttcttcttaccacttatgtgttacagatgccaagtatttgtcctaactccatttccacggcatcatttgtcatgttcccctatcccttgtatttcctgtggattgagttaaatctagaggcttgccctaagtttgattttttttagcgggggagagggagtgggctaaaatgctttctagatgttgctgcttgttttcataggcataatgtctaattatctccctttttatgacattagcagcctagatacatttgaagttgacccttgaacaacagggagtttaggggtgctgagccctgcacacaaaaatctgcatataacttttgactccccaaaaacttaactactaatgagctactgttgatcagaagtctttatgataacatagtcaattaacacatattttgtaaatgtattatatactgtattcttataataaagtaagctagagaagagaaaactgttaagaaaagcataaggaagagatacatttatagtaccgtactctatttatcaataccatctgtttacaagatgaattttctgaaatggcaaccacggtggcacacctcaatctgtggtacatatcaagcaattcaactttttcttgtaaagtcacgacttttccctgcttcttgggagcacttccaacatcactagttgcacattgtatgagtcctatggtgttagtcaaggtctacagtattacactaaatgtgatgaaaagtatgtgagagccatcacttcttcctgtgatatgcaatttactggagagatgaactgctcacatagaggtgattagcatccgcagcattttaccagatactggcaacacttgagctcaccacaatagcaacaggaggtagctatgaaattactacagtagtacagtatgtactacagataatgttctgcagttatgatttaatactacatctttacatttgtttacatttctctcatctgcaaagggagccatgtacaatctgtgtttatgtgcatatgttttgacaaattttaactttttataatagatctgtgtatactttgtggtagtaaatgctaaaataaactagcatccacatatatttatgcattcataacatacctttttcttaattattttgatatttccagactatgtggttcattgtagaatttttttaaattgtcacaaatctccaaaaaatttgtggaaaaaaatatttgaaaaagtggatccacacacttcaaactcatgttgttcaaaggccaactagatttaatttcagtatattctgaatggtacagtctaatcatgtaattccttctttattaatttaaataaatctatgcaaacagaactttccccttatcagctattcagttactctgagatacttttgtataagaaggtaggataaatgcctcattctttctctttatttacctatttttaaaccatcagtttgtttactagtatcacccaaagatgatttatttattttttgtgtcattattaactgatggatttaaaaatatttgatgtgtttcattccattgtagtagctattttattgatgctcaaattgtcccatctttggccaattgaaacatctttaaactggttctgagtccttttgacatgaccctcatagttgttgatatcatcctggctttctgataggacaaattgtttcaggctatcttgtacatgtcctgccctagatctgaaatcagctatctcttcaaagaatccaatttattttcctaggtcatagtatttagaggccacagtctgaacagtaagtgtrtgtrttgctactggattgttcattgtttctaggtcttttcagcagacaggactaggaaacactttttttctccaacatgaaattatattactaattatatgatatttccaatttaagttgaggactataaaattgcactttacctcactgatgttacatctgcattttctttttcccctgcctacaatcctggctctcagtggaacaacataatcactcatttgctttatcccacaatacacacccagtagtctcagaaaaacagtatcaacacgatcaccaacagtataactattgaaaagagttttctgtagttctttttgtttttagtatgtatattctactagagatgtacaaatttctgttaacctatgatgcatattactctaaatatgatatcatttccatttctctcyctctctctctctctctctctctctctctctctctctccctctctccttttttagagatgggatctcacccaggctggagtgcaaaagtacattcatagctcactgcaacctcaaactcctgtgctcaagcaatcttcccacctcagcctcccgagtagctaggactacaggctggcgccatkgtgcccagctaatttttttaaaatttttatttttagagatgaggtctcactatgttgcttaggctggtcttgaattcctgggctcaagcagtcctcccacctcggctgcccaaagtgctgagattataggcaggagccactgcacctggccatttttattatttttgttttaaaacctccactattgatttctaaaatgtttaaatgcttattttctaatttttctttataatgtggggaagagaatatgagtaggaatcattatatgatttatgaattaccttggagtgtcatagttagatcctcaggatactattgcctgttctttcttcttagacctgactcaatttcacaatttcattcactcattcatttaagaaacccaagtaaatgctatgaagcaattggaaaagaggcttaaggagagaatttaacatatatttgttgtttactatgtgtcaaaattatgatagatgctttacttatctcataatttcataagaacattttgaagtataaattattattatgtgaccaattttcaaatgaggcagttgggaatcagggagtttcctttgcccaaagtcataaagatattaagtagagaagctagaattaacatatacagtctgttttactcccgtgtcacatataagatgcagtccctgtccttaaggagttaatggagggttgagacccaagaagaacagagtacaataggagttcaggccaaaagaaaggtattaaactgccggggcctcacaaagaggtggcatttcacctgattatcaggaaataataaaatgtgctggatgtagagggaatgcatcccatgtcaaaaattggagatgagcaacattctgtaggtaagaaaatgtgaggggtatttaaaatgataaccagtcgggttggaccaaagtttagttaatatagggaaatagaaaactaaaagcgttgcctggaatctcagttgggatctgaaggtcattctgaggattcaggacagctagaaacttttgaaggtttgagcaggagtgaaatatgctagggcacaatcctagccactgggcaggctccggctaacccagatccttctccttggaaggactccagacaaaacccaccctcatagatccacaagtcttgctgattgactgcatgtcttctagcaatttcctagaaaagttgcattttcttcgatgttttgctactggaagttttgccaaattaagtcttccagttgaagagagatggagtagccccacatagcattgcattgcgattggcagtggttttctgaagtctcagatgtgagcaaataaagtctgactctaattagacatacttaatctgctcgttgaaacttggagtcaaataagtcttagagtgacatttcagtcttagagtracatttcactgatttcttataagagctttgctaaaaaatatgcttatcaatttaatcaattataggattctagaaatcacaggaaaaacatcacaattaaagagattttggtaaaactgagttaaaattgggtaggacttkttactataaaaataagttatatctaatgttatacaataaactgcctagtttggataatttcattagcttaaactcttccctttgctcagtattaaagttcagaagtkgccacctaacctaacattcttacatatccccctcatggggacttttaacacagtgaattaagtgtcccctttattccatttttttataagaatgtatgagattgcataattcatgataactaaacttacttttaaaatatgacatttgctgtcttaattctttccagttcataatctataaatcaaatatggtcgagctctgtgaaatctattagttatgcatcttttgagacctgagtgatccgttgcctatcataggacgagatatgaagtgtgtcctcagtattcttagtacccacccttctttccttccttccttccttctttccttccttccttccttctatacatgtattttttgtaatagcttgaatagtttactgtcatgtaagagaatagtatcttatgtagaaacatagcgtggacttcaccaatactcatttttggaagtttaaacctaagagaaaaatgtttgctggatacatctttataaaatctacatttttacagaaatagttcattgattattataaatatcatgtttgaaaaacttttaaaaatgaagttacacacagatattgtttaatacctttagcactatactgygaagtgcactgcagaaataaagccattgtttatttagatgggtcagtgattccagactcactactcctcacacaagattttatctgagataccctgatcattgtagtcatttggcttgtgagcttcagttgcccccccatacgcttaaatttttcattttgtgctagtgtagaccaagtcaaagcccacataaacccaatatatgtgttaaggttagagttgtgcttcacactcttgactgtactttaaaatcacctggggagcttttaaaattatctcagtgctggggccccactcccagagagtcagagctaattggtcaggctgcaaggccacaacagttgcacaaatgcaggtggcacctcttaccaagaacctcttcatctccctggccttccaacttcctggagcacaactccactgttttccatgtgaatagcacccctgtacttgtgcaaacttggaagccctagcgatagtggctgagcacccatgttttcagaaggcccccaggtgttctaatatgcagccagaattgagaaccactgacatataactttgacattaggtgtatggattaaggagctgtgtagaaatagattcaagatctagctctactactttttagctgtgtgaccttaggaaagtcatttcactccttggaacctcaatttcttcctaaataaaatagtaatactaatacctacctcatgagattatataaaagaaaaataagatggtcaaagtgaaatgcttggcacaaagttaacacttaataagccacttttattattttagctattaaagcaagatttctatattagtctagattcctacagtactaagttacagaggtctatctcagatgatctgaarcaaaaatggggaaattaagcaagccacggaaggatagagtttgatttggcctcagattttggcatttgaatgctgttaggacacatattctctctctctttctctctctggggcttattccagcttctcttttcatggtgcttgcattctctcagcccaacttccccccttggggtaaaccatgaccatgggcagctcaagacatatcttttcagcctctttagcacagaacaggcaaaaaattcatcctatctgacccggttggaaaagttacagtgacccagcctggctccatccctgtggtcaagagctgtagtcattaaaacggggagaaggagtgctgtgcaggtaaatacaataaccagctttgtttcattgttgagacctgattcaaaataaataaaatacataaaactcctgccattctaggatctattggcagacaaggaaagtcagcagtaagatcccaagagcaagaacttccctgaaattaaaacacctagtctctccactctccatgatctatgcacaataatcaccccttaaggtgaatttaagatcacagaagtgtgccttatcccctctggtccagtttayttgagacgctcaaactcacaggcaaatgaggagttgaatcacttcataccaagctcccagcaatctgcattattgaatacctgaagtgttctgtcctcccactcccaccccatggtatttccttacccatacaagtgagaagactaggcagagttatttatttatgtaagtgttatttataggaacactctctacagctactctaacgtgtatgttatccaagaataaggcaatgaggtaaaacaaccacaaaaggcccagaaacatcctttaacatttggattgttctaaccacttacctgacacttgtggtggagaggcaacaagtgtcatgaaagagcaacaagattcatcacttatagcagtgtgcttttgacaagttacttaacttcctggagcttcagtttcctgatctgtaaaatgagggcaataatatttcaaaggactattgtgagaattgaatgtatttgataagtgataatgtatttgaatgtcaattacactctgtacagttgacattaaataagtggttttccaaggggggtgaataattttatatttaaagcattattgaaaaagctttgctatgaacatgttctcatgtatttggacccagtagagaggatgactgggcatgtactcgactatcctaagaaacattgcaaaagaggcacaagtactattggtactcaccagccattgggttcttagcatacttactttgtggttacaaaaaagagtgatggagctactagcatacactataaccaccctgctactatactggttcagtgtccttgtttaggaaagcagcctgactcatttcactgtaacatggtacaacactgcagagaataatgccaagaagaaaaatgtcaaatattaataacattactagctcttctatttcaaagaatgcctctagggattttgaggtctctttatagttcctattcagccaaagtaaattgattgattataggtgataagagtcggtggaggattatatgagtgaatgtataaaagcacctggccaaaggcacagaatagcacttggactgactctcacaggcgayatcaagttctagtttgtctgctatggactgactgggtattcttcactgtaaaggagcctcatccctaatggtgatgtgaagatagtatgtatcccaaaatatacatagggtatgcattttctgtgacctggaaatgggacaagtacctctgtaagcctcacttattttattttttttcacactgccatgagaaagtaaatgtaagcctcttttagcattaaaactctataacccaaaccccacatttttccagaagtgaaaattgcttacaatgtaaaagatgaacattttgaatgaaggagcagtctactcataaacttttaggagcaagagatgaaatagcacaaaactgcctatatcaaagaaacacgaataaagttcagacgtggattttaagttgttcaaaagattggtacttcaacctactaaaatactggggacaaactgatgagaatatcttggaagtgaaggaacatatttccttaattttcaacatgtagtcttggaaccagttttatttcaaattttttctaatataaatatataaatatctgatttatacagtttatgtatcccgtggcaatgtgatcttttgcttcttttattttcttcctacccctcccccatctttttcttgagggaatcaggaaaaggtgtcctatttctcaactgttgaatctatttatgaaaattagaactaaacagtttagcacaattaagcagaatgccacattcatcaaatcttcatttttctaagacttcaattctgtcagtcactagaaagcatgtgctaagtggaagctgtgtttccggtcttttggcatcccacatctgttgacaattacagaggcacatacagtgccattcatagaatggcatgtgtctccctatgccttggttcacaggccctcrgggacatttacaaagtgtgtactttttaactgtcctagaactaaggagtttaattttgcctgagaatgtgtttatgtgccttgtaaaggagctagtcattcccttttgctttcctttattatgatgtgtgtatactctgtgtgtgtgtgtgtgtgtgtgtgtstctctgtgtgtatgtacaccaaagaagaaccacaccaggaattgagcataaaggctttctcttacccatctacacacctttcttgtaagttgctgcttttattttttatttattcttttgttaatagtgtatttcttggcttctgctggattttttttctgtttctaaacactatttagttctgatttcatatccttatgttcttcagtcaagactggggtcagacttctttatattatatatgtaattattacaataaaagtcaccatgtgtggtggcccacacctgtaataccagcaatttgagaggctgatgagggaagattgcctgagcctaggagttcaagaccagcctgggcaacatagcaagaccctgtctctacataaaatttaaaaattagccaggcgcagtggtgcattcctgtagttctaactacttgggaggctgagggaggaggatcacttgatcccagaaggtggaggctacagtgagccatgatcatgccactgcactccagcctggatgacaaagtgaaaccctggctctaaaaaaaaaaaaccaaaaacaagtccctggaccctctctggagctatgccctctttcttttggatctcttcctgacccataagcaaaccatattcttcaggaagtatctagtacctagaaaactgaagctgaatctacatgtcatctatccaggaacttcatctcgctagtcttaacacctcagatatttggcaatacccagaatattgaccatttttcctattttcatccaaatatttaatattgggtatgcatgaccatagtaacattaatttttttcatttaaaagataggtactgcctttggacattgtaagcatctcttgttaataccatgaatagttaaataaattctagtataggagccacctagaggagttgtttaacggctgaaagaagaattaggtgaaaaagaagttgagactgaggctaaagccaattgtggtttcatccacagtggttaatggtgtttcttaatctttaaatatcaaatgtgttgtaatgcttaattatccttaatacataaaggaagtgacctacaaattctttactgtttattgaaaagtagcatatttggaggctttgacaattctacagaagagaggaagctgttaaattctaggctaccatgtccttcaaatgggaaaaaacaaaatgcctgagcatgtctcttctccagcattaaatttttcatcagtttcctattaaactcaaggatatgggaagggagcaattttaattgcttggcacttaaaaagcctcctccactgttcaatgagttagaaatattttgaaaatttgattgcatttagaaccacacaaatttacctgtaataaaatttttgctgcacgcttaaataatgtcttctagaaatgaacatttaaatgaactatagaatgctcagggggtaaagggaagctaatatttattgaagaccataaggtgccaaatacagtatattcattattttatttgctcttcttaacatccatgtgaatgggtattgctgtttctgttttacgaataagaattggggctaaaaccagctgagggggttacctaaatggtacaaggtgcagggcagatctgaaatctgctctgtttgattgcagagtctgttttccttctctgttgtctttacattctcaggattatgttgaaaacagcaaagagtgccatcttattagctcatataggctttacagtcagtgyagcctgattcaccaaagctacacacccaccctcacacacagaaaaccacttgggggctgacttacctggatttgtgtctaaattatcccatatatcaaataatactagatctcctcttcagtttctgctttgtagttagcttaaaatatctcaaaactcacattgtcccagaggaataccaagaatgtcatcttacgttaagtaagtatgtactgtactgtctcatattaattaaatttatggtacctaaatcaagaatccttcagattggcttttgaagtgcactctatctctgccatgggaagagcccattttgaggttttcctacacaaaagaaaagaaagccacctccaggtatccttagggtcctttcaactgatccccaaacagaggaatctagtttcaatggaagtttttaataaacctcattatttgacaattagtcaagtgtctggcattccttctttctttatttttccacttctgcttatgctttcaggctcctttgatgttgtttgcccctccggtggtggtaaatgaccacaatggctaataggctggcttccacaggtgcctgttaacaaccacttcataaatattcaacaggagcattctgtgcgaaagactggggaattaggtgacctgccaaatctttccacatccaatatctatgataatggatacacaaattacgcgggacagaaggaatggccttgcactgtgaaaaaccgaaggggaatcaatacagcctgtggctcccagctcaggcaggcagcctcgcccagtatacttctcccaggtgccgacttggggggtcaagggctttcccctctgcctaatgagcagttcttccatagcaagtcatcaccaccccagagtggtgggctcttatctgtattttaattttttgttataatggtaattagcattacatcttgaatagtaaattaagaaacccaaaacagaattttaaatttaaaaagcttttccattaggaatccagttgcattaattttgtggatggaaggtgagctaaattagccaagtttgtgcattcattacctcgttctaatcctcaacatcacaaatgcaaaagactgtcattagatttgagaactgacaagaactgggatttcacagtatgaatgttgaaagattaatttgaaaagatctcactaaaaaacacaaaaggttattgctaacatggaatattttatattcatagtctgtacctagttttaaaatgcctatttacagttatctggcttaaaaataaatggtacatttacagtacttgatcaaattggaatatttctaggtatcttgttttgatgatagagaagtgtaggtatccaatattatatgataatattggaaatgctttttttatcaagagatatttgactttcaattattatatccaaagagaggttaaaaataaagagaaacaagaaagagaatgggctttttcacccttttacttcatagtatgttgtcaaaaaagaaagttattcttttgcaatatttcaccctttgtgtttgccctgaaaatattaatggtgaagtagaaatcacagtgatgaaagcagtgtcatacatttcatgaaagtacagttaattttcaccaaatgagttgccaagctggtagtgggtaaaaatktaaatgttcatctttgatcaattgaattttaatgttgtgaatagctgtatgccttgatttatacatctgtagcacattttaaacatctgtgttcaagatgaccatttgggaaaagattcattggcttcacttagttcatgttgtttggttctatatactatattcaagtcccaaatgagacttttctaaaaagaaattttacacaaattgcttactttattatagactgcgcaacctagaatggcattttaaaaaccagcatgggtgatttcaccatgagttttcaaaggttatacaattgttgaagaatgaaaatgtatccgtttcaacagtgaaaatgagaataattgatatttaaatgctacagtagctgaggctaatgtttctcttaggagctctgttaccacaggaccctcactctctgtgttgtctttattagtttctaggagatttttgcatttagaacctatagcctagcttttaaaaaatgctactttaaggtcatagactggagtgtagcattatttttcatcaaacttgattaattttaaccataggtagctcaaaagaacagctcaattaaaactaccacatatacaggaagaaaagaaatagattgcctgtagcttagctctaaaataggaagtccaagctatactcgaaataacttttacaggtgacccttctatttttaagacaattataagctgggcatggtggctcatacctgtaatcccagcactttggaaggccaaggcgggtggatcacctgaggttgggagtttgagacgaacctgaccaacatggagaaaccccatctctaccaaaaatacaaaattagccaggtgtggtggcacacgcctgtagtcccagctactcaggaggctgagacaagagaatcacctgaacccgggaggcggaggttgtggtgagccgagatcgtgccattacactccagcctgggcaacaagagcaaagctcagtctcaaaaaaaaaaaaaaaagagaaaagaaaagaaaagaaaattatagtattaccatttctaaaatgtctaggcagccattgctattaagaaagttgcattgcttctatttaccttacaatgtgtttgcatctttcctaaaagcacaggcctagaagtaattccaatgatccagggggtagtccatagtctccccttcgagaccagagctacagctgcagattttgctaacatcagaatagtccgctagttcttcttcattttctattagtacaggaatccccccatgggcttaaaagcagcagctttgttataagaggatcttttaaaaaaaattactcttgagatccctttctgctggagatatatttattttgtagtcaataaaaacttacaggaccccttctgaaagttttgcttggtaactcataatttaaacatctgtcattttttcctttttaacactaccctttatgtgtattgaactcaacctaggatggggtagggagtactgatcctttctttaattttgagtggccttttggaaacacttacccctggaccagtagtattcaatgtggttaacaatctcctgtacagcttattacaagcgcaaagactcctgagcccaataccccaaaatactaatgtagtaagtgtggggtgagactcagaattttcatttttcttaagttcccctgcgggctaagaagggcatctgggaaccatcctttgaggagtaagatggtctctgagtccttgtttatctgtttacacagaaactacctattgtaaccacctaagaattatgtgatctaggcagtgttttcccaggtatactaatgttaacagttgcagaagcaaaaggataacactgaggttacttcacacgaatggatgtttgatggattctgagagttccctggagtagggagacctgggtgagttccagggccctgatgctgatgctctggcattgtgcaacttaaatgactcagttttctagtgtgtgagtggagataatcatctttccctcctacccacataattccaatgctctgacaaatgtcgaggcactacctgtaaaaataatctaatttctacatgatggtgtagttatataagtaaaagttttccagaacaaaataccaattgaaaacctagcattttttaatgttttataatttccccccattttagatgatagcttgtaaaactacttcctcacagactttccccataactttctactttacctttaacctgtgctaattcatttctataaagacattgagataccagattacatgtcatgtttctaaaccactctctaactggtgtccttggaaatttcacatttcccacactcagaacctaggagatcaaccatatttgactcaccgaaaataataaccagtctgggatatggtatgggaaaaaaattaggttaaaccacaaaactcttcccaataatgagtcagtgtgtgagtgcctctgtgtaagacctcatttaagagcagcaggagctgagtgggggacagttctcaagcggttctttggaattagcatttttgcaaggaagctttcttacccaccccaactagagaaacctctcattgttttacccacctcatcctctccaaacattatgatgcaacttcacatcataacaggatgctgcaagagtccatgcccctttaacttctgctttgtctaagaccaagaacacatctatggctggacaaattgggtttatcattcattgcagtgagggagaactcatgtcatggggacccacgatgcatctcaataaaagggtgttagaagggcttggaggaggattgagattttgtgtagaggagagtttggtaagagtccaagaaagtggcgttcgctctagactgggcgctgttgggaagtggggaccatsctatgactgtgtatcttaataaactgtgtctacagggacagaagcccagaaggagactaaagctttaattagtaaagatgcagccatcacttatatttctcagaagaggggatgtctgatattttgtggtttgccagtgactttgttttttctgggcttaaatgaaattatgaactggctagttttgactgacttcagtacrgtcacagagtgaccttgtctgttgctggcgttccatgagattagttatttgttcatgaggagaacagatggcatggtttctttaacagcactgatacctacttgtaattgtcaggccagttcccagatgtcagaggctacttcttttttagatcagatacctttgtagcataaaatcagttttagggcagtatgatttttcatggtgaacattttaggttctctttgtaggtgctggtttttaaattaatctttagttttgccattgtccatttatgatcagttgatctgatttcaaaatgcaaatccctagcatttaggaacttatacattgggaacatttagggatttaggaaaagtgggaagagtgaagaaaggtttctcccatgaagcagtgggtcagtagggaaattataaggaagaccaaagagaatgaaatggttaccaaagtgtactaatgtgagagatacaaagatggatggatadatggatggatggatggatggatggatggcagagagagagagagagaggatgaaaatgtcatgctcatctgaacctcattcttatcaccccagggaaactgcagttatcctaaatgcctctggtaccaataactgacaaaacacatgattcctaccatttagttattcgtctgtttgtatgtatgtacatacgtacatatgcattgcatctgtttgacacataatactgaaaccgtatactgctaaaattatgataaagagcagctaatgttccaataggcttttcttgcttcatagctaaggggaaaatgtatgggatgaaaactccagtagaaaactgtgtgcggcatttagttttaacacccactacctttgaaatctgtcaaaaatccattgtccgctgtggttagcctcagaatcataaggtttaaaggctataaaatgttcagtttcatataaacatagaatggattcaggatttgaggtgatgcattccttttccaataggtacttctgcataactacccagtagagaaggatcctttcacaaraggtgtgggaaaactatactacaagcctgcagtaaccaaaatggcatgttacgggtacaaaaacagacacataggccaatggaacaggttagagaagccagaaataaagccacacacctacaaccatctgatctttggcaaagccaacagtaaaaaacaatggggaaaggactcccaattcaataaatgctgctgggataactgactagccatatgcagaagattgaaactggactccttcctctcaccatacataaaaatcaacccaagattgattaaagacttaagtgtaaaacctaaaattataaaaatcctacaagaaaaccttggaaataacattctggacattggccctggcaaagacttcatgatgaagactccaaaagcaattgtaacaaaaacaaaaatcgacaagtgggacctaattaaagagtttctgcacagtaaaagaaactgtcaacagagtaaatagacaacctacagaatggaagaaaatatttgcaaactacgtatctgacaaaggtctaatatctagaatctataaggaacttaagcaattcaacaaactaaaaacaaacaatcccattaaaaagtgggcaaaagacatgaacagacacttctcaaacgaagacagacaagcagccaacaaacatatgaaaaaatgctcaacatcattaatcatcagagaaatgcaaatcaaaaccacaatgagataccgtctcacaccagtcagagtggctattactacaatgtcaaaaaataacagatgctggcaaagttgcagagaaaaaagaatacttacacactgctggtgggaatgtaaattagttcagccactgtggaaagtacttttggagatttttcaaagaacttaaaacaggacctaccacttgacccagcaaatgctgtgtgtatactcagaggaacataaattgttctaccataaagacacatgctcacatattttcatcgcagcactattcacaatagcaaaacatggaattaacccaaatgcctttcaatggtagagtggataaagaaaatacattcattacctgggtgacaaaataatttataaaccaaaccccaatgacacacaatttacccatgtaacaaacctgcayatataccccctaaaccaaaaataaaagttggatagaaaaaagaaagaggtgtgagaaaagaccccactgtgacacataagtggcatagataacagtggagattcactcacatttgwtgagtattacctagacagtggagattcactcacatttgatgcgtattacctagacaaggaggacaatggcccctcttcctttctgtattctttgtaaagggtaggccttctgagaggttaaaccaccaatcagaatttgaaatctttaaagtaatcaatttatccgctattcatttgccttctactttaaatctaaagttttgtcacagccaatatttakagtstctgacatcactgggatcagaatggaaatactaraatctgttttgtggtatcytaaattcactgaattagtatttattgtaggactcccatagggtgtgagtctttacaaataaaggtagggaatgccctttatttgtaagggcaaataagttcctccttctcttgtcaaggggatgtgaaaacctccttgcacattttttcttttctttttttctctttgcagaatgagtgttctgagaagaacaaaactcttttctgacaactcttataaaacacttttgtgtttgattctccaacgactaagatttggacacacaattctccattcatttctcaagtgtcaagaragaattgagtttaaaggctccaattcccttgcaggttacactgtctatctagatgaattagtattcagcacagctttgggaaaatctcaaatgatttgcaggtttgcaaattgttcaaactcataatgaaatttcaggctgaggaaatcactaaacagttcatggcatgagtttttccctctgagatctggacatcttagatcaattcactcctctaccttcgctgccccatccatgccagacagcccagggctgcttgagaaagtcacacacacctgtcaccactgaggttattctcctatccccatgtcctcccctgctcagcaaaccagcccactctccatccattttcattctttattttctgttcctatagcatgtgttcctcttcttatccmgggctatgttctgagtccggtccccctctatgccctcaagcaactcaaactggcaattatttatatcctattgcttcaattctctctcttctctaaacttttcccatcagaatataaatatttcaagtattcgccattaaaawatatatatatatacagctttacccaactttatgaacctccagctctttcttttctttgcagccaagctttttgtcctctcactcattcctccttccagtgcatcctgaattccacttggaactgtccaccaggattaccttcccaaggacacaaaggtcctccttttggccaaattgaactggtgcattctagtccttttcttgtttgatttttctgaagcattgacatagttgaccaccacttacatcttgaaactctgtatgtccttagcttctcttaactcctcttttcattcctttttygcttcccttccttgtgccagtcccttacgtgttagtatatgctaggatctcatccttggactctatttattcaggtcactgttcctggaagataactctatagattctcaaatctatatctacagattttggaagccatgtggccaatgttaccacttgggtatcctgtaggtatttaaattcaacatgtctgaagccaaacttctatctcacccttaccacaacccatctctaggaatagaaattatcgtccaagtcgctcaaacctgaaaacttggcattgacttagacttattttcctcattcactctccctyattcagtcaatccttaagataatgccatttctaccctttaaatgtagcctctcctttattcattgtactgctgccttagttaaggcactcaaaattcctcattactgcattgctcccagttgtcttcccaaaatgtggcttcccattctttcaaggccaactcttgagcatgacatattggtatataaaggcctacatgacttgacacttgccaaactctccagcctggtctctcatgggtttttcatgtggacttaactctggccatagcatcctgctggaaattatttaaaaacaccaaattatttcacaattccttatttcatatgctattattccctttgctacttatcttttaaggcttagcacagagagcgtcttaacacatattactcaagagatgttagcaatcactattgttgtttttgttgtcatgtctccctttagtatctaaggctgtttggtactcctcctctgttttcatagtaaacttaaaacatagccttaatcatactatatcatagttggctacttgtttttcttgtcaccaaattctgaattttacttttctcacttacattgccttcctggaacctaaaagcatttgggcttgttatttctgtttaaaataacaaagaccatcaacaaatttccagtgaaattatagttgtggtggggatgatgatgatgatgatgatgatgatagctacatttattgaactctatgtcctaggcacttgctaaatgtttttaaatgttttccattataatcttattaatgatttcatttaatgggtaaggaaactaacactgagagaggtaagtaccttggccaattcatataagttatgagtggtagagccaggatttaagcacatagagtagtattccagagaccaaaaaataaagaaatcattatctatgtcctgatactaaccttatccttattactttatgagaaagagagcctggaaagtcaattcaaaatatttgttacatgtctactttatgttggattgaattaggtctttgaataaaacagctcttctttgaactttatctcctagaaagggaaataagatatgaacctccctaaataactaggcaaaatattataaatgctaaaacgtacaactrctataaaaatggaaagagagaaagtttaaactggttgaggaaaactcaggaaagtcatcttggagaaggcggcatttgatatgtgcctgaacagttgagtcctaatgcgtgaagatggcagaggattgaagagtgcatgagatttgaagggtacttgtaaggaatggaacaaccacctcttattactctgctttatggcaaaggagtaagatgaaggcaagaggccttcatagagctttctccctgcagagaggggaagagtatagtccctcatgactcagaatctcttggttgctgccatgcaggcatctatggaatcacaaaagcraggcccaggaaactttaaactaacctatgcttcccgcccagaattcagtctatttccatattagtgggtgccttctgtccrtacctatttctgtgtgcaatgtgttgagtcttttgagtggtggcttaacagcccaggagagaattgagctatactgaggcttcatatatgaacacagtatggttctattcttgaaaaggtttccagcgtccttttccaaaactatagagttgtgctgctcctgtctagaaagcagctcagtgaacttgaccttgacccttctgctgtatgaacttctcagaagattgcagatacttttattcaataagtctattccccctttttttgtttagtcaagtaggtaactattttgtgggtatattttctaaggtcaaattcctaatgataatagacaacctgaagttgatagtggccaactccgtgacattgctacttgataaatataccaatcttaggatctcttcttttttttgagtacacaaaaatcattttgaaatgcctgacttgctagttttttgatgccttacatatggaatatgcttaataaattacatttgttatttactatatgtgactcaatatatacatatgcaagtacgtatgtgattgtaacccccattctttagtcctactctctgtcaagaataagaagcttaaaggtccctataaccaacacagaattcaatggcctctgtcgtgtaagtaatgctggcagctacaacaagcaatcccatctcagtggcttaacaaaacaaacatttagttcttgctcatgttataggccagtggggaacagtttgtgggaggggtttggggaggaatattgtgcgccatgcaggtattcaggtatccagacttctatctactgacctggctgtgccctaaggtctcagagccttgaagttctccactggaacctctgcaactggttgcccagacaaggagagagagagagagagaaagaaagaacatgtaaatttacaagagaggtttctggaagtaccacacatgacttctgcccaaattccattggctagaacaagttacatgttacatggccctaactaagtgcaaggggagccaggaaatgttgccttcctatgtatccagaagaaaaataaaatgatttgttgaacatacagcattgtctctatcacagcctttatccccttcattattccactcatttctagtattttgaaagtttcaaggtctcccccaaccctcagatgtcaagagggcctcctagtagattgatggagagagttggggatacataaagaatgcagtcttcccaactttacactactctctttttcctggatcatggctttctgcagctgcttctcatttagttcagtccaaaaacatkaattgaaatcccaccatgaaccaagcactgttgtaggatctggggagtcaatgatgcacaagacagtctctgccctcaagatgctgagtctagtggggtcctctactactgtggcatgttctttcatcaactccaaagggctttctccagtgcttttccccctcccaaacttctgggttcttcagagagaggtcatactccccttccaactctagacagcaactctcagcagaagccctgctggtccttacaggaatagtctgtgtttccaaaaaccttctttgaacaccctagaattaattttgagggataagtctagaaaacataacccagagccatattcctgcttattattaaggtcctctttagattatgtcctcaagcatggcacacattcactgatgttctctggcacaaggaaaactctcatcctctctgagtggattggttgtcttaatggtcacagtacaggtcatcatacacctctggaggaagtctgttctccagtattgagaaaaattagcagtagaatcaaattccccttcacaggggaatttattcaattgggtcctggaaacagccattgatatcccatgattcccaaacagagacatgcaaatagaattctacaatagcctgaggttgtatgtgtgtgtgttcactcacacccccacacacacatacataaacacacagatatgtgtataaaattaaatttagaaagccattttgtagaagagactgacttaggcctgttaaataaaagtttaatttaacaaagcaacccggtatttttttcaccaagtttttaaagcattcaagatgctaaattttccaagatgagttttctggaagaagtcccaaaactcccttctctctcttttttttttttttttttttttttttttgtgatgaagtctcactccgttgcccactaccaggctggagtgcagtggcacgatctcagctcactgcaacatccacctcccagattcaagggatcctcctgcctctgcctcctgagtaactgggactacaggctcacaccaccaaacctggctaatttttgtatttttagtagaaacagggtttcaccatgttggccaggctggtctcgaactcctgacctcaggcgatccatccaccttggcctcccaaaatgctgggattacaggcgtgagccaccatgcctggccccaaaactccctttctgatcacatcctatcaggcttagaaggggcaggtattttcttttggtgggttcaactccacctttgttcattttgattataggaaaaattcttaagatatgtgtgttttttttttttctgactacgtggtttctcctagtgctaaattctcaccatgcttgaaatattgtagagcaaagcagctctagttatcctcaagaaaaggatcaaagaagggaaaatatattaatgagcacaataattcaaaacctcttaaaatgctgttcccaagtgtgctgggactttctggtcatgtctctgcgaaatggatattttggatcttgctttagcatacacagraaaccaatctccaggcagttcttccttataatttctttacaagtttccccttaaagaattcctaatgtaytttcctcaatagtaacatagatttttctagagttagaaaattatgagaaaatagagtgagcggctatctcaagtgtgtttacttgtctagtcccctgatattaactagctatgtacctctaacaccaaggcaaccacattattgatttaatgataagctgtacagcagtgaaatcacattgtttcttcatagacacagagaaagcagaagcatagctactgttgtcaaggaggttaaaatttagatgtgaacactaaaagtgggaaccccaactggaacataagttccacgagaggcagccttattcactgctgaatctctagtgtcttgagtagtatctggaatatgatacagttctccagaattatttgttgaacgaatggagatccaacagcatagagcaatatatcaccaagtattaaaactgtaagaatggcaggagttcactgagaaaagtgaagactttatgaagacagtggagttgagcagagccatagagctatagacttccaataggtggaggagagaggagcgggcaaaccaggcaargagagatgagagaagtaacacaggaggtaatgagcatgttgcagtgggaaagtgggcttggctctggtcagaggaatcatgcaatggattaatagaatccaggcaggtcagggatagggataaggacttagacatctatctggttttgtgtcctagcttcgtcatttattcaatagctgaataaatcaccccttttagtctcatttaatatctaaatttgagaataatacatagaacatatatttttaaaattcaagaagaatttataggttaaaaatggtaaacttgaagagcttttttaaaacatggtattatcattgttattatttatgacaacagtgttctggttgaccttttgattgtggttttcttagtgggaaaatagctcatataatggcccccgaatgtatgcctgggaagaaatatgttaaaaaatgaaatctagtgattgaytgtttattggataatttcaaaatagtacaagggaaaaaattattttagtactcctaagtattagaaataattttacagttcaatttgtgtgattaaattattgtatattatatacagtcatttcacaaaattgttatgcgggaagtaaagatccgttcagtcactgagttagcaaaggaacttgattagaataatactcaaccacgtttgtattgtcaggaaatgttagagaaagctttagtgttgttaatgactcttggcatatataatactcctcgtccttaaagaacttgacaaacattgatttaagcctcttttcaaatatattccaaaactaaagtcattgtttctgagtatgccataaaagataaagtacgatttggtggttctcacattaaaaaaactgttgaagaagcagaagtgaaaactgcatattcatagagtaatgatagtttgggagatgatagtgttggcttaaaacaaattgggtggtatgttctgcccacaattgatcaaattgtggtcaattatatagacagattcagcaaatatatagtatttctgccgtactatatatatatatatgatatactatatatgtagaagatatactatctctctctctctctgtttctctccttagagactctgagtctaaagcagacatcactaatcaatcacagattctttccaactgagtctttttttcttttttctttttttttttttttttttgccttttgaccaggaaaaggaatccaactgagttttgatttggccattatgtctctttgagatatagggctctaagtagccaataccagagatcagagttggcacaggcaaaatggaacctacttactatcctagaatcaaggatagttctacgaaagtttcaaagagcctcccttatcattaatggctgcaaatatataagggcatataattaataatacataaatgcaggacttaaatgacagtaatatctcaatctcccttcccacgtgttgctttcttcattcatttggcccttcatttttattcattagattggtggctctctctctctctctctctctctctctccctccctccctctctctctctctctctctctctctcctgatagctcaccttatgttaagtgctaaagagaaaagatataagacctgcttgctgctctgaaagagcatgcaatatggtacagttagggagataagatctagctgtgagaagcagtcacacatcctgcttctttttaaaatgaatgtgattacttgagttgtttgtttgttttgaaaataaaaatgcactcaaactgaaaaaaaggaaaacggatgtatttcttcctgggtttgcaaagccacttctgatttcaaagaaagctgctcgataatttcttacgggctcaactctgaaagaagctcttagaaaccaaagtacctaattactaagtcacccccatccaaccatcactactgtttgagttaaactgcctttttccagaagtagagagaggaataggggagaggttctgtgatgggaaaagaatgaggaccagagtgattgtatatgttgctgtttctcgctattcaacaggcaattgaaggcggctgctttacaacattggcaatagtgccttttcacttaccttcttttactcgcagtttcaaggattcagatttggtgttttgattaggaacatggtccaaaaggcctgagttcaggtatcagctgtgcgatttcagccaagttcttaacctatctacatgtcagtaaaatgacattactgacatttttcatctgtaaaatgagattaaaaacagtgtcactgagggaattatggtgcactaaaccacccagcactacacccagactttgcatgggctgaaaaaatcttgtctagtattatcactggtgatgcttagttgactatattagtttccttttgccactgtaagaaatcaccacaaagttaagatgacttaaaacaacaacaacaaaaaagtgtctttttttacgttctagaggtcaaaagtcagaaatctgcttcactgggctaaagttagggtgttagtagagatggttctttacagagtgtctgaggggagaatctatttccttgccttctagtgccttggggccccttcttccatcttcaaagtatatcactccaatcatctctgcttccaccattgcgttgtcctcttctccaactacctcctggtttcctcttgtagggatcattatggttacattggacccacccagataactcaggataatcaaccatcttaaaatccttaatttaagcacacctgcaaagttcctttttgccatataaggaaaaggtgacactcacgggccctaggaattaggatgtggccagccatctttggggatcattattcaacttaaccacattgactaatcagattattcaacatcattgagacagtctgcttcatagtgctataacgcagagtggtgactgtgaaccttgaggccatgagggtttgagatgctaatcaaacaaatcactttagaaaactagtattttttaaactctagtgttatttctgtaacacccatctatccttccactcctgtcttatctctacttgctcagaaagaaagatgaaatctgataaagcagaacagaagagcataatcctaaaactcagatagacctgagttcatgttccaactgcaacctgatggctagctgggttaccttgggaaaattacatgattgcattgggtgcattcctcaaaagcattccctgagacaaagatttgaggtaggactttatctgaaagatgatcccaggaaagatggatggaaagtgaggaaatgagtcagagaatggaaagaagctaataaacagtatattatcaagcaggttactcctgtgggccactgggtgacctgtgggaagtcacaggcagacagtgtagaacatcagaggtatcctagctgtggaaaagaagctttcatcattggctgaggactgatccctggcacattatcttcygcacttccaggctgctcctgaagcaggctgagaaagccctggggagactgcataggatggcctacctctagtgagaaacactgagtgccacactggttgtaaatggggtactagaaaggcctctctgaacttcaaggatgatagyactcagcttgcagggattttctgagaattagggattttctgagaatcacatgctaaagcacctactagtatgcatggcacataataatcgctcaacaagtggtagcttctaaataatgatcatatcaaaggtttgcctttggtttctgcttatgaaattagtttgcacatgagaagatcactcgacatttttgtgcccagtcgttttttaatctctaaaatcagggaggagagtaaactaaaccatcccaaagtgtattcttaggactaataatctaagtcgtcatggcttagtttctcatgtcctttggcactataatttcgctctggcttctatgctgatgattgtaaactgacctcagctgatttggtcatgtatgactcttaggatctttttggtaaatcatagtagcctctgatgaagttttgaggtaagagttgcctgctcaactggcaacttcactactaggttataatgaacagaaattccagacaaatactgtcacaataaaacatccatcaagtaaacatttattagcaagtaaacacacagttacacacacacaatttatatgacctgttttgtaaacttgagcatgtgtcagctgttatttttagctcctctgacccccatcttgcacaaaatattccctgaaggccatcacaaagattccacagtcaggaatttgtcactctttggctagcatcagggatctagaatccctcagtgttcctggctgggcataggactatttagagatttagtctaggtcatcatccctgagggtgaagtctacaggactaattggattcttgtgcccttgtgaagcaggtgtgggaagtgtttctaaaatatttctgccgatccacatgtaakgaatacttttaatttcactgagagtcttttcctaacattcactggcctacataacaaactaccaatttcatcaacagaaaatctgtttctgactttcagtatgttaattagcaaagcattgcttgtgggttgagatacaggtaacaaaaacttgtggtagctaattgaaaagaccaccccggcattgtgccttcttgattagcatgcagacagctctcgggttatagcttaacctaagtaatggtcacgtggtatcacacagcacatgctgaagtttggggatttttttagattatagtaaaatagacataaaattccactcagcccttgacaaccaacattctaccttctgcctctgaatttgacaactctggatacctcatctaagtggaataatacaatatttgtccttttgtgactggcttatttcacttagcataatgtcttcaaggtttatccaggttgtagcatgtgtcagaatttcatctctttttaaggctaaataatattccattgtatgtgtataccatgttttgtctggttttttattcagcagtggacatttgagtcgtttctaccttttggttattgtgaataatgttgctataaacattggtatacaaataaatgccaaaagcattttgacataaattacagatataacaatctgctccttttactaggaacctaaggaacatgcaaactattgcttaatccttagtattgttgcagtttagtaaaacacttgtagcttcttagtaccttagtatatctaaaagcattggtcacgtggatcttcaaaataagattttagaaggaaacagttttaaactctttatttgttatcataagcctgatttcatatttcattccccaaacagcttttaaaaatatcatttaccctatagtcatttaatttcctatacagtactttcattctgcaaaaatcagttacatttctacagctatttggtaattctgctttgtttctaggatgcagttgcataaaacattatattctgtgacctcaacctcttcatctgtgaatgctgaaatgtgccttcatcttcctttccattgggaggtcccgatactttacagaattttaataacttccctctgtaagaccatgaatgtggatagtatctgctctgaattctgatgatggccacgaatgaatcaagtggattacataccagcagagattggagggcttggattctgtgcaggatggattgtttgtttccttaatttatatgtgagaatgaatgtgtttgtaaaatcaggaaaacccaggaccaggcactgttcttacctacaggtatgctgtcagaaagcccctgcccagacttctggatatttccttaacatgcttggaaagaagtgtgtttcctgagtgatgagttcccgggttctgaccctatctttgcaagtgatagactgcaagttcttagaaaagttgaccttggactttgatcacacatctgttaacacatttttattgagcacctactatgtgtcaggcactctgccaggtgcttaggatacctcagtgaggaaacagtgctccctgctcttgcggcackgcgtctagagctgctccttgggagccactggccacatgtggctaataaaatatgtttaagtttaggaaaattaggtaaaatttaaaattaaattcttcagttgcactagccacatttcaagtactagacatccaaatggagatgtcaggtagagagtatgatgctaagaaagaggtgaaggctacagaaatcatttgagaatcaatagcaggagagccttgggccagatggatcgcaagtgagtgagcatagagaagagaagagccctggcagttccatcattaagagcttggggataaagagagagaatcagcaaagagccgagaaagagaggscagtataggaagaaaacgaaagagagtggaatactagaagccagtgaaaaagcgtattgggatagagggagtgattctcgtgtcacatgctgcaggaatataaagtaaaatgaggatagaaaacaaatcattggatttaatatattggtgaccttgacaagaacaattctattagaaggtgaagagcaaaagccaaacaggaaagaacagaagggaaggaatgggagctactgactctaatagcagaaatttgctacaaaggatctttttttcaaaaaggcttaataggtagtgcactaacatttatgggatccaggccaaaatggaggcctatatacaatatttgtaaataggtaaaagttatttatcaagctaacaaactattaaacaaatatgtgctttgcattatattgacaaatataacttcataagaatctggaaaagcagattccaatttagaattattggactttggagttctgttctataacttggtggcacagggaaagggcctgaggcccacatgccttggcttccaaaccccagcaccatcccatactctgaagggtgtgcttgtgaggggcctgcatgccctggcctgcatatcccagccctgtccacacttcttcaaacaacgatcccctgaatatctcttgagtccaggagtgtgtaaatcagcaagtccaccctaaggaagatggacccagagaagaggactatgaacaccctgtaaggggctaaggaccatgtgggcagagaattctgaggtgcagagtacccatgatctagatggcaggaagcatcagctctgactaagcacttctccttggcctagcaaatgctcacccagagagagatgtatggctggagaagggccagaatacagaccttaaggcacagagccaagggcagctctctgaggtggtggggaaatggggcaaagaaaaagatttttaagataagagaaataacatgtttgctcatgagaacaatccagtagagtgggaaatagatgatgtggaaaagaaaaggatagccaaagccattatctgagtaggcaaaagggaagaggctgtggtgtgcaagtgtagaaatgggctttggatataagcttgaacagttcctctacagcagcaaataagaaggcagagcatgtggatgctgatgcaggtgaggaagtggatgtggtggtgggacgatgtggaagttcccttctgattaatcagcacatgtttctggaagatttctgattaagaatgccttgccagtgctgtttcaggtcaaagttgattatttttgttaatttaatttctatgtaagtctcactaataatgcactgtttttaagtatataaagtactaatattccatgttgtatagctctttcactggcatagtttctccatgaggaaactgaggcacagagagacaawcatttgtcaagggacacataacaactctgctgccattttctcctgacttatgatataacaggcagctcctactggccttttgaatgtttttcttgatttaggagtctgggggttcccaaataagagattttatttttaaagacttgatgggattatgtcaattttaaaaatcaataaaagaactagaaagatgaataagaagaatataactcctttcttctcataaattttatttttaagtgtcaaaacacgcaatttcttttcagatactgaaacctgtgatattatgtgccctttgcctactgcaatygctttctgaatagtcaagtgattcagcgattacctctgtgcacccaaatcctacctgattggaaggaagtcaccggggaggggatggtgagatgacgcactaaagtaaaactccttgtttgtaaaaggtgaataaaaaccacttttgtgttactcatagagactgaattgagatcaactttaaaacatattttgaagaatttccagcttcatagaattaaagtggttaattatagacaataacataagagaaagagaagcttgttgagtgaggattctccaccacattttctcaaggacttcaacctttggctcactcttcctccatacccatattctgccatgatccttagtgactccaacgtccaacacaaaatgtcaccaccgttcagctcatccctcagcatagcttgtaactcatcagcattcagagatgctctccttcaaatatcttgagcattaaatttaccttagttgatccacattgcctcatacttaccaactttcttgtacatcctgaacctacttctcttcttcctgacttccagacccttgacccttccccacccttcactggccctgctccatcccattcctgcttctagccataatcmatttcaagggtgttcttaatagctacggtgcactttcattctccatgctctgctagtttcccacattggcaatgatctccactgttggtctatgccrtacaactcagaattgcttcattcatctcaggcaaaccccctttcagattctctatagtgctgtgttctgaacccttaacatgctcttgagaccacagttctacctttcactgaaggtcttttctccacwatgttgagacattggaggatgtctgtcaggggttctcattcttttcttcccctcacccttcacagctttacccagccctccatcttccttcctgacccagaaggttcccctcctttctaagggtgagccatcaaggtctaccagaaccttgctctgtgaacgatctcctctcttcaatgtctcttcctcagtgattccccctttggcctgcaaacatgctacacacaaatgatttttttttcagttatctagacttttcagactccttgaatgattattccccttctctttcttggtgaatcctatggaatatgtactcagcgcttttggctcctactgccttacccgctgttttatgacctccgcctccctttctggctttacctccattccccacatgactcgtcctcaggccaatgcacatccccagctccctaccttctatctccatttcttcctccttctttgccttccccccaaaaaattctttaagggttattctccatggagccttcttgaggcagcacttctacaaatccatgctatctttctacccaactcttatttttttctatttttactgagatacaattgacatatggtaaaatgcacccagcttgatgagtttggataattatgtaacctgggtgaccaccacccaaataaagacagaacatttccagcaccccagacattttcccagttctacttttcagtcaactgccaacttcaccaagagacaacactattctgatttctattaccagatattagtttttcctgtgcttgaacttcatataaatggactcacacacgggtatgtatcatatttagcactgcatactgtttctgagattcayccacgctgttgcatttatcaataattcattctttttgattgctgagtactattccattatataaatacaccacagtttgtttatccattttcctgttaaatgcatatttaactttttttcagtttttggcatttatgagtagagctactatgtacgtacttatacaagtgtgcaagttttattttctttcttggraaaatatctaggagtgggattgccrggtcacaggttaaatatatgtttaactttctaagaagctgtcaaactattttccaaagtggtttttaccccttttcattcttcacatcccaccagcagtgtgcatggagtctggttgctccacatccatcccctacttctgtgtcctccttcttggctttttttggcatcactgcctatattcttagagcatcttatctcatctcccctccacttgagcttctgagggactgcagttgtgccttcatcatctctgcacccccacactctagccttccttaaagctctaaatttgtacagaataggataatatggaatccagcgaaggagccagggattcgggagttctgtacaaacaaccaagtggcccaaccaaatcaatatgatccgactcacccagcagtgtattacagtattgcagcttgaatgtggggctcctgcggccatttgtcacagtcttcaggaaaggctttttatcagattcatagtggcaagtgatacarattattggatttcttttccaacataaaaaatagctatttgcagccttttgaagctgggtaaatgagccattgatcttacctgtggaacaccgcagggtatttttgtccatcctaactttcaatattctatgatgggagcccacccctccagccaagctggtctaatcattattccttgggtgtgcctgatctgtatcctcctccataccttttcccacaatgtagagaaaatttttagtggaaatgtcctcccttttcctcctcctagaagctgtcttcaaggcctggcacaaatgccagtacgtctatgaaggcttcccagctgcatcatcctgtagtaactcttctctcccatgaattattacaaccttcccaggatgagatgacggcctccctcatagcttcctggacttctaaatagaaagaggaatctgagaacagaagagagctccctaaatgacaagtgtaccccagatgtctgtggccatgtcccagarggccagctgcaatgcagggcctctcttttgatgtcccttgttcacaacgagccatttcacttctagtcaggactatctgcctcctaccatcatcttgaagcaataaattgcttcagactgtgtttcatcacttaccagtcagtcaagagcttgggttgcattcaagagcacatgttagagcattctgtctgctgagtgtgtgggaaggcacagagtaacatggccctgcctcatgtcgtcagtgcaggatgctcatttccaagggggacaagaaacattcagcttaaatttggtaaatatcttgaacaaaacaagaggagtctaaaaaccctccaggtttcttttctcttattctgtctcactctctgtcaaagcaaaccagcacctggtctgtttcttcatatgctctgggatatcttccygaagaacagcctgaaaagcagagtcttctcttgccattgtccacactgatctccaggaaatccttcatctttaaccctggaaaatggcagctggagaaccaaggaataccaccctcccatgcttccttattttccctttccagctttggtactccactctgtcctcacctcccatttcctataaaatatgtttattcattaaaaagtatttaatgccttattttttattatttttattttttttttatttttttttttgctaagacactgtggtaagaattagaagtccaacaacagacaagatgaaaacagtgtctacttctggggcttatattttactaggagatatagacactcaacgagtcatctacaaaagagtatcctgactgccatcttagtaaaagtacaaggactgtgggcatatgagaggggcaaagaggccaagctcaggacatctgggaaggcctcagagaagaactgacccataagctgatgagagttacccagaagtcagctggaagccatgagggtggcatggcacagaggacatgggtgggggcacccagcaactgagagcatggcacaataaggaagcagtggcaggtatgagagggagtggtgaagacaaagctgaaaagggcagcaaggatattcccatcacaggcctttcttgtacgttctaagaaagagtagggacttatagcaaaggggagccatttataagctcacacaggggaatgagggcatcccttttgtgtttgcaaaggccgtgctgcagcagcactgacagcatggatcagagggcaacactggacaggcgggaagacagaggagacatgacaatggcttccatgaggggaggggcagtgctgatggcgtacatggaggcactagtgatgtcacggagaggaaggagtaaaggatggggctctggtttcaggcttgcgcctctgggataatcgtagcacacccacagaagttgggaagactagaagctgcagatctagggacagagggaagccatttcggggatagtttgctgtgtatctgggcctcaggagaggcctggaccattggggtcacaaatcatcaaaactttgctagtcatgctgccctgggagtgggttagacagcccaggagaagaggagggatgctaaggagcaggcaggtaaagagaagcccatggagaagactgcggggccatcagcgagtgggggcaaccaggagagaggctaccatgacagggcttggggaagagttttgcaaggaaggcagatgatcaagcaggtccagtgtcccagaaagacctttttttgtttttgagacaagtcctgtgctgtcgcccaggctggaacctcaagaggcttggctctgaagggaggagacagagagagcagcagcaggagaagggtgtggggtaaaagaatgggttggtttaagacaggaggaacrtaaacaggactttaatgtgttttagaatgaagaggatgagtgaatgaatgtttggtgagaagcaattacaggatataaagcaaataattagaatataggcacagtgtttactgacttaaacacttaacaacaaaattatatgatagtggactgaatcctcagtttgcaaaacagagaattcagttccatgtggtggaggcagcatagtgagcaggttctggagcaaacctctgtggtgcattcccagttgagggtggctaagggcaagtgacctaatctctctaccagaaatggagataatcacacccatctctcaggcaacaacaactgagctcagttagagcgcaacaaatgtcagctctaatcagctactgaaacctaacattaagggaataaaacgtatctggtggatactcacccagtctgctaaaggtacagaaaaatgtgttcatgtgctgttgatttctaaactgctgaaactcagaccagtcctcaagagctgggcctgttccaactgtggaaacacttagggtttgtattgtttggctacaacgtgggcagcagagtgtccatcacgaaggccatgtgtgcacagccaagaaaactcttttaggttcctacctgtctctttccagagccatccctctggatttcagatgagatttccctattaaggagggatgccaaatgctggggatttcataatactcccaaccccaggcaccagatttgtgtaattgcagtggtggagatttaattgtcctttgaagaggccccatactgtttgtctgtcaaattgtctgcatgttggtgcagttgaaattataggagaagaggaaaccaggggtatgtttcaaagtagttggcacgtggttggtgatccatagtgcaggtttcctttctggaaggtaacaggactgtgttctcataaggcagcatggcagggtggaagccatatgggatttgccctcgaatttcagcgctgccgttgagcagctgtatgaacttgagctatttgcatatcttcttgaacttttttgctcctctgtgaatgaagccattgcaccagcatgttttcaggattaagtgagacaatatgtggaagtgcctggcacacagtaggtgttcagtatttttttattttccattctctgtgtccttgttttgactaccaggtaactatgtttaccctcagagatctgatgtatttcttcatatcaagtatatatcaagaatttcatccctcatcctaatgcattaaactcactgcatggaagttataccattacctagactcaccacggtcttgtcagacaccagcagagttttgtgtggctgcaatagagatgttattgccagttgtcagtattgaaatgaggcactccttcatccttcagtgaaatctgtgcaggcattttcctttctctggttaaacattttatagtctcctttaaaaacaatgccctcatttcatttcctctctctggctggactcttctcctccctcctgctttcctaaaatccatcttgtttccctgtaytgtttgctgaatgggcagtttaatgaatacagcatttccattttgaaatgtacagagcacaaggcagaaactgaatttcctcctggacagtttccatccacagtcctcatttccagttttctcccttcttttcttttctacaacacaactgaaatttgctgaaccagaaaggggaggaaggaggtgtgacaggagaggcaatatgccttctcattgtttcagcaaaagcttattagcatcctgctccctagaagagaccaagtgccctaaagatgccctgggtgcctcttctattgcacaaagctcaaggtccagagtatacagtgcatgacagaatctaattaccaagataattactgttacctgcactacctaactgttgtgttttgtaatcaaaagctatattggcaggggtgagtgtgagcctgctgaaaactcagggaaactgttgaaggtttatcaaccygaagcaattttactctagttagtgggcctgtgttgctcagttagcagaatgtttggggatcagaagaataccccagagcacttcagccattgcatagacattagttaccgggtaggaatatcctcagctgactcaggtattcatgttgttgaaaccagacttcatggcaatttgaaaacgtctgtgccatttttaaatttgttctcgaaatagttgatcagtacctgacttagccttcatttggcattcggtgaaggagaaattgatttcctttgggcatggctgtatgtacctgatgggtacagcgtgtgctaagctggatgtaggtatgtattcatactatcaccacctgcttcatattcattatggcacaaggttacaaattggctttctgtttcccatctcagccagctctagttaatttatgtctttacctctgtgcttcacacactaaagaaatggagtttctactttaaaaatcaggtgtattgaaaaaatggttataattgtttttttaaatttttaaagaaattccaagtggaaaacaaggaataagttgcaaaagagtatgaaaagtttggtaataaaggcaaggacacttaaaaggagggagtaaaataacaaagcaaaatgggtgaggctgacaggctataaattgaaaagggagaaggggtcaaggaaaatgcagacaggaagaaaagagacagaaaaagaaatgatagggccttgagtaatggactcagaaaaggaaataggaaaagttaagaccaaagtaagaattatggagacaaaagtcaaagacatccaggtctcaagaattacaggttattggtggcctgggaggtagtgaagaggggctaggcatatccctcatgaagttagatgtctgaattcctcaggacagtgtgacagtcagggagaatgtcccctgaatatgctaattcagactctaaaataagagccagccagattcattaccatggttggccagcctgtaatggcaacagaattcactgatgcatattaaactgaatttttctaaccaaggtcttaaataaacagacaccagctataactgaaaattagaataaggccttcagtggtgactatttctgtagggaaagtctgaaaacccttaacatggtttttttccaaatttttagaaatttgtggttcttaaggctgcttagtatgttagcaattgctccagtgcaggactgtgtggatccctctggtattttcttttaactttctgcaaggcagagagtgtggctgacctgtgatataaatgaaaccccgtggcaggaacattaactccatctacaacaaaggaacatgtagagatttggattctaatgaaaataatagaagctccttctcccaaagttgggaaatacagaggaggtcttctcagccagtccaaatttgcaaaaccagaatcatcacagaaaggtagataataggaggcctaagagaaagctcagttgtcctttggcctatggcctttgggcttgctgtagatcctctgttggcaactggatgctctgttgrgtccaggaattgatgataaccagtagtttgtgggtagatttccatgttgagcactgccttcagctaagtgctttcagttgcctcttgttatggttggagctgaatgacctttgtttacgtgtgtttcaggctaactgatgaattacaagattttcaccaatgagtgggaaatgtagcgataattattcagactgatttatatttgtctttgggctggtttttcatrtatatttttagacattttaatatatttggatctgattttttataaaatcatgaggttctctttatgctcaagtgctgccaagaagttggacagccctcctgttcttctcccagttccccagtccctattccagatgaggggatgcagagttagttgtcmattcattcaacaaacatttattcagcagttagagtgactatctcatctcagtttccctgagacttttctggtttgagcactgaaaagttctatattctaggaaactcctcaacctcaggccagccaagacagttggttaccttatcatctaccatgttccaatagagctaggagagaccctagaaatcatgacaatttctttattattattaattactttttaatattcttcttttttttgagacaggatcttgccctgtacccaggcttgagtacagtggtgcaaccacatctcattacagtctccacctcccaggctcaagcaatccccctgcctcagcctcccaagtagcttggactacaggcatgtgccatcacacctggctaattttttatttttatttttttgtagagacgaggtctcatcatgttgcccaggctggtctcaaacttccagtctcaagcaattatcctgtcttgatgatttaaattcaaagaaacctagcttcccaaagtgccaggattacaggcacgagccacagtgcccagcccattctgatttctacacacccattttaaagtgccagttaaagccaaggagacctctttatcaatttgttttccttctgattcacacattccctggattggaagagataattaagttctatggttgaagatgttatcttcaggctgcattaaagaataaaattaaataaaaggtcatgcagtgtgccaataagagttttacaagccagttggaatttgaaaattagagagtcaaaaagataaagtgaatcaaaaatcatttatttagtattgaggtaccttttggtacatcaaagagatcatttataaaatagtataatgtaaggaagttgaaagaatgaactacagtggaatactattattatatctacttatgcctttttttctggaaaatgttcacaatgatgtgaaaggatctaagaccagcctggcagccaccagatggtgattctagtcctggctcagtcagtaataggtcactgaccccagagaaatcaattcagcctccccaggtccttggatttctttctgtgaaaatgaaagcataggtaggaatttcccatggaacagctagcagaggagaaatattaaaagtcaggagactcatgctatagttttcatacttcattacaacaatgttgtttaggacaagtgagttaacctgttagcttcctctatataaaatggaaagtcattaaaaacctacatagcagggttcttgtgaagatcaagtgataatgtaggaagcatgtacaaatgtcacattctgccgtcacgtaatggtcctcacagcttgaggtagcatttagcatgtgtcatgatttagtacaagggttggcaaactgttgctcttggattaagtctggctcattgcctgtttttsaaagaaaaaaattgtatatgtgtgtatatatgttatatataggtacacacacatatgtgctatatatagcatatatacacacataatatataaacatgtacatatatagcattatatatatacgtgtataatatctccagtcctcatgaccagccatgcttgttcatttacatttgcatactctatgattgctttcatgcaacaatggcagagttgagtgattgttttgcaacagagactgtatggcccactaaacctaaaatatttagtctctgaccctgaaatgtaagattgatagcccaggaccaggcrtggtggctcacacttgtaatcctagcactttggcaggccaaggagggtggatcacctgaggtcaggagttaaagaccagcctggccaacatggtgaaaccctgactctactaaaaatacagaaattagctgggcgtggtaatgggtgcctgcaatccaagctactctggaggctgaggcaggagaatcacttgaacccaggaggcagargttacagtgagctgagatggtgccactgcactccagcctggacgacagagtgagactccatctcaaaaaaaaaaaaaaaaaaaaaaagatagtccaagatccaggattcttttaggttctgtgtcactatgtgatctcaggttaatgatttattgtttctgattctgtttcttacactgtaaaaaaaaaaaaaaatggtgggggggaatacaaatccagccccttctttcctcacagaaatgttgttaagatagataagaaaacaaaakcattgatctcttctggaggaaagatgatttaaattcaaagtattactcataaggtggatgctgttagatgactcagaaatgatgactgatgtgttattattattctctgaaattagttccctcatgtacctcagtgggggattacttagaacagcgatagcatacagacccctgcatcgtgacactacatcaaaagctaagatactgcaccagaatctaatttaatcacagtacccagtcaggagtgagttttaattgtttctttatccctttatcctctgaagactgtcattaacatttacaagacatgaacttcagatcatgccaacatctctgctgaggtcacctggcagctagccattttagtccatgatcaagacagaggggccttctgggcacatgaggagggacaagacagaacagtagtggtggtagcacataagctggtttacagagcaaataccaaagataggcttgtttctgttaaaacttgaatttatattttattcttggacacatgactgatatccaggctgactaagaacatacacaagtaaataacaaaactttgtctaacacgtataaatattaggacctcctttttccccaagaatcccctcaaacctctagggaggatctccctaaaggagcagctcttcatgtggctgaaagcagccacataaggaggctaaggctggcctctgaaagttacctcggcccaggtgcagcccatttatagaccctctatacccaactccagatttatggcatagataaattagtgggcaatcatttgctctataaaatgattcttcattttacaagcttattcactgccgcattcctttactgatctattcctttactgatctattcctttactgatccctctatacmcaactccagatttatggcacagataaattagtgggcaatcatttgctctataaaatgattcttcattttacaagtttattcactgccacattcctttactgatctattgccactagtgcagttccaataaaatctcattgttagaaatccagtacacaaatgctttttcactgctaacctggatggaaagatgaagaatacaatgcacttataatccccttagatcttatgatgtggctttggtcaaagtcttctgttctcagtttaggagcttaatgttccttggtacttacaattgacagggagagacaggacaaaagattctttaaaataacaatgaaacaatatgtgatttcattaactaacttgctctaattatctgcatgagatttttaataaaaggatcagtcatacagaaataagctaactggccttttgatgatgagtaataatgatactgacaatagctaccatattgagcattaccatgtgccccatagcattctaactcattaactcattgaagctaaaacctaaaaggtaagtataattattttcatttctgtattacagatgaagaaattaaggcacagagaagtaaaatatcctacctcatgtcacaagctgctatatttggagtcaatattcaaactcagtggcactgactttataattttgctactaaatagttacagtgctgtattgacaagtaaagcaactgtcaggtgctgaaatgtaggagcaagagcaatacataacatgtgttctaccttcaagaaactaataagaatttctgcctcaggccattagagaaaaactggtttgggacttgtcctttgccataaaatgaaagaaaaaaggaaaactggacaaaatatatcaaacaactaatttcataccttggacaacaggaaggttgttgttggacaacaggaagccaaagtggaaagaacttgttgggtatatagtaaattgaacagagaccctagaagggccttggtgtaatagtaaggctaaactagccctagaatcaagattattttagactcactctggtaaaacttaaaaacaagacttgaaaggatcaagtacatctagagctgccaaaacaatagccaacactttttaaaggaaaaaaagacaatctagacagacactcaacatgtaaaatttattatatctatcattcaatcaaaaattactagacatgtaaagaagcaagaaaatatgacccacaactagaacacccactgaagagaagcagacctagaaatgatagtgatgatgaaatttgtagacaggcactataagcaactattatacatatattcaaggatttaagagaaatcagaaacataatgmaaagagaaatggaaactatagaaaaggaatcaaatgtaattctataactgaaaaatacaatatatgaaataaaaaaattcaccttatgggctcaacagtagattagatactgccaaataaaagatacatgaactcgaaaagatagtgatagaagcaattcaaactgaagataaaatgaggctgaagataaaaaggctcttgtaaaaataagaacagagtctcatttttaaataaaaataaacagagtctccatgacctgtgggacaacatcaagcagactaacatatatgtaaatggagtcccagaaaatgtcagggtaatggcaaaaaaacctgaggaattaatgactacaatttttccaaatgtaataacaactataaactgacatatccaagaaactcaataaaacccaagcatgataagcgacaagaaaatcattacaatcaactagtcagaaagcagcaatacaaaaaaaacttaaaagcctccagagagttgaaacacattatataaaaaagaaaaagatgagaataatcactgatgttttttgagaaaatgcaatgtcttgtagaagacaatgggtgacatctttaaagtgcgtgaacaaaaatctgcccacctagaattctataatcagcaaaaatattcctcaaaaataagaatgaaattaagaattttttagacaaacaaaatttgatgagcaattttttcaccactctaagaaatgtcgaagggaatttatcaagtcaaaataaaataatgggaactcagatttgcacaaaagagaaaagtttctaaattaataaatatgtaagctgggtgtggtggcttatgcctgtaatcccagcactttgggaggccaaggcacgcggatcattgaggtccggagtttgagaacaggctgaccaacaagctgaaatcgcatctctactaaagatacataaattagccggacatggtggcgtgcacctgtaatcccagcttctcagcagcctgaggcaggagaatcgcttgaacccaggaggcagaggtttcagtgagccaatatcacaccactgtactccagcctgggcaacagagtgaaactctgtctcaataaaataaaataaaataaaataaaataaaataaaataaaataaaataaataaaataaaataaaataaaataaaataaaataaaattaaaataaaataaaataaaatacaaaataaaataaaataaaataaataaaataaaataaaataaaataaataaaataaaataaaataaaaaaaataaaataaaataaataaaataaaataaaataaataaaataaaataaaataaaataaataaaataaaataaaataaaataaataaaataaaataaaataaaataaaatataaaataaaataaaataaaataaaataaaaaataaaataaaataaaataaaataaaataaataaaataaaataaaaataaaataaaataaaatagtgagtaaatataaaaggcattttggtttttaaaatagcttgaaaagtaaatggactgttcaaataaaaaataataaagatataataatgatataataggaaaaaatatatgataatagcataaaagaaaagagaataagtggaagtatactattgtagaattcttaaatatatgaagtacatatctaatgaagactgtgatagttaaaatgcatattgtaaatgctagagcaaccatttttaaaaaatggtatagccaataagccatagaaaagatgagatggaatttgaaaagaaaaacctcatatgaaatgaaaggaagaaaggaacagtgaaagaataaagaataaggtacaaaaaaatcaagatgatataatacaaactcaatatatcagtaattacattaggcataaatagactaaccatgccccattaaaagacagaaatcgtcaaactgaataaaaaaagcaagattcagttatatgctatttacaaaaaaaatattttaaatataaaaatagctaggttagatataaatggatagaaaaagatatacagcaaattctgtatacgtgaaggctgtcataattgtactatctgaaaaagttggcttcaaaatagagaacattattagagaggaggagggacattttataatggtaaaataatctattcatcaataagacacagtgatcttaaaagtaaattcactcgccgaggtgggcagatcacaacaaggtcaggagtttgagaccagcctggccaacatggtgaaaccccatctctactaaagaaaaacaaaaattagatggacttggtggtggacacctgtaatcccagctgctctggaggctgaggcaggagaatcgtttgagctggggaggtggaggttgcagtgagccgagattgcaccattgcactccagcctgggcgacagagcaagactccgtctcaaaaaaaaaaaaaaaaaaaaaaaaaagtaaattcattcaattacaagctttgaaaactacatgaagaaaaaactgacagaattgaaagaatacacacatctatagttgtggctggaaatttcaacacttctcagcagttgttagaacaagtagctggaaagtctggatatggaagattcaaacaatactatcaatcaacttgatcaaattgatattacagaacactgcattcaacaacagcagggtgtacattctttttaagtgcacatggggtattcaccatgatagactatatgctgggttataaaagcttctcaacaaatttaaaaggattaaaattatatgaggtctgtttgttgaccaccatggaattgggtaagaagtcaaaagcattaagatatcaagaaaattcccaaatacttggaaattaaatatcacacttctaaataagccatagatcaaagaagaaatcaccaggaaattagaatttatttgaaccttattgataataaaaacacaatatatcccagtgtatgggatgaagctaaagcagtgcttagatggaaatgtgtaggttaaatgcttatgttagaaaagaagaaagttctaaaatcagtgatctagcttccacattaagaagctaacaacaacaacaaaaatactaaccttaagtacgtagaaaaaagtagaaatcaatgaaatagaaaataataaataatagagaaaatcaatgaattttaaaacggactttttgaaacaaagctataaaactgataaactatcaagctggtcaagaaaaaagagaagatgcaaactggcaatctcaggtgtgaaacaggacacatgactacacatacgtcattaaaagggcactaaaggactctaatgaacaaacatatacaaaaaattcaacaacgcagatgacatgcataaattccttaaaagacaaattgctaatactgattcaagaagaaataaaaaacctaaatactcctataaattaaatgaattgaattcataagtaaaagcctttactcaaagaaaaccccaggcccaggtagttccctaattaattctgtgaaccatttaaaggataaataataacatgactatgcaaactttaagaaaacagagaaagaggtaaatacttcccaactcattttataaggcgtgtatgacactgatatcaaaaccaaagatatggtaagaaaactatagaccaatatccttcataaatatagacacaaaaattcttaacaaaatataagcaaattaaattcagccatatgtaaactggataatatactatgttcaagtggcatttatcttagaaatttaaggttggtttaatatttttaaatcgatcaatataatttaccacattaacataataaaggaaagagtatgatcatttcaggaggtgcataaaaagcattgcacaaaattcaacacccattcataataatgacttttggaaaattagkaatagtgacagcttcctcgacctgttaaaaggcagtgatgtcaaatcttcagtttaattatgaaagagtgaatgctttcctactacgatggggaataagacaaagattcccgttctcaccacttctatttaaacatcatattgcaagtaccaactagtataattagacaagataaagaaatcaaagattacagattgcaaaggaagtagtaaaattattattatgaataaacaacagaattgtgtactgtcaacctaaataactaaaagagaggggctctgtgaaagaaagatgtttatctgggaatagagctttgcaatggaaatacctaggctgtagttaactatgtgtgtattcagggaggtaaaggaagacaaagctttttcaaggaaaaaatgaggaagattacataattgttttaaaataattatccttgactacaaagatcaataagaagggtgcgatgggtacgctaaaagcccasacctcacaactgcacaatatatacacgtcttctgcacttgtacccactaaccctataatttaaaaaaataataataaaaaatagcaagagtgacaccttctgaggttggacaggtagctgctgggcagatgtacttacagaagtaagttttatgcaaagtcttgatggtctctgtgcaaagttgtggttttagcggtcttttttgttatcaggcatgcaagcatgagaaccctctcttcgtgaccttccctagctgtatttgtttgggttttcataacatttatgccttcatttttattctgataactttcacagtacatagaaaatcctaagaaaactacaaacatatgctgctagaagcaagaagtaaacttagcaaggtcacaatatacaaaattaaagtttatgtctgtatactaaaaactagcaaataatattttaaaaaataacatcaaagaacatgaaatactcaagaataattttaataaaatacatgtaaaatttaggagatttttaagcagacttaaataaatgaaagaaaaattttgaaaaggagaaaaaaaatttgaggacttactctgatttcaaaaactttcatctacaataatcaaagtcatgtggtattggcatattggcataagaatagacagatcagtggaatagaataggtctatgcgtatatggtcacttaattttttacaaaagtacaaggttattcaacgggaaaaggatagtctttacaacaaatagtgttaaaacagatatccttaaggggaaaaaaatgaaccttagcccttatctcataccctgcacaaaaattaactcaaaatggatcataaacctaaatgtaaaatcttaaactatgataattatagaagaaaatataggagaaaaatcttttgacctcaggttaggtaaagatttcttagattactaaaggaactaaccatttaaagaaattgataagttggacatcatcgtaagtaaaatttccactctttggaagatatcattaagaaaatgaaaggcaagccacagaggagaaaatacaatacatacgtctgacaaaggacttgtaactctcacaactcaattaaaaggagactaacaagaaaaaatgagcaaaatattttaacaaacatttcacaaacaagatacaccaatccccagtaagtacatgaaaaggtgcttgagatcattagtcatcattgaaatacaaattaaggctaggtgtggtggctcccaacactttgggaggccaaggccagcagatcacttgaggtcaggagtttgagaccagcctggccaacatggtgaaacccccatctctacaaaaaatacaaaaattagccaggcgtggtggcacgcacctgtagtcccagctactcaggaggctgaggcacgggaattacttgaacctgggaagtgaaggctgcagtaagccgagatttcgccactgcactccagcgtgggtgacagagcaagactccatcccaaaaaaaatgaaaaaaagaaaaagaaatacaaattaaaaccaagacaagacattgctaacattcactaaaatgtccaaaacaaacaaactatgcaataatgtggatgaattcccaaatcattatgctgagcaaaagaagccagacacaagagatcacactgtatgattcctttcaggcaaaagtataggaaaggcaagcctaatcaatagtgacaggaatcaaaccaatggttgcccgagacgggggtgggaaggaatggactgaaaaggaccatgagtgaatttttaggagtgatggaaatgttctgtgtcttattgctgtagtagtcacacaggtgtgttcattcgccaaaacttgtcaaatatacacttagaatgagtattttctattctattcaaattttgcataaaaagaagcagctattttgttgttcatgatagaagcaatattagcacttactgttctctagctctttcccaaggttttgcagcactatgaattcctttagtcactcagagaattaggaaattagcatgggttgttttgatctgattgggcatcacaataggaactgacctttctgtcttctgagctctaactttggatctcatgttttgctcctggtgtgtaagtcctagctctcctatttgggcctccttaagggtgggtgcttggtgcaactgtcatagtcctttgcttaaaactttctccttggccaggcacagtggctcaagcctgtaatcccagcactttgggaggccaaggcaggtggatcacctgaggttaggagttcaagaccagcctggccaactcggtgaaacctcgtttctactaaaaatacaaaaattagccaggtgtggtagcaggcacctgtaatcccagctactcaggaggctgaggcaggagaatcgcttgaacctgggaggtggaggttgcagtgagccgagatggtgccgttgcactccagcctgggcaacagagcgaaactctgtctcaaaaaaacaaacaaacaaacagaaaaaactttctcctcagcttattttacgaacatagttgtaagttgaatgaatgcacgcctggagagcaattgggatgcactactgtggaaagtagaggtattcagaaaaggctcaacagccatatattagggatattatgaagtgatttaaacattagatgatggttggactagagaagttctttcccagtcctgattatgtgaaaagaaagcttccaagggcaggagacatttctccacagggggaagtgagtctaaatattaggagggtcagtagccattctgacaacctacccaccatagacagagtgggattcacccctaaaccagcagagtggttagatgtctgtcaccaggcatgtgggtctgaatcagaagaaagagaaggatatcattttggaaatttacaagtgagacatgaaatctaatagaagggatttcaaaaagcacagattcatatgagaagttccctggaaagaaaagatgggtgctgatgtgggcaggggccatctgaggatggcagcttcacagaattgccctctcactccactctggggccaggactccccactcctgtagtcttctccctaagatgagtaaatatgaattcagcaccaagtaaaacggcctacacatcctctcaccagactcttttgcttataatcatcattattaccttaaagccaaagtttactcatctgtaaaatsaggataataataattatagaatcattgtgaggctttgataagataatgcctgtaagtgtttagtacaggctcatagaaagtacttagtaaatcctggctatgattgtggttatgattttgttacttgtttcatcattaaaccatgtatcatttactccggaaacaaaaagtaggaatgctatttcccaatctctgtaccacgctcacagcgaaacagcctgtgccatccactaacatacccataaacaatctccactgcattacaatcaggaacttagggaaaatgaggcttttttcttgttaagctttatctgcagaatctcaagtagtttttagctgtgctcttttatattccagtcaacctcatttccacagatgtactcccctagattgaaagttccgtgagagcaggcatctggtaaattatgcccaccactctttccccagggcctagcaaggtacttggcacttagtgggagctcagtagatataagatgaatgaatatggtgccctttccaaaatccttctacgcaagtcctgctgcactagtcgctgccctgctatggatgcaaaaatgagtgaaaggttgatacattgtaaacgtaactgtgatcattctgagtagtcatttaacctctttacagcagctggatgattatttctcagctatacgaaattattaaataagaaataattcatgcttcatgttccatgtcctccatcatgaggcctttttaccagtttaattagttagtaaaggacagcacgctttcctctccaccttttatcaagaattctaaaggctttagagaaaaaatgactcaggaggtgaaacagcaggactcctggtgttatttataaactcgtccctggcatctgcagcagcaaatctcaagcatcgtttaccttgccccgtaattctggagtttgagtataaatgatgaaacagctaatggcatgttacccgacaaagtagcattagcttcctctatcatcgtcagctgttttttttttttttttttttttccacaaaaatgtgtaaattgcagtttatctcaccagagaagcatttgatcaaatgtactttaattatattttgtgtggctactgagaataatcactgtttcttcatcataaggattgtcctaaaaaattatattaacgtgggtcaaccataaacagcagtgggaatttagctacctttaaatgctaaatttacctctcagcttgtagatttcctacaaatgaatttctttgggtcaagattttttcatgagcattggcawttagtggatattccttgaaccaaccttttactttaagtgaaatgtatttgcattaagagcatattcatttcccaggctgcttcttaacacatttgtttccctttgttttggaattcacaaagcttttcatggtttgcctattcattccctcactgcataatgatttatagtaggttatattttagaaggttttgtgtcaaaaaaaaaaatttgcatctcttcatcaggtagtcagttaaagaggctgcgttgagctgccaaatgggacgctgccaggtgaccaagaaagaaaagcctacttgcataaataaaacgaaagcatattagaacatttagctaacattcacccaatttttcatagttggcaacttctaactttgtttcatcttcaaggattatggtttgaagcaagggtaattcgccttgtgtcttccttttagttcttccctcagaacctggtttgggaaaaacctcactaatattttgtagcatcagccaagtagttgtcatcttttttgtaaccaactgccttatacaaaagcatagacacacttattttggataaatccatactgtctgacacataagcaaatatggaaaatataaaggaatccaaaggctctcacacagatcaattttcttcattggccagagctgcctctaaagaaattcacatgacaccgtcttcatttttctgaacatgatacatattattcattagcatttaagcttatatctaatgcacatttttagataggattttttagtagtaagacttttttatatgtytacctattattatccatggtagagtttcttgtgaccttgaccctgtgatatctggaaatgaaaaaagcccattttgtttcagactcttggtccctctagctataattctacttctgacagtggcccccagaggcattttgtggagggctgctgccactttgacatcacccctaaaattgttgggcacaccctctctaaaataattttatttctcattatagcttaatcactatgaatttmtactagagtcatttaaaagaacaattttagcctgccctacttgttgggaagaataggggaaattaacagcatcttgtaactggaaggacccttataggttcctaagactgattccaattccaaacaataataccagtccgtaagtggatctgcttatagagaaacacctgttgcttctgttttttgtctcatatccagttagtttcccattcacagcaaaacattcccttcaatsccaaggaaactcaacctttttgattattagtatagtttcatcaaagtttctttgaaaggtaaaatatcccctttttcttgcctataatttttaaacctttttaaaggttgtaaagaattagttagtcaaggcttcttctcataaagccagggtttcttttttcctagactctatgtgcttaagtgctctatgataaaatgtggatgttataaactcatcagcttggccatgtggaagtgaaaaccactggtcagaggtgtgtggattctcccttgtgacctatctcatattactgtgaaccagctggcccccaataccataagcattaacaatggctgacaaaattgggactccagctccattgtgtcacctgggcatctgtgcagcactcctgccaaacagtcctgctaaactattccgatttcagatgggaatttggtcagaaacagcattttcttgtaatacttcccacttttctaattcccttgtttctggttgccaaaagaatgggaggtagacaggaagaggtggggaaaaatgtttaagttcaaatgtcatctctgctaaaacctgacttccactgcactgtggctttgtaacctccttgtgtttgtagccagctatcaaaaatctgtccatttgaacatgattatactaaagcatgattattttaaagctttcattataaactctacactggaaataatctttagggtgttttcaggtttgaaaacccatatgcactgaatgttctcatggtgtgctctgtcagaaacaatttttaatgatgtttcctcagtgagcatcattccctagatgtggacagagctgcagaaaggcatttacaaggagtcatgctggctcagatgggtgaagagggaactttattgacgtcagaccatgaaaagagagtgggcaataaattctgtatagacaaaggtgaacacaataaactgagactgacatataaacacgagtacaattcaaaatacagtggtaaggaggtgtggatgtttctttatagctgtatatgtttttgacacacccgcacacacagaaaattataaagtcaaagataatgaacctagagtcatgtggaaggtgtgaggtgggtcaagggagaaatagaggttattaaggagtataggtaggtattgaagaagagcctcattttatacacatacagacacatgcacacatatayacctatatatactctctctccatatatacatatatttatatttatgcacatgtaaatacatatatgtaatttatatttattttcccccaatactcctcatacctagagaccatgaactacatacagagggaaggcacactttctacctgaaggccagcccttatattggtgatcagtttgttcagtgctcttaatcattagagtaattgtgtataaaatcatgaatggggactttgtgagtcacttaacatttgcaagaagcatatgaacgtgattgttcttttagagtttgttaggtgggtggtggtaaagyaatacaattttctaaatggtaaaatcatgaatctcatgcatgtcaaaaaatttattcaattcattaattaatgagaatatcagtaagatgttacaccattttaaagagcatttgagaaaccaagtctgtgcaacttaataaatatatattaggataaaattgctgggttagataaaaactggttaatgtcttagaagccaataaactgtaacatttgagatatctgttctatgggacaaaattcattttcatctcttttagacatctttaagttgacatgtaacttcactaaatctgggacctttaatcaacagtaagcagtgagtcaaaataagtacattctaataaataatctttgggtggacttggcccctgaatgacattgaaagaatgtactgcctacctttttgctttatttttaagtcatgaataatttttataagagtggtgaaaggtataagaacatactgagttctacataatagtgtttggatctcaacttgtatactgctatatgttcacatggttttggtaaggagaactgacttgtcattctccaaggcagaagctgagagtagaactcccagaaagtgggatttacttaccataagttgctgtagaaaaggaggatggagtcaatctttatttctgcttttgtcccactacatgttaagaattttttcatttacccattcagtgattcaacaaatatctgttaagcatccactaagtgccaggcattgaggattggggtgaaaaagcccctgctcttaaggagcttacattctagcagaaaagacagacaacaataataaaaccatgataatattgtttcaactggtagatagtgctatgaaaaagaaaaagaagcagcagcatgaaggtaagggagataatgagtgaccacatggaggggtggactttagactgaaygatcagggagtcccaggaggactggcaggcctgcagagtgtggcccggccacagcgatgggcttggtgtcaggtagggctgccattcatcttctgcccactgtatgaatgtaattcaagtctttactctatttcatggtccaggatacctccgacccaagtttccatctctttgtcataaagtagaataggggtgggagatcagagctgcaaatgaagcaagtcatgcaaatggtttcccactggagaaaaggcacattttttcccgagatagggcagtgaagaaggtacagagcatggatttcagatcagagacacctgggtttgaattctatttctaccacttactactgtatgacatcagacaagttactaaaatctattttccatctgttaaagacacatgaagatctctccctcatagggccaattcaatgaaatcatctccagaaagccctcagtacacagaaagcactcaacaagcagtgactattattcttgtaattcccctatttggggagtctgtagcatcatcttcatgtagtactgattaactagtcttagttattgctgccacacagttttaccaccttacagagatgactcattatcacacagttcagatactgtgggacctgcaagtccaccagaggtgwtggtgttgacctaaactatttggtcaaaattatgcccatagccaagccaaggtttccaaagagatagaaggtacatgggcttagtggcgcacctaaaactttttagcccaagtttggagattcttgggtagcttgagagttagaaactaaaagtagaatacttttaatggatttgtgattgaggattttttttgtttttactttctggtcctgtcctgtcctttgttttcctttcatttyttccccctcttatgagttgagttgctttctcttctagggagctatgtgttaggaagctgctaatgaactgcttttgagtctaattttcaataagatttaatacagtagggattaaactgcccccttgaaaagagagattaagtgtctgcaaatcccatgaattgattttctaattgttttggtaataatgtgtatgtgtttttcatttgctaatgttgctgaaaataataataattttaattaaattttaaatgtatttttagtattttaaggattctagagggactaagttttcttgcaaggaatatgttaagaccataacattcttccctcaccccataattattatgatcagggaatatctataatatattccatggcaattaaattgcataccccagactgttcaagatgtgtttataaaaggagaaatggatttcccacagctgctygcctgtgaatgcatccttcacacagaaccacagtagccagtatatgcactaaaataacagacttgaatttaaactttcagtgctttcaaacgtctttcaaaaacttctcataacacaaattgcttaatttgtgtacatgaaaactcactgattacatatgaatgagagtcaacctataataatggtgactttgagaatctttgtgtatgtgcccacccatctcttcaggaattagcaggtattcagtcttgttccaacattctgcacaagccacagtcattagtgagagcaccctgtgaaggctgaaatctgctgtgaacagtatggggcagctcaggtattttttataatattcatcagatggtcttcacccagtcacgtagctggaaaatgttttctgtgagatgagtgtttacaaaaaaaaaagattcatagagaaggagcaagggaaggaggaagagggaaaataatccaaaccagggtcaaggcagtcatatagactagaatcacagaccaggtgttccgtctttaaaaagcgatcgtcacaactttgatttattaaattggaatttaaatcttccaagctgtaatgaattgatcatgatactgttgatatagattggctcatctttgtggctgtataacaactataataaagaattaattgagtacctattaatcctcacaagcatcttggaagttggatatcattagccctgtttgctgattgaggaaactaaagttgaatggctttacatcattctttcaaagtcacccaggttttaagcagaagaatttgaatttgaacccagccctacctgcctctaaaccccatattctctcagctgtatctccctcctaggtgcaatggctccttggctgacatgctgaaggatatgtcttcacattcttaaactccaaacctcccttggaaataatttcctaacagtgaaactgccctaataatgcygtagtttgtttccaggggagaatatttgccttcagagcaggctccttctgccagctttccatttcataaatgcattttatgactccctcttcagagctcatatacctgtcagaagatcctatgcaatttatccctggggatagttaacattccccctgacccacccaccctgcaatgtcaggtgctctcagaaatggaagtgcaggatctccctcagtgcccatcttttagatcagtagctgtcactgataaaatgtctccttggaactacagagacaaagttgcaagccagccagcgggcccaccctggtatctcctgcagttatcagcattctcactagtgattgatagaacacgttttggagttgttttagttttgtagaatgttcatgggaacttagatgatatctgaggaaatgccttcttcaagtcactagttctaaaggaaggcagccaaattccttcagtctgagaattttggagctctgaagagggcatggacaaatatttcttgcctctcttttttaaatatggaatttggaggctttgtctgtcgaccaccatgccgtgtctttaagaagctctgactgggaaggaaacagccccaagtgttccaagctctgtctgctggaattaaatgtcccttcctgtttcctgacatccacaattctaattcatcctccattcaccctcagtgacttctgttctttgaaggttttgactctgtccttgtacatgaatttgacattcacctgatactctgtggggtccagagagcatgtactccccaccagcttcaactaactctaaaatgtcacagtttctgttaaagtgctttctagctactaccagagtaaacatacagatttgtctcccctgggtgtgctgtgagttcatggcataaagtattttctggttttaaaatggacttctggcctgtaatcccagcactttgggaggccgaggcgggcggatcatgaggtcaggaaatcgagaccatcgtggttaacacggtgaaactccttctctactaaaaatacaaaaaattagctgggcgtggtggcaggcgcctgtagtcccgggaggcggagcttgcagtgagccaagttcacgccactgcactccagcctgggcgaagagcaagactccgtctcaaaaaaaaaaaaggacttctggcttttctactgggaaatgtggttatctgtgccttctggaggtcaagatgtcatcatctggccctggtccctctcacttctcctcagactggacctcttctccagctgtttactcaccttcgtagttgttcacacaatttctccttcatgttttttggagcatctccctaaggtgcatctctagtcaccccaccttctcattcatcctcccaaccaccatggctccacatttatgaactacattcagtctattttcagcctgacatttaggaccttccacaggtagttgccaactttatctgccaataattagcccaagttaccccccagtgtcaaccaaactggaacgctcacatgttctgttcatctggaatacctgtgcctatatctgtctgttgacatcctaagtactccaccccagagcaaggggtttatgggagtagataggggaaaactctggtacaaagttgtaagaacgtgggttgggcttggagaaaatctagatggcatcctggggcaatggagggctcaagaacaatggcaatgtccagtccacaagacaggaggtaggggatttgaagagggaaatcctagcaatgtggttaccagaaacacatagaaacatacctccccttccctaaaatagttattggatataataataattgccttttaataatacatgacttagcaagaggcaaaataagggaattcctcagaggtgagaaataatagaaataatgaaaatctatagaagtaagaaaaccctggggcctggcatttgtctgctaatccctgtttgcctagagcatgggttttaatgagcagtgrgtgcatctaggacaagtacaaaacttggggccactagtgtactttataagatattgattaactttagacttattaagatgaatatgtaacctataatttccaaggtctccactgacagaattgaaataaagcatgtagcttccaaactatagagttggagggaaaaggaatgagagaagggaaaaaaatcaacccaaaagaaggcaagaaagaaagaaaaaaaagaaacctagaaaacataataaacagatagaagcaaaaaaattcaacyctaaactattcataagagaaactcctaaaagtatgagatagagaaaggctgccagtraaacgatgggaaaggacataccagggtaatactctgcaaaaagaactaggtgtgcctatcttaattattaggaaaaactggacttccagaacaaaaagcaacattacagatgagttttcaatttaccagggatacataattttaaatttgtatacccctaacagcataactttgaaatatattttaaaaaattactggaactacggaatattcaaaatcacaaagggacattttcacacatctcacagagggacattttcacacatctctctcaaaattgatgggtcaaatagacaataaatcagtaaggagttaaaaggtttgaagaacacaattaagaagcttgatctaatggacttacacagagcactgaaagcacattctcttcaaatacacatggaatatttacaaaaatgcatcacatactaggccatagagcaaacatcaacaaaattcaaagaatctatatcatacagccaacattctctaacagttaaattagaaatcaataatgaaaaaaataactcagaaaacttcatacttttgaaaattaaaaaaatgcattctaactcatgagtcaaggaaaaagtaaaactagaaattaataaatatttagaactgaattgtcatgaaactactaatgggaactggtgagatacagctaaagcagtattgagggaagattatagccttactgcttatgctagagacaaagtacgtctgcagagtaataaactgagtgtttaactccaaaaattagaaaaagaaaagcaaataaatccaaagaaaggaggagtaaaataatataagcataatataaacttaggagcagaaatcaatggaagaacaactactaaataatagaaagtatccaaaaaatgaaagtcatcattttttctttttcttcaaattattaataaaactgacaaactgcaagcaagatttaaaaaaaaaacagagaagacactgataatcaacatcaagaatgaaaaagagggcatcactatagatgctgcagacatcaactaaaattaaaaacaggatattactgacaacttcatgccaattattttgagcatttagacaaaactcacaaattcctagacaaatgtaatttccatagttaattcaagaataagtacaaaacctgaataagccaataaccatgaaagaaattgaatcattagttaaaattgttatcataaagaaaacatcagactttgatggctytgttaaaagttctacaaaataaccaggaaataaataattctaatcttacacaaactatcccagaatgtataaaaaaaagaaggaaaaccatgttatgcatcagatacatccttgatactaaaactggagagccacaaacagaaaatgtaggtttttcaaaatgaaaatttacaatagcaacaaaatatataagccatcaaagaaagaaaatgaacaaaagggatgtaaaactgttataaaactttaaagacattaagaagacaaatagaaacatatataaacacaccattttcatggataagaacacaatattctaataaaaagatgttcggttccccccaatttaaaatagatattaccacaattctgatcaaaatccaaaaatacttttggagtatatttaaatgattctaaaatttatctgaaagagcaaatggttctgaataatcaaaacactcctgaagaagaaggaagagaaagtgagggaatttgccctaacagatatcaaggattctaaagtaatagcaattaagatagtgtggcattgttgcagagatagacaaatagatcactgaaacaattagaaagccccaaaataaacatataaggaaacttaatatggcacaatccgtaccgcagatcagtggagaaagaggatgtactactaatgaataaatgtttctaggcaatggaaaactgaaaatagaatcctacctcacacccaacacaaaaatcatttcctattctggatgggtrgagaacttaaaaatgaaaataaaatatttttaaaatttagaatagaatttcagagaatatctttgtaatattagggtaaggaaggacttcttaagacataaacagtatggatcttacaggaaaatattcataaatccaactacattgaaagtaaaaacacttattcatcaaaacacacactaaacagggtaaagagatgagccacaaactgggaaatgatatatacaaacttactaacagaagtgtctaaattatgccaagaactcttacaagtcaataagaaaaagacaaatccattgaaaaatgggcaaaatgcatgaacaagaacttcacaaaagagaaaacacacataaatgacaaaaaaatccacatgtaaaaacatacttaatctcacaattagtttcttttaaaactgaaaatgaaatgttagcatttcacactcaccaaatttacaaaaattagtttgacaatatcaagtgctgtagactatgtgaagcaagagaatgactcatatactaacagtgtaagtgtaaattgaaaaggaaaacattttggaattgcacggtaaaattgaacacacacatactctatagcccagcaaaccactcctacattcaaagccttgatagtgttggtagcagcacgtaatagaaaactggaaaccacctaaatgaccattgttggtaaaatggataaataaatacaaagaggtaatatactgcaataaaacatgaaaatactagagctatacacaacagcatagataaatcttatatatgtttgaatggaaaaagcaagctaaagaaatatatctggaggatatggttcaaaagtaggcaatattaaactgtatatctgtacacgtataattgttatatatagtcatatacayatatgtggtaaagtatgaagtggtaaaactgtagaaaagcaaggagtaattaagaggcaagacaggctagtgggtacctctggagggaggaaaagatctgcagtgggcaggggtgtcataaatgggtttccaagatactggtgatatcattcttgcattaaattatggacatatatgtacttattattttcaccctttataatatacatttatgttctgtacaatcttatgtgtgtatggtatatttcacaataaaacagtcaaccaaccaatcaatcaagctagctagaggctaaagaactgaaactagaatccataagatgggtctagtaggttttcaaggataaataagagacaatgaagtttccctgaggctatgatccatgactgaaactagcaaaaagcttcacacttgaatgagaagaaagctttgaagcagggcagagactcctgctggtgcccttggaggttgctggggatgttataactctaggaagtaaatggatgatttgagaaggaaaacttgaacaaaggggtattggctttcttttgtaaccaggaaggtacataatttgcaaacgtgcagatacaaagaagatactgtctttttataaatatgaggcatttgtctcagttacttatacaaataaaagtttattttcccttatatcacaggaaatccagaagaaggcagtgcagagcttgttgagagagttagcaatattttccaaatgtaggctacttccactctgccatttttagtttaggggctttttgccccatgcagctccaaagttctcatctgccttgaatgcagcattagggatattttcccaactctttgtcaacgaagttaaaggcttttctagaactcatccacagccggctactcacatcatagtcatctgaatggtgacacatggacatttcttgcagcaagagagcctggaaaagtaattattttgctattgcagactgtataataggagcaggcaaaagtgaagggggagaggtgtgtattcagcagtgtctgtcaaaatactccactaagaattcttcctcttttatccccaggagccagtctacttgatgacttatacaagtatttcttcttccatcactcccacggagacaccatgactgtcatggatccaaagcagatgaatgttgctgctgctgtttgggctgttgtttcttatgttgttgcagacatggaagaaatgctgcctaggtcctagaaacagtaagaaagaaacgttttcatgcttctggccaggaatcctgggtctgcaactttggaaaactcctcttcacataacaatttcatccaattcatcttcaaagcacaactctatttcatgctttctgttattatctttcttgatactttccaaattctctgattctagaaaaaggaatcattctcccctccctcccmccacatagaatcaacatatggtagggattacagtgggggcatttctttatatcacctcttaaaaacattgtttccmctttaaaagtaaacacttaataaatttttggaagatctctgatttttatgtgttcatttatgaacattaaataygaaaatattatggtttatattatttattgaaggagtagaggaattactcaactttagtatgctcttaattgaatatatggaggcatttgactttctaatttgtatatttttatattatgtgaattttaaaaatgagctttggaattttttaatttatagaaaaaaaggatatcatttggggaaaaaatcaagaatgtataattcaattgccttattaaaggtaaatactagggtctgtcactagataaataataatgctattttgcatttatgttttgttattttacacaacatttccatgaagttggggcttattcacaatttgctgatgacatggttggagctcagagaggctcaataatatttacagagtcgtctagagcaaaaacattaatccccatcctctctggagccaatttctactattctgcctcacacaacatccaatattcaataaaaaattacaagacacaccgaaaaaagaagaagaaataaacttattgtcaagagataaagcaattaagagaacaagactaagagatgacccagaagtttgaacgatcagaggagtttaacctaactatgatgattatgttaaaggtctagtaagaaaaatggactacacacatgaacagaaggggaatttcagcagagctggaaaccataaaatggagtcaaatacaaatgttaaaaaatgcaatgtcagagatataaaatttttttgtcagactcatcagccaattggacaaggctgcagagagcattagtggacttgtatgtaggccaatggaaattatccaaaaagagaagaaagagtaaaaaaaaaaaaaatgccagagtgaatcatccaagaattgtgatacaatatcaagttgtctaatatgtgtgtaactggattttcagaaggagaggacaaagcatcaattgtattaatgataaaaaaatgattgaaagagtgggatctttcatttctgacgaagtagcacaccagtactctgacccttacactgaagatgactaaaaatgctagataatatttgagaaacatcttattaaatatatgaatgaactgattaacaagaatattagacaaaagactaagtatcgaaagactatataccaagagatacatagaatattttttgcttttaaaaggtttttaaacttttaaatatatatatatacatatgtgtgtgtgtgcgtgtgtgtgtgtgtactctgttgcccaggctggagtgcagtggtgcgatcttggttcactgcaacctccacctcccaggctcaggtgatcctcccacttcagcctcctgagtagctgggaccaaagggtgctaaatttttttgtgttttttgtttgtttgtttgtttgtagagatggggtttcgccacattgcccaggctggtcttgaactcctggactcaagcgatcagcctgcctcagcctcccaaagtgctgggattacatgcatgagccactgcgctcagccttaaaaacatacatattttttaattccaatagctttttaggtacaaatggtttttgttacacggatgaattgtatagtggtaaagcctgagattttagtgcacccctcacccaactagcgtgcattgtatccaatatatagtttttttatccctcacctccctctcatcctccctgcttctgagtctccaatgtccattatagcactctgtatgcctttgtatacccatagcttagctcccacttataagtgagaacatacagtattcagttttccattcctgagttacttcacttagaataatggcctctagctccatccaagttgctgcaaaaaacatttcattcttgtttatagcttactcagcagtgttccatggtgtatatataccacattttcttcatccactcatcacttgatgggcagttagattggttctatacctattcaactgtgaattgtgttgcgataaacatatgtatgccagtgtcttttgatataatgacttattttcctttgggtagatacccagtaatggggttgttggatagcatggtagatatacttttggttctttgggaaatctctatactgttttccgtagaggttgtactaatttacattcccaccaatagtgtataagcagtcccttcttaccacatccagtcaacatctattgttttttgactttataataatgggcattctggggccaggcatggtggctcgtgcctgtaatcccagaacttttggaatgcaggaggattgcttcagttcaggagttcaagactagcctggacaatattgtgagacctttactgtacaaaaaataaacataaaaataaattagccaggcatggtggcatgcatctgtggtcccagctacttgggaagctgaggtgggaggatctcttgagcccaggaggtcaaggttgcagtgacctgtgatcatgccactgcactccagcctgggtgacagcaagaccctgtctcaaaaataataataatggccattctgactgcagtaaggtggtatctcattgtggtttcgatttgcattttcttgataattagtgatgttgagcatgtttttataagtttgttggtcatttggagatacataaaacattgaacaagctttctctttgagaaagtttaaggaatgtggtaaacttaaattccattcagagatcaggagattgtagacaaattccagattctgccacattaaggatactatagaactccaacaaaaatgagaccccaaaatattatacctcaatacagtggtgaacaaaaataactctcaggtctgcaaggaaagttaccatgattgagtaaaagctaagtagagggtctgaagaaattcccacttataaagttagataaaatattaactcacaacaaaaaggggaaaaaaagaatcacagcattctgagcaagagcaaacaaaaaaagatcaagaattaacccacagtgtcctctgatattggaattttttggttaaaattatttaagctatgtccattatttcaaggaagtcaaagaagagtttgaaagtagaatagagagcatgggaccataaaaaaaaatgaccaagcatattgtagaaagaaccaaatagaactttagggaatataaattatactcagtgaaattttaaaattcggggacaaatttaaccaatttaatgagagttagtaaactgcaagacaatagtgatgaaatttatgagaatttagcacagaaagacaaagaatggaaaatataaatgaaaggttaagaaatatgaaggatagagttatattgtctaatgtgtttaatcagggtttcagaaaaaagaaaatgggacaaagaattatctgaagacataataaatcaaaattttccagaatttagatacacaaaatcaagaaacccagtgaatcccagacagaataaataaaaagacatattttagagaaactacagaccagaagagacaaaagaagctctttgaagtaagagagaagagatggactatcttgaaaaaagcaacaattggacttttagctaacttcttaacagcaacaatgcaagccagaagatcttccacatgctgagagacaacaattatcaacctaacaactctgtgctcagggaaaatatcttttgaaaacaaggacaaagtaaggatatttttcagattaaaaagtgaaagagttggccagccatggtggctcatgcctgtaattccagcactttggagggtgaggcgggtggatcacctgaggtcaggagttcaagaccagccaagccaacatggcaaaaccccatctctactaaaaaaaaatacaaaaattagctgggtatagtggcacgtgcctgtaatcccagctactagggggctgaggcaggagaatcgcttgaacctgggaggcagaggttgcagcgagccaagatcatgtcactgcactccagtctgggcaacagagtgagactctgtctcagaaaaaaaaaaaaaaaaaagtgaaagagtttactaccagcaggtcttcactacaggaaattagaaaaagtgtcctttaggcaaaattaaatgattatagagtggacactaatatacaagaagtgaggagattggctccaggccaaaatcaaaatctgtatgtgactttccaggcctgactttaggcattacaaaggctttgcctggcaggcgctactgggagaaagctgcccccttgatgtggtttgattgtgtccccacccaaatgtcatcctcaattcccatgtgttgtgggagggacctggtgggaggtaatttaatcatgggggcaggtctttcctgtgctgttctcatgatagtgaataagtctcatgagatctgatggttttataaaggggagcttccctgcacaagctctcatttgtctgccaccatgtgagacgtgcctttcaccttctgctgtgattatgaggcctccccagccatgtggaactgtgagtctattaaacctccttttccttatacattacccagtttcaggtatgtctttatcagcagcctgaaaacagactaatacacctccccacagctgacttagtgctctgccagtgggttacagttttccagaaggagctgcagtcaaggactcaggccgcctagggcagccacccattcctcacccaaacacctccattcaaggcctccttatcttatgaccaagatactttcatccactctgacccagtacttttctagtcctagacttcccctactcccttctgtcagtcccctggaccataaaatgtcaggagtcatttgttcagggctctttggtagtgagatgattttccctgtctgagctgattcatctgacccttgcctactgccattccctggggaaaaaatggaatgttaggaagctggtgcttatttttgcctcttgtttacactatttctgtaagtgattaaggcttgattgttaactttcagtttggcttattgttctgactgaccacctaatcctggccactggacagaaattaagagcaaagaaagtgataaccgttttaaacaaacatagaataaataaaaaccacaataataaggtggtatttgaaaagaaaacaagatggaaagaatatatttcactggaatagcatgtgaataagacgtgaagttactggaattagtgttctaaggtccttttgaaactgcctttgcaaaattataacagtaagaaaaatctgacctagttgactccatctcacttctaaccccaagctgtccttggtcattcctggacataggccaagataactttgagaggaatttagtttacagtttaacttagaagcaagaatgataatagtccctccctgaaactaaccctctccctgttcaatggctgaaactgcctttgtaagactaatgaaaggccacaagattaggattatgggagaggcccaagttctgctaaaatgtaggcatagtttctataatttcttactgctcaggagtcatgtggccagaggtcccaagatttataacttccccaattgcttctataggtatcactgttgtagaacctaagactggggagttttttttttttagatgtttttcagactgatcccatctggactcatgactcagctggtcctgtggctctgcccacaggtggcctcactgcacaaggacagtcttccagtgatgtgatggcattcccaaccaatcagctgcacccattccctagtcccctgcccacaaaactgtccataaaaaccctaacctctgacccttcagggagactgatttgagtgataactccagttcttctgcatagctggcctcatgtcagttaaactctttctttactgcaatgccatggtctcaggcaattgattttgtctgtgcagtgggcagaaagaataaatttaggagctcatatgggatccacccttgtgggtgcctgcttgcagttcattggttccccacaggtccgactgacct

SEQ ID NO: 12218 - DNA, 15075 bp, Homo sapiens
  misc_feature (1)...(15075): n = A,T,C or G, or insertion/deletion polymorphism (see Tables 1-2)
tactctgctttcccaaatgtcagaggaagcagagtggtttacagtcctgaaccttaaggatgcctttttctgcatccctgtacatcctgactctcaattcttgtttgcctttgaagatccttcaaacccaatgtctcaactcacctggactgttttacctcaagggttcagagatagcccccatctatttggccaggcactagcccaagatttgagccagttctcatacctggacactcttgtcttttggtatgcggatgatttacttttagctgcccgttcagaaaccttgtgccatcaagccacccaagtggtctttttataaattttttatttatttatttttgagacagagtctcactctgtcgcccaggctggagtgcagtggcatgatctcggctgactgcaggctctgtctcctgggttcacaccattcttctgcctcagcctcccaagtggctgggactgcaggcgcccgccaccacacctggctaatttttttgtatttttggtagaaacggggtttcactgtgttggccaggatggtctcaatctcctgaccttgtgatctgcccgcctcagcctctcagggtgctgggattgcaggcatgagccactgcgcccagccccacccaagtgttcttaaatttccttgccacctgtggctacaaggtttccaaaccaaaggctcagctcagctaacagcaggttaaattcttaggtctaaaattatccaaaggcaccagggtcctcagtgagaaatgcattcagcctacactggcttatcctcatcccaaaaccctaaagcaactaagagggttccttggcataacaggcttctgccaaacatggattcccaggtacagtgaaatagccaggccattatacacactaattaagaaaactcggaaagccaatacccatttagtaagatggacacctgaagcagaagtggctttccgggccctaaagaaggctctaacccaagtcccagtgttaagcatgccaacagggcaagacttttctttatatgtcacagaaaaagcaggaatagctctaggagtccttacacaggtccgaggggccagcttgtaacctgtggcatacctgagtaaggaaattgatgtagtggcaaagggttggcctcattatttatgggtagtggcagcagtagcagtctcagtatctgaagcagttaaaatgacacagggaagagatcttactgtgtggacatctcgtgatgtgaatggcatactcattgctaaagaagacttgtggctgtcagacaaccgtttgcttaaatatcaggctttattacttgaaggaccagtgctgcaactgcacacctgtgcaactcttaatccagccacatttcttccagaaaatgaagaaaaatagaacataactgtcaacaagtaattgctcaaacctacaccactcgaggggaccttctagaggttcccttgactgattccgacctcaaattgtatactgatggaagtttctttgtagaaaaaggactttaaaaagcgtattatgcagtggtcagtgataatggaatacttgaaagtaatcccctcactccaggaactagtgctcagctggcagaaataatagccctcactcaggcgctagaattaggagaaaggaaaagggtaaatatatatacagactctaaatatgcttacctagtcctccatgcccatgcagcaatatggagagaaagggaattcttaacttctgaaggaacacctatcaaacatcaggaagccattaggagattattattggctgcacagaaatctaaagaggtggcaatcttacactactggggtcatcagaaaggaaagaaaagggaaatagaagggaaccgccaagtggatattgaagccaaaagagccacaaggcaggaccctccataagaaatgcttatagaaggacccctagtatggggtaatcccctccagaaaaccaagccccagtactcagcaagagaaagagaatggggaacctcacaaggacatagtttcctcccctcaggatggctagccactgaagaagggaaaatacttttgtctgcagctaacccatggaaattatttaaacccttcaccaaacctttcacttaggcattgatagcacccatcagatggccaaattattatttactggaccaggccttttcaaaactatcaagcagatagtcagggcctgtgaagtgtgccaaagaaataatcccctgcactgcaggccatacaaatcccctgcactgccaggacacacatttcaatccctgtatctttaacctccttgttaagtttgtctcttccagaatcgaagctgtaaaactacaaatcattcttcaaatggagccccagttgcagtccatgactaagatctaccgtggattcctggaccggcctgctagtccatgctcggatgttgataacatcaaaggcacccctccaaagaaaatctcaatggcatgatgcctactatgccccaattcagcaggaagcaattagagcgatcatcagccaacctccccaacagcacttgggttttcctgttgagagggtgtgactgagagacaggactagctggatttcctaggccgaataagaattcctaagcctagctgggaaggtgaccgcacccacctttaaacacagggcttgcaacttagctcacacccgaccagtcagctagtaaagagagctcactaaaatgctaattaggttaaaacaggaggtaaagaaatagccaatcatctatcacctgagagcacagagggagggacaatgatcgggatataaaacctagacatttgagccggcagcgacaaccccctttgggtcacctcccattttatgggagctctgtttcagtctattaaatcttgcaactgcaaaaaaaaaaaaagttaaatgaacaacatcttcaagaaatataagattgtgtaaagcaaccagatccgcaatgcatggccattcctgagggagaagaaaaagtaagaaatttggaaaacatatttgacggaataattcaggaaacatttcctgattttgttagagttgtagatatcccgataccagaaattctgagaacacctgtgagatattacagaagattaatatcatcaaggcttataattatttgattatccaagttcaatgtgaaaaaacaaatcttaaaagcagctccattgatgggcatttgggttggttccaagtctttgctattgtgaatagtgctgcaataaacatacgtgtgcatgtgtctttatagcagcacgatttataatcctttgggtatatacccagtaatgggacggctgggtcaaatggtatttctagttctagatccttttgatagactggattaagaacatatggcacatatacaccatggaatactatgcagccataaaaaagatgagttcatgtcctttgtagggacatggataaagctggaaaccattattctcagcaaactattgcaaagagaaaaccaaacaccgcatgttctcactcataggtgggaattgaacaatgagaacacatggacacaggaaggggaacatcacacatcggggcctgttgtggggtggggggaagggggagggatagcattaggagatatacctaatgtaaatgacgagttaatgggtgcagcaccccaacaaggcacatgtgtacatatgtaacaaacctgcacattgtgcacatgtaccctcgaacttaaagtataataataaataaaaaaagaaaaaaaaagcagctacagagaatcatcaaattacctatgatggaaatcccactagtcaaacagtggacttctcagcggaaacctaccaagccagtagagattgagagcctgtttttagcctctgtgaagaaaaaaaaaatgccagtaaagaattttatatcctgccaattaagctttataaatgaaaaaacgtaaagtacttcccagataagcaaatgctaagggaattcatcattgaaccagccctacaagaaatgctcatagaagtactaaatatggaaacaaaaaaatgacactgacatcataaaagcacatgtcacatgtgcacatgagcaaaactcacagatcttatctggcaattacatgattgagactacaaagcatatagctaacatcagtgtgacagaaacagaacctcatgtatcagtactaacattgaatgtaaatggcctaaatactgcacttaaaagatataggctggcatattggatgaaaaagcaagacccaactaactgctgcctaagacacccacctaatggttacagacaaaaagcaaaagggggaagaagatgtatcacgcaaatggaacagaaaactgagctactctttaaacaaaagtaaacaaaaaacaaagaagggcattatataatgagaaatataactatcctaaatatatatgcacccaacactggaagaccaaattcataaaacaaatatgactagacctaagaaaatagaaagcaatacaaaaatagtgggaaacgtaaataactcactgacaatactagacagatcacgaaggcaggaaatcaataaactctggacttaaattggacccagaccaaatgaaccgcatagatatttacacaacatttgacaatgttatgtaaatgacagaatatacattttcttatctgcatatagaacattctcccaaattaactacatgcttggccatatagcaaggctcaatacacttgaaaaaataataattatatcaagtatctaattggaccacagtgggataaatgtagaaatcgatatgaagaggaactctcaaaacaacacaaatacatgggaactaaataacttgctcctgcatgacttttgggtaaacaatgaaattaaggcagaaataaaataatatttttgaaacacaaaaatggggacacaacataccaaaactcctgggatgcaacaatagcagtattaagaggaaaaatcatggcattaaatgccttcatccaaaagagagaaaaatccccaactaacaacctaatgctccacttcaaggaagtagaaaaacaagaaaaaaaaaaaaaaaacactaaacctaaagctagcagaataaaagaaataactaacaccaaagcagcactaaatgaaattaagattaaaataattatacaatcattaaaatgaaaagtttgttctttgaaaggatagacaaaattgatagaccaccaactagattaattgagaagacagctgactcaaataaacacaatcagaaatgatagtgttgacattacaaccaatatcacagaaacagaaaagatcatcagagactattatgaacacaaactagaaaacctagaaaacatggatacttcctggacacatacaacctcccaagattgaaccagaaagaaatggaaatcctaaacagaccaataacaagtaatgaatttgaatctgtaatacaaaatatccaacaaaaatggcccaggaccagattgattcacagctggattttaccagacatacaaaaaacttgtcccaatcttacttaaattatgccaaaaaatcaaggaagaacaattcctctctaactcattctatgaaagcagtatcacctgatacaaatattatgcaaggaaagaataaaaaaaccttacaagctaacatacctggtgcatactgatgcataaatccacaataaaatattagcaaatttaaacaaacagtacatcaagccatgtgggtttgataccagagattcaaggatggttcaacatatgcaaatcaataatgtaattaaccacataaacagaataaaaaacaaacactacatgatcatctcaattgatgaagaaaaacgacttgataaaatccaacatttcttcacaaccaactaggcatttaatatacatacctcaaattaataaaagccatctatgacaaacccatagccaacatcatactgaatgaggataaggttaaagcattcctcctaagaactgaacaggatattggtggtgtccatcgtgggcagcagactaataaaggccatggcaccagcagaaatcctgaacaggaaggagatctccgcacaaataagggcgagactgaagaatcaagtcactcagttgaaggacaagtacctggtttcacaccaggcctggcaatattacaggttggcaacagagatgattccaatctttatataatgtgaagctgaaggctgctgaagagattgggatgaaagccactgacattaagttaccaagaacaaccacagaatctgaggtgatcaagtacatcatatctttgaatgaagactctactgtacacrggttcgtagtgcagctatctctagactcagacaatacactgaaggagtgatcaatgctattgcacctgaaaaggatgtggatggattgactagcatcagtgctgggaaacttgctagaggtgacctaaatgactgtttcattccttgtatgcctaaaggatgcttggaactcatgaaagagacaggggtgcagattgccagaaggcatgctgtggtggttgggtgcagtaaaatagtcagggccctgatgygtgacttgcttctgtggaacaatgccacagtgaccacctgccactccaagactgccaatctggatgaggaggtaaataaaggcgacatcctggtggttgcaactggtyggcctgaaatggttaaaggggaatggatcaaacctagcaatagtcatcaactgtggaatcaattatgtcccagatgataaaaaaaacaaatgggagaaaagttgtgggtgatgtggcatacgacgaggcccgttcctggtggcttagggctcatgacggttgcaatgctcatgcagagcactgtagagagtgccaagcrtttcctggagaaatttaagccaggaaagtggatgattcagtataacaaccttaacctcaagacacctgttccaagtgacattgatatatcacgatcttgtaaaccgaagcccattggtaagctggcttgagtaattggtctgctgtctgaagaggtagaattatatggtgaaacaaaggccaaagttctgctgtcagcactagaacgcctgaagcaccagcctgttgggaaatatcaggtggtgactggaataactccaacacccctgggagaagggaaaagcacgactacaatcgggctggtgcaagcccttcttgcccatctttaccagaacttttttatgtgtgtgcgacagccttctcagggccccacctttggaataaaaggtggtgttgcaggaggcggctactcccaggtcattcctatggaagagtttaatcttcacctcacaggtgacatccatgccatcactgtatctaataaccttgttgctgcggctattgatgctcagatatttcatgaactgacccagacagacaaggctacctttactcatttggtgccatcagtaaatggagtgagaaagttctctgatatccacatacaaaggttaaacagactaggcattgacaagactgactctaccacactgacagatgaagagataaacagatttgcaagattggacattgatccagaaaccatagcttggcaaagagtgttgaataccaatgatagattcctgaggaagatcacgattggacaggctccaacgaagaaaagtcacacacagacggtccactttgatatctctgtggccagtgaaattatggctgtcctggctctcaccacttctctagaagacaggagagagagactgggcaaaatggtggtggcatccagtaagaaaggagaccccgtcagtgctgaagatctgggggtgagtggtgcattgatagtgcttatgaaggacacaatcaagcccaatctcatgcagagattggagggcactccagtgtttgtccatgcaggcccatttgccawcatcgcacacggcaattcctctatcattgcagaccggatcacactctagcttgttggcccagaagggtttgtagtgacggaggcgggatttggagcagacattggaatagaaaagtttcttaacatcaaatcccagtattccggtctccaccctcacgtggtggtgcttgttgccactgtcagcrctctaaagatgcacaggggtggccctatggtcactgctggaatgcctcttcccaaggcttacatagaggagaacctggagctggttgaaaaagkcttcagtaacttgaagaaacaaactgaaaatgccagaatgtttggaattccagtagtagtggccgtgaatgcattcaagayagatacagagactgagctggacctcatcggctgcctttccagagaacagagggcttttgatgccgtgaagtgcactcactggcagaagggggcaagggtaccttagccctggctcaggctgtccagagagcaggacaagcacccagcagcttccaactcctttatgacctcaagctcccagttgaggataaaatcaggatcattgcacagaagatctatggagcagacaacattgaattactcctcaaagctcaacacaaagctgaagtctacacaaagcagggctttgggaatctccccatctgcatggccaaaacacacttgtccttgtctcacaacccagagcgaaaaggtgtccctacaggattcattctgcccattcgcaacatccatgccarcatcggggctggttttctgtaccctttagtaggaacgatgagcacaatggactccccacccagccctgtttttatgatactgatttggaccctgaaacagaacaggtgaatggatcattctaaacagatcatcatccatcttcaagaagctactttgaaaatctggccagtgtctattcaggcccactgggagttaggaagtataaggcagccaagagtcagcccctgcccagaagatctgaaactaatagtaggagttttcccggatgtcattttcagccttaattctcatcgtgtataaattaacataaatcatgcacatgtctatttacgttagtgacgttccacagaataaaaggaaatagttttgccaaaaacaaaaaacaaacaaacaaaaaaaacaagaactgaaaaaagacaaggatctccactctcaccactcctattcaacatagtactggcagttctagccagaggaaagggatccaaatttaaaaagaagtagtcatgttatctctgcttgctgatgacatacctagaaaacctagactttacataaaattcctatatttgataaacaattttggtaaagtttcaggataccaaatcaatgtaaataaagtcagtagcatttcgatacaccaatagcattaaacctaagaaacaaataaaaaattccatcccatttacactagccatttacaaaaataaaatactagaaatatgtttaaccaaggaggttaaagatcactataaggagaaatacaaaacactgatataataaatcatagatgccagaaatagaaaaagatcttatgctcatggactggaagtatcactagttaaaacgaccatactgccaagagcaatctacagactaaacataactcctatcattacaaagataatttttcacagaattagaaaaaaaatcctagaatacatataaaacaaaaaaagagcctgaagagccaaataaatttttcataaaaagaaaaaagaggccccacattatctgacttcaaaatatactaaaaaactatagtaacaaagactgtatggtaatggtaaaaaaatggagacatagaatggaaccaaatagagaatcaagaaataaagccacatacctataaaaaactgaactttgacaaagttgacaaaaataaacagtgaagaaaggatatgaaatattgctttactgaatagcaataaagagttctggcaaaattggctagccatattcagaataatgaaactggacccctctctctcaccatatacaaaaatgaactcaagtttcatttatgacttaaatgtaagacctcaaacaagaaaaatcctaagaaaaaaaaatagaaaaaacttctgacattgagggaaataatttatgactaagacctcaaaagcaaatgcaacgaaaacaaaagtacacaaatggaacataaactattttagcttctgtacagcaaaggaaataatcaacagagcaaaaagacaaactacagaagagaagaaaatatttgcaaattatgcctctgaaaatggtctaatatccacagtctacaagaaaccaaaacaaatcaacaaaaaaaaccccattaaaaagtgagcaaaaaacatgaatagacatttcttaaaataagacatgcaattagctacaaaaaaaaattatgaaaaggtgctcaacatcactagtcatcagagaaatgtaaattaaaaccacaatgagataccatcttacaccagtcagaatggctattttttaaggtaaaaaataacagttgttggcgagaatgcagaaaaaaaggaatgcttatacactgttggcatattgtaaagtagtaaaatttctgtggaaaacagtatggaggtttctcaaagaaccaaaataaagctaccattcagcactgcatttccactcctgactatctaaccaaaagaaaaaaattattatatcaaaaagacacctaaacttgtgtgttgtgtttattgcaacactatttacaatagcagtcatggaataaacctaagtttttatcaatggttgactggataaagaaatgtgatatataaacaccacagaatactatacggccataaaaaatgaaagcatgccctttgcaaccacgtggatttagcttgaggccattatcctaagttaaacaactcagaaacagaaagtctgtttctcacttataagtggaaactaaacaatggatacacttggacaagtaggcagaaataattgacactggcaactcaaaaatatggaagggtgggaggtagatgagggctgaaaaattacctgtgggataaaatgttcactgtttgcatgactggtacactagaagcccaaacttcaccattacacaatatatccatttaacaacatgcacaagtaccctttcaatctaaaataataaaaaataaagtacaataaatataagacttgactgtgaaattcctagaggaaaatagagagaaaaagctccgtgacattggtcttggcaattgttttttgcatgtatctccgaaagcacaggctaataaagcaaaaatagacaaattggtttagagcaaactaaaaagtattttcacacaaagaaaacaatataaaatacaaaggcaacctactgaatgggataaaacatttgtaaaacatatatttgatataggattaatattcaaaatatacaaggaattcatagaacttatcagaaacaaataacttaattgaaaaattggcaaacaacctgaatagacatttcttcaaaggagacatgcaactggcccctaggtatatgaaaaaaaaaaatcaacaacactaatcatcaggtgaatgcacaccaaagccaagatgagatgtcacctcccacccaatagcatagctattatttttttttaaaggtaagtgttggtgaggacagggagaaaagggaaaccttgtacactgtggtagaaatgtaaatttgtacagccattcaaaacattaaaaatagaactaccatatgatccagcaatgctacgtctagtaatatatttgaagtaattcaaatcaggatctctaagaagtaactgcaatcccatgttctctgcagtattatatataattgctaagatattaaaacatcctaagtgtgtgttgatggatggataaagaaaatgctgtatatacatgcactggaatattattcagccttaaaagtatagaaaattttgcaattttcaacaatatagatggacctgaagggcattatgttaagtgaaataaaccagacacagaaaaacaaatgttttataatatcatttatttatgtaatctaaaaaagtcaaattcctagaagtagagagtagaatcgtagttgccaggaattggggtggggtaaggggatgaaataaagctatattggtcagagggtacaaactttcatttgtattagtcattatatattatatatgtatatatatatatgtgtgtgtgtgtgtaggtgtgtgtgtgtgtgcgtgtgtatgtgtgtgtgtaagggtactaaaattagggtactccannnnnnnnnnnnnnnnnnnnnnnnnnnnnnnnnnnnnnnnnnngagtaccataacaaacccactttggaagacaatctcaagatttctaacaaagcaaagtatattgtgttccttggtactacctaattgaatagaaaacatgtctatggaaaaggtgcacataaatgattataacagcttttgttcaaagataacaatattttgaaacaaccaagatgtcctttactaggtaaataggtaaaaaatggtggcacatccttaaaatgaaatattattcagagataaaaagagttaccaagccacgaaaagacatggagggaacttaaatgcgtatttcaatgtgaaagaagcaagtataaaacggttacataatttagattctaaatatatgatattaggggaaaggcaaaagtataaagacagtaaaaaatctgtggtttccagtaggagtggagagaatgtatgaataaataagtgatgcacagaagttttttgagtggtaaaaactactattctgtatgatattgtaatgatagttacatggcattatgcatttgtcaaatgctgtaaaactgtacaatataaacactaatgtaaactatggagtttagttaataatatatcaatattgtttcatcagtcatgaaacatgtaccctactagtgaaagaaagaggggctacccatggacactgtactatctgctcaatcttttggtaaatatataactgttctaaaaataaaatctgctaataaaaaaatccaacagcacacaaggccttggcatatttttctacaaaataggtaaaagtaaggtgttgctaggaaatatagaaatgataaaaagacctggattataaaatatcccccacaaagtttgatgtcctaactcctttccttttattctgacttagaaagaattacagaccaacatcagttagcaactattgagtttctgctacaaaatcaaaaaagctccctctttatattgaacctgaaagtggataaagttcaaattgctatataaagttattaactttagagaaatatttaaatgtattatgccatattaaaattctggaatactaaatccttaatatttttattctcctgagtcaaaagttttcatttcttcttggctatttattctgacaggagaaccttaacatcattttctcaacttccataataaaagttgctaatttgattttaattgctataaaatatagccatcctgtcctaaaacatggtatttttctgacaatagcttgggaatggtggaggtggcacacatccttaccccacctccaatgatgtaataatgtctttctctatttacctcctccctcctcagatacacacatcactcattctcatgttcctccacttcctccttttcagaaaatatacagaaacaaagatacataaattaatttatgcaatgacagattatagaacagcaggcctgttggtgtttcagaaatgcatttatcactgtgatggaattttggagtgtgcctaggaactttataaaatggaatgatatttgtaatcccagtgacagggattatataggctatgggatctatccaccaacaactcaagctataaaactaagtttctttttttattcaaaactcattttaggactcttagtaaagttctgtaatttttctctggtaggttctacaaccttatttttagagtctgtaggcattttgtaggattttctgtttgtcttctctgttttcctcattctactttttatctggttattgctgatatgttagctatggtttttctcattttcatcgtacatcctattttaggttgaactcatttattctaagagttttaaaatagcactccttgagttttacaagaatatactcatatcttaatctataaataattattgatttgtcttttttcatagtcatacctcttatttctaatttatccttggcatactttctataaataataatggtgatggttagcatgcttatctaactttatattttaaagagattgccctggatttcatgcatataatataaaaagaacatagtatggcaaaaaataatttttaatcagaaacagacatctgaattttataaaatgctttctggaaaaatatttaggttataaaatttctcttatggaaccaacttgtaaagcatacaacagtagtatagatccttgtattccatacaccaatcttcactagagcctgttctaaacttatccaatatgaaatgaaactcctaaatgaattcacatgtatttcaatctgtctcttttttagcatgtgactattttaaactattatttcaaactaaactattctgtgatagctctccctgctacctgatgccaacaggtgatgaggtctgcaacactgtcacttctgacactgcagagaaagtttcaataacagtgagactcttgattagtatcaacagtgaaaaaacccatttaggaaaattggcttttcatacacatgaatttcaggccagcaaaaatatggttttaataccgtaaagggaagggtttggggtcagaatattaaattggctagagaatttggtaatgaagagtctgtacattaagttattagaatttttgctaaagctacagaacaggaagggaggtaattctactgtgagagcaaattacattggactaaaagttcaatgtaagtaatttacttccattcacttacttttttcctcctgctcctggcttcataattttgcatttatcctccagctcgccaggaaagtaccaatttgctttgccactagcattctatggtttatca

SEQ ID NO: 12219 - DNA, 84311 bp, Homo sapiens
tgggggagaatataatgtcgtcacgcctcaaggcaggataccttctgggtttgccttgatgaccgcaggtgactaagatgaccattttccttccttttggtattggccaacctccattctacaaatattcttcctgctgaaagcattagcagtgtagcctgggttttcttttccctctcctacctctgggattggctgtggctttgcacacacaacagcatacacacaaattcttacaccaacttgcagaggttcacatggggagagagttctaactaccataatctgtggccacatcaacataaacaataattttgttcaagtgagatgcggaaggagatgggatcagaaaattcccaatatgctagggaaagcttggacttccttggaggttgatgctagggacacatacctctcctgaacaaaaggaagtctgaggctctcaggcacaagcaggtagatatacatacccttgggacggagagactgcatcaagcccacagttggctgtgcttgtcctaactctattctatccagggaaaaagatttctctttcctataaagtgctgagattcctaccatgtaggggccttctgcgaccaaggggttgatcaccaggtagctatctcatgctggtatctcattaagccaaatccttgcaaagtaaaagattttcttccatccctttttccactttttttttttctcatttttttttgttctactcctcagctgctgctggttcttgggaggctgctttgttttgctatttttgagttgacttgcttaaataataaacccaccctcttgtagaggattaagcagacaattaggaaatcaatcaatcaattggtgtcagctgcaggcagaggccggtgaaaggcctcatcttcccggtggccctttccaacctcaaaacctgctgaggctctgggccgcgcaggcggcgggagctctcagcttcatttgcttccatttcagagccttgaggctgggacaaatccaggaatggagaaatgagggagcagggaggagtgtgtggcggcttcaaagttttgttcttggtggagtaggaaatgagaggctgaggcagggtggtcagtggctcctggctatgccattgcccagctggccggtatgttgccagcttcctctttaggaaacatgggagggaaggctgcctggcccaccagtgtggggaacggctgggacacaggtgccaattacagggctattcactcacctggctggactgagctgaggaggagaagaaaaaaggagcagggagtgaggggctgggcctctagaagccgaggcagcctttgtacttgcagagacaattccccccaagagtgagggccgagcgcagaaagtcgccaggaactctcagcatggcacagtcatcccgaggccctagccccgccggggagcaccaacttggggccctggggacacctctctggacatccctgacaccgtcagctagagcccaggcctctcacaggcctggacttgggccgcttccctggcaggaggggccccacacgccccctcactagggtcagctttctccccagctaagagattgtgccttcaagctttggcttcacaaagagtgagagaaaccgcatgtggcttctcctgagaggggaaaagaactgcgtctacggaggaagcaggaagagctcttttatcagtatttttaagaagggttgttttaaaggagaaaataaggtcttgactggaacccaggtagtctggagctctgcgtcgggaaccagatctgcccccagataccctgactcactccagaagacagcatctgaggtctgtgctctccttcctatcactccctgcagtggtggcggtgatgagggtcttgggtacccaaccttggaaagaagatatcaggtctttctgatggcacagttacccgtgcctccacttctccccaacagaagctggggcagcggtttgtttgcagagacataagaccggctttgcccaagcaaattggcagggctccctccctaggctgacccagctcacgtaggaccatgaaagccacgtctgtctaagctgttagaactcccagtgcatccaggggggcttgggcaccatttgagtttgggtggagagcctgctggagtaggatggtggggcctcaccaggcttccaggtgccctaggactgggaatggtaaagttggctcagacctctcatatagagtgcaaggtgaaatgaaagttgggggttgaggtgtcaggtgggggattatagattctaggctggtgacccaggccgaggtgggcttctttcttggtggagaagagcagtcgagttgtgcatgaacaatggctgatccgaattccatgtggtgtctttggctcactgtcccgggccctggtttggtctaggagagtctgtctacgacagggggacacgaggcagcttcatcttccctaaactgatgcatctgaggcaggggcccaactgttgcccatgtcctgatatccacctggaaggtctgcagggtcatcttcctccaagatctctcctggtgagatcagaacttcagggaggtgaagcaggggatcccatcgcttcaccccaaaaacccacccagccctagcagtaaaaaggacaggacacagccctggggtacatgtttatgtgagtaataaaatatttactataacataaatataaagggaacttcccagtctacattatttttttttcaataaagatacaaagagaatgcaccgaaacattgtttcaaaaaataataaaaataaaataacaaaatttaaattcaaaccttaacaaacagaagaagaaacggagaagggggaagctccaaacacatccagaaaataaatagagatgggtcagaaattcggaaatcatattaaaatatctttttcggattagtcagtgtacaaaatcctttagggtaggaaggaagggtaacccggaaaaccaaaaataaaaaccaagcacaaaatgtttcttctccccgccagtgtgtacatatctcacatatttacatggttcccacctcaccccaaacttggggaatttctctcccggcctcccctggcatcccgcatcccggcgggctggaaagggagcagagggaagctgcagggaatcaggcggagggttctcagggaacggcttatttctacagctggttaaaaaacaatctctctaacttttccaagtttcgtttggtgtggccaggagggcagggccccgcggggagcaggggccgcgctatgcggcggtcggtctgcagcagggcagargccccttcccgtctgggtgtgtgggagcgcagacccctccggcgtggccgggaaccaagccggggctcggatgaaacgaaacgaaaaatgaacactcgaattttttttgttagtttttttttttttttttgcttttttttggggggagggtagggtagggaaatataaggggaaaaataaattaggctagattaaagctttggctatttcctgcttttatacacagacgcggctctcgcgacctcccctccggggccccgataaatacagtatactgcgatttaaattaagggcgcgggcggagttagaaggaccccaggagccgagaggctccacgaataaataaaaaccgtaaaaaaccaagcccggagaaaggggaaagcggggtggggcgcatccttataggagagaagaggcgtgtagcgaataaagtgacagccccccaccctggacccgcaggctcaggagtccacgcggggagaggggatggagaactctcctcgcttcgtcctctctcccggggaatccctaaccccgcactgcgttacctgtcgctttggggaggccgctgccgggatccggccccgaacagcccgggggggcaggggcgggggtcgtcgaggggatgggggcagagagcaggcggcgggcaggatgcccggggtgagttggcgagttccggatcttcgctcctctctcccggggctcgggcgacgcagcctaccgggctgtcttcgccgctcaccggagagggtcgtccgggtgtttggttttgttcgaaagtttctgggcttttttttttttttgtaaaatccaaagcaaccgaacaaaaagagtccaggccgcgcgggcgggctgcgcgcccgcgccctgcagcgcgccggcgggggcccggcccgcggggtcactgcactgagccgggcagtgtgtggtggtggtggtggtgcagcgccgccggcgggggcggtgggggcgcggagggtggcgatgcgccgcccccgccaggccctagctccccaggcgcgtatacatcgtccatgggcgggtggcccgcgccggccgcaggggtcatgcgcttctccttctgccgccggttgcagaaccagacgcgcaccacctccttctccagctgcaggctgtctgccaagccggtgatctcgtgcgccgagggcttggggcacttgagaaagtggctctcgagcgcgcctttgacccccacctcgatggacgtgcgcttcttgcgcttgcggccctgcgccgcgatcttgtccaggttggtggggctgccgctggacgagtcggtctcctccagccacttgttgagcagcggcttgagcttgcacatgttcttgaagctcagctgcagggcctcgaagcggcagatggtggtctgcgagaacacgttaccgtagagcgtgcccagcgccagccccacgtcggcctgcgtaaagcccagcttgatgcgccgctgcttgaactgcttggcgaactgctccaggtcgtccgagctgggcgcatcctcgtccgagtgctcgcccaccgatgagccgccgccgcccgcgcccgggtgcaggtgcgccgccgccgcgtgcaggccgcccgcgtgtgcatgtccgtgtgcgtgtccgtgggcgcccagatgcggcggcggcgacggctccagctgcgcctcgtggccatcctcgtgcagcgcgtggtgcaggcccggccccgcgccgccaccgcccgccgccagcatcccggccaggccgccgccgccgccccccgggtaggccgcctgcgcgtacagcccgagcggctggggctggtggcccccgctggccccgggcgagggcgacatggccgggcccaagtggtgcgctgtgctgccctgcgcccatgccgcgcccgcgtgggccgccccctggtgcaccaggcgcgcgtggaaacctccgccgccgccgccgtcgtcggctcggccggtgccgccgccgcctgccttgccgtgttctaggtgcgggccgccggcccaatcgccgccgccgcctcctcccgtgggtagccactgggggtgcgctaggcccacggggtggcccgcgcccgcgcccagccactcgtggtgcatcagcttctgcacttcgcggtacgcggcccctgcatgcaatcgctccgcggccgccgccgccgccgccgccgccgcggcgtccgggtgcataagcggcccggtgcccccggctccgccaccggggccccgcggcaggtactgcgcggtggtggccatgccgccccgcgccctgcgccgcgccgccgccgccgctccgctccgtctgcgggccccgccgcctcgctccgccggcttaaagccccgacccgctcggcgctccggagccccaccccgcccgccgcccattggctgcccgcggagctgcctcccgcctcccctgcccggcccccgccccgcgcgcccgcccgccaccctgcccggccgcccagagctctccattgggcgtcgctcccggggtcccgcgcgccggccgtgctgattggccgctggggcttcattcacggcccccctaccgtccgcgtacacactcacgccccgggggcgcggccgccacgtggggagtggcgcgggggtggccctgggaccgcaccccctctcgtcctggctgtgtgggccccgctttcccccagcgctggagactccgagcccggccggtcccacattccacgcgagctgaattcccgcccgcatcccgcccgggcagcagggattgccggctccgggaggcgctcgggctccgagaagcggctcagccccgcgcccctccctcctcagtaccgctgccggcggaccaggattcccgcgggtcctggcggctgcgagcgcgaggcggcgcggattcgcggctcggttccggcgcgactgctcaccgcgcccgcctcgcctcccgcggctgccagcgtgcactgggcgctcctcggcgcgtctgcccggcccgtctcggctttccttctccttcctctagtcccagcgtcacaactccgccgacctcctctgccctgagagcgcgtccggtgcgggcggagtcggacggactctggcttcacgcctcgcgcgggcacaccttctcccgggcactgaggcccaggtgagtaccgcgcgggcagctggggctgggacggcgggcggcagcggttctacagtcctacgcgagcccctggtacccggccgcgctccggggttccagaaggagaagatctcgaggtggagactgtggctccggggraaacgctgctggcaagggcgctagttgggggtggacgttgggcccaggggtatctgacctgcgccgctgcagccttctcgctccttctcccagcttgaacggctcatcggctgtggtcgtggtgggatcacgccccgggagaggagaaggatgggctcagggaaggggctcgggctctccagaaatccggcgtgcaggccgggagctgtccagcctcgctaagagccctgggctagagtttgcccggacttgcctggagctgctgaaaagggaattgagattgaggaggccttgttggaaaggtgggcagtggaatttagctacctcctcacgccccagcccttgaggactccctgaaggatcttgagtggagtcggacctcactgcagttcctttgtgccttcttacccgaccttgggccccaggctgagggtactgagctgtgttttctcctcttccccacaccgaggcttgggtcccagggagtcttcagctgccagtcctccctcttttctctcctggatctagcctcaagtggatttatagcttacagggccctggggtcccagatcacagaactgagctgggggcccacctagggccccactgggcaaatcaggtctgtggaataaatccttagattgaaaaaagttgctgggggctcaggtggcagctgccattggaacgatccagggcggctgggacagagttgacagtgacaggggtcaccctgggcacagactttgatcatgtgggccctgaatgccctaggaccagccagggaaggagtgggacagagcagggcccttatcctgccattggccactgtcctgagcaggctccgtggtcccaccctagctgtaagagctgcgatggagctctgtgtctgaaccgagctagagatactgggctttcctggactctggcccagggaatggtcaccttgaggcagcccaggtctttcacctttcccaggcctgggaggtaggaggaagactgggaattccgcagtgaagtccatgctcgtgycagccctaaccaggcctgtgtgatattgaagcttgggctttcaacctggagctgccatcatctccctgggcaagagtaactctggtctagccttcctagctcttggttttccttcctgtatgttgggaataacagtactataggcagcccacctgtctcactaaggtaggtcagatagttatgtgagacaacgggggtgtaaagctctcagataggtgtttactttggtcgtttccattgttgctgttcagtgacaggcaaggcattccccctctctaactaaatctcagtttctccacctgtagcgtgggattgcagaggtttggaccagtcgacctctctggcacttctcactctcatggtctgtgattctgtgaatctgtctcagttcctgttgaaggaagtctggacagcgggcaggtgttttgatttccagcctttggaattgccactgaggctggaagaacaatgaccaacaggcacggattttttttttttttttaaattatactttaagttctgggatacatgaacagaatgtgcaggtttgttacataggtatacatacaggcacagtgttttagcaagtacttttacctgtacctctcagccctgtgagagagcactgagattattatcttcattgcctagatgagggacccaaaatttgtccaagggcacaggacctgtgagttttcactcatcattcccctcattaccgtgggatgggggtctatggaggcagcagctttggctggcacagcaaagagagcccttggccctgtttctggtaggtctcaagggcaggccagggcctgctggggctcctgaaaccgtcttcccatgtctgtgctgaattgaggggcatcagcagtagagcagtagcgaggcttctaggttatcagcttgtcacccagcaaatcaaagtcccaatcccaccatgtcctttagcagccctgtgactttgtgtgagccacattgcctcttggagcctaagtttgtgcatcttacagtgagaacaataatgcctgcttttcaggattgctctgaggctccacagatgaaataaggcatgcaatttaggtgccctttaaatgttagatgctggcctgggctggaaagcagtttgaagcaggaaagatataattcttttctctgctttggaaattttagaccttctacagggatatgggtttggtcttgagtcagaattttcttgtgtttgagttaagtttcccccaggaagtcttgacatcactcttaagattctgtgtgggacactagggctgagacatggccactggtagaaacatctgcagctgagcaacccctttgtcctgcagcaccaccttcttaggccctggggagaactcatcctcagacccacaacacgtaggcagggtgtacacacagaggtcagacatccacgtgacccatgcagacacagagtggtgtgggcatgagaacaggtgtgcacacacacacacacacacacacacacagatacaaccatgcaatttagcacaggactgaatgtacggattcacaataggaacacacaaacttgcaccattaggctgaatattgatagtcacacaaagcaacacccagtggtaaatacaggcatgtgtctaaatggggagatacacagaacccacacataggctgaaataggctgaagtaggcactgctttgctgacacagagatacatgaaacctaacaggctcttggggccacaaacatggagactctcagctggtgtgccgagtcacacacataggcataccatcatactcacacacaagagcacgtggagccagccatgcacaccctctcacccagatgcacaaagaggcttaccccacacatcacagagacacacagacatatctacccacaccctgtaagaaataacagatccgctcaggggatcagaaagcagaggaaagggctgtgtccaacccagagtttggtccacatggtttggttgcagcgctaggcccaaggcttttcttttcatattttttcccactctccttttctgtggagtgcagctcccagccaggccgccgccagtttcagagtctccygggcctccctccccagyggggcctctgcccagccygcccccaggcaggagctgcttgggctttcccagagcacagcagcctcctccaggctctggagtgtgaccgagcgcctactcatttgacacaggtcaccgagcctccagcagatggggccctcgctgtggggggtctctgagccrggggctgtgggrggctgggagtaggagggaggctctgcagggatggacaggctacacaagctccagctccttatactctttctgcaaagccccgggttacagacgtgggacctagaatacaactatactcacgagtcagtcgtcatcagcaccctggcggccacatacacagggcagtattccagacacacatcccaggtgtcagggggcctaacaatggcacgccgagcacagctttgggaaggagaaagaggaagagccttgctcagcgtctcctggaggcagctgggtctggctgctttccccctttggtctctgagcccccgagctctcttctgtgagttggtcagttggttaggagtccaggatgggttgagagcagatgcagtttcagacctcaggccttttcagtgctgggggaagacaggctccaggatgctccacctggattcctcacaagtcaggaatgctaagagatgaagaggagagatggggcccatgggaagtgctgccggacaggctgtgtatcttaggatgcctcccgcatgcatggactttgagtctttgaggctggctggaccggggcagcactcgcgggccacttcctttccctcctggcagtctccttatgccctggatcttgccttttcagagtggcctggcttggcagtaaagggtcctgggttccatcttggccctgactcaggcctcattttgggccagtgtcagcctcctaaccctctgtatcctcatctgaaagttgggcaatatggtctctgttggctgcttgagaagatgggggtgagatcactgcttgaagaaaacttggaaagggaaagtgtggcttgatttccctccctggccggccatctggggtgggtaagaggctgtgtgagcaggcgtggaacctgcctgctcccctaaccagttcttgctaaagagtgtcaggagggaccacgcccactggggcttgctgcccgcgcattctgagctgcaatgtggttttgactggaagagtctggcagggtcctagctgtcataaattcccagtcttaggagggtgccagggtcatcttattgatccactgccttggcgagggtgggtgccatctagacagatttgtagtgcttgccaccatcctaaagctctccccgcataggatgagctcacccttctgagccctcaaagcccctacgtctctccctctaagctcagccccttcaggtgtccagttcttctgtccttcctgtratctttagagcccaaggcagaagagaggagtagtagtagggccgtcgctgcctttggcagaagagaaaggagcgatctaacttatttaatctcaggtcttggtgaagggaaggagggacagaaggtgaaatatctctttgggaagaatctttccttgtatttttgttttcctgcctcagcccctaggctgtgggtgtgggtaggggtcctcccagagtgtcagtagaatattcaaattaggggtggtcaattgctcttgaaatttactttcatttttagcagaatgtcagcctttgagctggtgttaatgcccacaatccggttatgcagaacacgctctctgcaaatcggtaaatcattagtggggattaatcaactctgaaaggctggggctaggctttagtttctttctttctttctttcttttttttaaaacatactttttatccggatggctgcaaaattcaccatcacaggatagggtgggagcaggggatgataatttaagtccttgtcaccatcattagaaaagtgagatacctttctgggccttgggttgactttgtagtccaattgaagggtgggagtaggcagtttgggtggggtgggaggaagggagggcagttcccttgtgattatatgtgttatgatgtttataatagtgtgtaggtggcttggtgtgcttgtatatatggtgactttatgttagcatgcttgcatgaattcatacgtttctactttagagatgcccatttatgtgcttgtgttagggtgcttttgcttggtttgtattagtgtcagacacttggtttgtaattgtgtcagacagtacttccgtttgagagtgttttgggatactgttttattgtgtgtgtgagtacttcccctctggtgggagaccacatctcaccctcctcagcctcagggtagctccctaggggaggaaggtagaacaggagggcagtcccaaccagcacctgctgggggggtgtggctcaaggttgatttgcatattcatgagctagctgcctggtggcttggggagctctcctcttgaagagactcagtctgagcccaagtgggagacctcttagggcagatagggaggtcaggctctcactgttaacacctcttactccccagtctcaggtatagtggctgcctccaccccatggctcaggaacctccaaaacccgcagttcctgaaacctgacctctgcatagccacagtacacataattctagcttccaatagggataagagtgatgtggccgctcctatcaggaagctgtcagttcctggacgctcctgtgggggatcttggggaaggaagcttattcttccagccaggatcaagctgataaatgggaccatctccccattctctgttcacactggatcagcctccktattcctctccttctccctagcttaatgcagcccagctttggagtagtaattaccttcacatgacccagtaatcatattccctgggtgttgagcagagcatgtgtgtacggggatgaggtcacaggactttcccttcccctctagtcacagagtgtgaggtttgaggtgggatttaatgggcctggtccttacatcaacccacattttcctctaaccacccccacctccctctcccaatatagggtcagcttggctagcctgggcatcaccgtttgctactccccagatggcacaggtgccctgtactcctgtacatgtgcctcgttcatcatcccactgtatgtctccccacgcctccaatgtagtagtctagcttgtagtcagggggaagaatggaatgatacaactacttggcttttgcaaggtgggaaggtctggggagagttgtctgggctcattgctgacctttctcagctttcttggggggtagcaggtggagggtggaagtggtgaaggaggatttaggaattatattttcccagggacctctcagcatctttatatatctctcgtggcagacatctgtctgagcttagggtagcatctgcctaggctagggacaacatctgtttgaggctgggacacctggctgagcccagcacattatctggccctgggacagcttctgtctgagctcaggacatgtgtttgaacctggcacaacatctgtctgggcctggtacatcatcttcctggcctgggggcaatgtctgtttgagccctgratgtgtgtttaacttggggacgtctgctgggcctggaacaatacctgtctgagcctggggatggacttgtcattgcagataaaatcacccctgagcctcaactttggtttgtggctgaacacagagtgtgtgcagggctcatgtccctgttctcctttctaccgaggaacgggatcttaggtggaatgcctcagtttaccttcaattgtaggtccattggcctggttgctctgggtacctcgagcactggacaaagcctacaaccccagtggctctgggaaaccaaagtcaaaagaacgcatgaggggatcgataggttataaaatccagtgaccggtctaggatgattctccctttctccaatccctcatctaggtacttgagtcaggtcacagtgttcccactaagacacaatttggacatgtcactttgcacttggctcctgagaacccttctatttatttatttatttatttatttatttatttatttatttattttttgagacagagtctcacgctgttgcccaggctggagtgcagtggtgcaatcttggctcactgcaacctccgcctcccgggttcaagctattctcctgcctcagcctcccgggtagctgggactacaggcacccaccaccacacctggctaattttcctgagaacacttctattgctccctgttatgtacatcatcaggcccaaagtccctggtaatcctgtctctgctgaccctctgaatccagcaacactgagctctgttcctgcaaacacacggggccctccgagaccccttatctccacacacatggttccctctcctgggaatgtccaccatctctgctttacattcttcaaatcccagcacaagggtcaccagccctgggaagttttcccctctagactaagccacagcctctgtcctgcttccacagtccatttgtgcattagcatttacaggcctatattgtcattaattctttgtgtgtctgtctctcccataggactgtgagctctggggctccgggactggatctgcttcacctctatcccccagcacccagctcaattcccrgtctatagtactcaccaataaagaatrcctgttgaatgaccataggttgtgcccctgtgatctcatttccttcttttttaaaaatgagggcttagagggatactgtagacactggtttgcagtctcagaagaagtgggcttcagagaagagggcatgtctttttcatacctggttggttgactgtagccaaaagcgctgggtaatggacccagagtgccctggacaagagcctggtggaggcttgtcctgcccaaggttctttatcggtgaagtgaagtgaaggtcagggggcagcaatgaatccagacataatagcctctctgtgggctgcagggatgggactaagtctaataaggaggactgtgtcgggcaaatgtcaggaccttgacctgggaccaaacccaactccttgggggcaggtgggagaatagaggcctggctcagcacgaatggagaagttacagggttcctaggtatgctcgtcttgccagagagagaaagtcacaaaaagttttatcaatatcaacgttgtatccagagcaaggtgctctcactggtcaggacaccctggcacctggccagcttcagagggacatggatccctaggaatgtgtatggggagaaaggccagaataggggggcatgtggaaccatgaagaggtagctgagaagtgaatgttccgaggacatggtctctgcttttgtgtcttttattccaccaaataggaatatctttatgtttttgctgatgataaaaacaatacaagctcatttgtaaacactagaaaagtagtatacaaaatagaaaatggaagtcctccatcagcctctctgcctcaytcctcataactactcctggtggctatatctttccagaccttttttttgtgtggacacacagtacttaataatagtagcttaggtttattgagggtttatgatgtgcaggtactgtgctaaatgcttctacctgaatttacgcattgcatcctcacaaaaacattatgggttagctgcaactattattcccattttacaaatgaagaaactgaggctcagagagttgaactcaaacttgccagggttatccaggtagtaatctatatcgttatctgtggatctattatgtacagatatatagatagatagagatatgaattcttttggcagaagatgggaccacagtgcatatagtgttttatagtgttttgtaacttgttcttttttgttgttgttgtcgagacggagtgttgctctgctgcccagggtggagtgcagtggcgcaatcttggctcacttcaacctccacctcctggattcaagcaattctcctgcctcagcctcccgagtagctgggattacaggygcctgccaccacaccggctaatttttgtgtttttagtagagataggattttaccacgttggccaggctagtctcgaacatgtgacctcaggtgatccgcctgctttggcctcccaaagtgctgggattacaggcgtgagacaccgcacccggcctgtaacttgtttttttaaattaacaatgtttttggatgtgtgtctattttttaatacatcttatccactttacccttttgaaatggctgtacagtattcattgtgttgatgcactgtaatttctttaaaatctactgatggacattgagattgcagcttctgcctcttgtctgcagggctgtcctgggtcccagggagtagataaactctttgtgacctgaaggagcagagttcagatcaagccatggacattttagggagccagtgttcgggttccccattctaaggaccaccttgtcagagactaagctccctgactctggaggaattgagtaaaggcagagtagctgctctcagaaatgccgcaggaggatttttgtatcaggctatgctttggggggagcgtgggtggggcctgaggtatagggaaaggagcgctggttttacagcttggagacctgctcaagtccctgttctggctcctggcaaacctcccagtgcttcagttttccccatctgtaaaatgaaaatagagtaccacagtagttcagatcatgggcttggagccaggcagacctgattctgagtgtaggtgctgcctcttaccagctgtgtgaccaggggcaatttgcttaaactgtcttagctatacttaactttaacccaggaatacaatacaaatagttgtgtgtgtgtgtgttttgagacagggtctcgctctgttgcccaggctggagtgcagtgacgtgatcacagttgactgcagccttgacctcctgggctcaagcgatcctcccacctgagcctcctgagtagctggggactacaggtgcatgctaccacacccagctattttaaaaaaagatgttttgtagagatagggcctcattatgttacccaggctggtcttgaactcctaggctcaagcgattttcccacccgggcctcccaaagtgttgggaatataggcatgggccaccacaccagcctacaaatagtttgtccttacatttcaactaattttttttttttttgagacggagtctcgctctgttgcgcaggctggagkgcagtggtgtgatctcggctcactgcaacctccgcctcctgggttcaagcaattctcctacctcagcctcccaagtagctgggattacaggcrcccaccacaaggtccagctaatttttttatttttatttttagtagagaygggatttcaccatgttggccagtctggtctggaattcctgacctcaggtgatccgcccgccttggcctcccaaagtgctgggattacaggcatgagccatcgtgcctggcctcagctaatattttttatcacctgttttcgcccaagcattgaggatatagccatgaaaaagatagacaaagccactgtcctcagagaatgtacattctagaagaggagggaagagaatcagacaggaaacaaataaacagtttcacagaagatgactacagattatactaagagttttgaagagactgcatcggatgctatgatagagttgctggaggggcccagatgcagttggttgagaaaaccctccctgaggatgtgacatgggagctgaggcctggggatgagaagggccagtcacactgagagccatggaaagagcgtcctggcagggaagactgtgaggtgccaaggtgtccttgtgtgtccaaggaacaaaaggcagctgatgttgctggagcagagtggcagaggagagagcagctggagctgagatccaagagggaggtgatgcagacctagcaggcccttgtagaacgtggtcaggagtctgatatcctgctaagggtgaatttctacctcttagggttctcatgagggttcaatgagatatgcatgtttgggtttccccagaagcagatcccaagataaggatttgaacacatgcaggaaagtgattccaggaaatgctggtagggagtgggcctgtgagactgggaggggaggaagcccacagagrgagcctcttggagcaagttgcaagttacactatgggtaactggaccactgaggatcactgggcgcctgtgttgaacacacttctgagagttaccccacttgctagatgaggaagccaggtcatttatctactgtcatgtcagtcattctgggggttggggtgaaggttaattctctagcactctgagcctgccttgggagggcagagcaggctcctggagaccagaagaagccctcaggcaaggatgcagctgcaggcartttgaagtcaggctagagtacactgaaatggtagggcctggaggaatgggggtggagcgccagcactgtctgctactcatggagagcttgtggcataggaagcaccctatcgatgatagtaattattgctgataatattaatggtagttttactaatgattattgtcattgtgagggttaaattggaggatattaatcatagctcacatatattgggttcttataggtgccagcagtaagcacttctaagcactttacatgctatctcatttcatacytgtagtagctagtatgtaggagaatgcatgatgtgtggcaggcagtcagtaaatcgctgtttcttcaaacttggaagttctagaacttcaggtgatgaatttgggactgttcaatggacccctagatgctgagggttcttgtcccaaacctcctgagctacaggcagcctccctggtgccttgagatgctgactcagcagagaaagatgtaaattcctaccttggtttgcatacaatttacacatatttatttatgagtgtctttgattaatgtcaaagtgcctgtgtgatttttctgccaggcttctgggccctgcaagggcatggctggcatcaatgtggctgcaggctccgtgtgagcatgtgggggttctcgggtggcctgaaagtgacagccatgggtagtggctggcagccataggtagtggctggcagccatagagggcgtggtgagcagcctggagcctgtwattctagcgtgatttgggcagctggtgtgagtcggggatgtctgttarcatgtggcagggtccagccaagggactgggggcaggtcagggctccaggcactggggtgagtgactgtgggcccacagttggccatggtcttggaggagcctgggtggcggccacattttctgggtgggaactcagacccagggagccaggacaagctcaggttctaggactcatggtggtgggaaaggcttccaaacaaggcagagctcagaggctgtctctgcagagtgcctgccccccggggctgcccagggcaggaatcctctgcttagaagctctgagaaagggagtgctctctgcaatcaaggcctgggacaggaattgagaaaatctgccaatcagcaagaattttctgtgtgctggcagtgcccagccctgtgtctggaactgtggagaagatcagtcctagcctgtaaactttggcaggagaactggtgagataaggagggaagggcagaccccgaccttggtggaggctctgtgcttggcaccatgcggtacttacacccattatctcctttaatcctcacaagagcccagacaggcagttaatgtcatgtctcctcattacaggggagaagcagggatcagagagctgtagtaacttgcccaaggtcacacagcaagtaagtggaggagtctagatttgaacccagctctgtttcattccagagcccaagcacttgaccagtttattctgcctcagctaggtgtaaaataaggataaaaccaagatcatttagtttttgtgagttaaatgggctcaagtgtgtggacagcttagcatggtggctggcacacagtaagtgctcagtaaaagtgtttttttcttaagtggtacagcaaggattcttaaatcctggttcattgcaccctcgtgtttgcatggtactgtggtttttgccaaggccaattgggagggcagacggttgggaacagagcatgacctctgctgtgagttgagtgagcccttgtcatgcagggacactgacagccatcagcagatgggtgggaccacctgccaggccagatcctctgttggctcaaggcccagccctggatagggtagggacactgaggctgtctagtcaggatggcctggatatacgtgtgtgtgtgtatgtgtgtgtgtgtgtgtgtttatggacttggtgagggtcctggactagagaaggagagacaactttgggaagtggggagctctcccagcaggcaatggtcagagccctttcttatttccagctgcagagatctaaatcaggtgagagcctgaaccatgtgaaaatgtgtgggaaatcactcctggcagagggaacagcaagtgcaaaggccctgcggtgggaatgaacttaatgtgtacatccactttccacagtagctgtagagacaatattgactccaattctccagtatttgatgtagaggagctaagtgggggcaggattcatttattccttcaacaaacatttagtgcctgctttgtgccaggcactatcctagatgccagtggctaacacttatttggtgctcactgcttctaagcactttatgtatattatctcatttagtcttcacagcaccacattgagttggggaagtctggggagacagctggtcctcctctgtttcctctaccttcttcccatctcccagccacctcaggtacccagtrtgtgccacccaggaagaccaggatctccacagtgggtgagstggggcagttctgagaacatgactgctgcagggtctttcccgtcctgactgggccctgcctaagcgcaggctgttagcctcctgggagccacccagtgacaggctagaaagggtgctctccagtcaggcctgcctcagaacatcccctcccagggggcttccagttgtaccttctctgttccttctctaccactcagctcctggcctccctccaacccatttgtgtagcttaagccctgtttttggactctgcctagggagccacgttccagttcagggctgagactgctggcagggagaaaagaaaaacttccattttctgatggggcagtccccgaacactccctgtggtttcactaactctgctggaggcagcagggcggttcacactgtgcccggctgactctgtcctttccttacgatgatcagctcacagggcctcagccagggcagacttttcagttcctaactgcccacctgtgcctgtgcacccagcttgtgcccatgacytgggctcctcaccctcttccggaggaaaaggggcagaaaagattaaatagaaaattgctcaaaattcagaggccgtggaacagatctgacagttccaatagactttggtgaataaataaacctggaaaaagggggttttctgggtggggtgaaggaaaaggaaggtcttgtatgatgggctacgctaacctggaaaccatggctccatctgtcattccattcatccgtctatccatctatccaaccatccataatccatcctgcctgcctgcctgcctgcctkcctkccttccttccttccttccttccttccttccttccttccttccttccttccttccttctctccatccatccatccatccacccacccacccacccactgactgcttgcctgatgcagccaccagctcagttatgcttgtggagtaagtgtgctgggagctcgtcagtgtttatgcttttatgacccctctgtttgtgcatttcctctcctcaccaggtttgtagagagctccttgtgaagtgaagtccctccatctctgtagagccaagaggaggggctctgtgttggctgtggggttggcagcagctgcctggcttgggcaccctggttagtggggaatcttgcatgctgctgccactcctgctgcaccaggcctatgaccttcagtcccagctgtggagtgtgccaatgtggtcgccaggtgagcagggccagggctttgcactgctccaggggcagggccttgttgcctggcagcctgcccatgatgctgaggggctgctggcctccagccagcaccaagcttttagagtgatacagttgtattgctgcagaacctctccacactactatagtaaacaaacagtctggggccaggcatggtggttcatgcctataatcccagcactttgtgaggctgaggcaggtggatcacctgaggtcaggagttcgagaccagcctgaccaacatggtgaaaccccattgctactaaaaatacaaaaaattagctgggcgtggtggcacatgcctgtaatcccagctaattgagaggctgaggcaggagaatcacttgaacagaggttacactgagtggagattgcaccattgcactccagcctgggcaacaagaacgaaacaaaaaaaaaaaaaaaaaaaaaaagtctgggactctgggcctgcctgggaaccaggaaggattggggtagttgccatctctgttcttggaggggtgggtgggtgggcgagctttgaacccagcagctgctgtgggcctgagagttgaggccagtcctcccgaccccagccagacctggcttggacagcagatgtggggcagcacacagactaggcggtgagctgtgttggctggaagtgaaactgcagagggcccaaaggcaaaagacccaaatcagacggagatagagatgcagatagagcagaggratatggagattgagggggtgaggggggagtgggggagagagagagagagtctcagaaaggcaagacagagtcagtgagagagggaagattcaaaggactgagaagagaaggatcaggggaggggagtccagggcaagggaagaaagccggtgtggtgggctcagggaagcaggtctttcaaaggcaggggatgcagagagtaatgatagcttaataaaagccccctcctgtgtggacagcaccctacagcgaacaaactttcccacttgccaaaactcattcaggcctcctgatagccgggctgagatggggttggagatctccacrctgcaggatggggcggggagctggaattggaactgggactggctggagtgggtaacacagggtgggggtggtgagtggcttagagacagagcccccagctgggcccaagtccctgcagtgactgagacttccccagctgtgttcccgggccaggcttgtgctcgccattcctgccaccatgacagtgctgctttgtttcctgggaggaggtgcgtcgctctcaagtcccggctgctgactgtagtggatgctgtggtgcatgctcagattccccttcaggtctgaggcgctcgctccccagcttctgggtgtgtgggctgtggatgactcacagctgaatccgtctcagggaattgcctttgatggaagtggggggagaaccttgcccagcgttattcctcctccctgggggcagcctgtatccaatggcctattgattgtaggagtgggggagttgtacaaaggccaagtccccttgcatcaacttgtgacactactgaagggccatcccagttccagaggtccttgggagattggctgaggcctttggtatgactgcatggcagatcaatttctccatttgcccaaccctgcttccctcgcttcctgttgttcttgggattactccccagtaaactcccccagaaacggtgaggctgtgagattagacacccaagaaggccaaactctggcccctaacaacagaactggtggagagatgtgaacttggagcagttgtcacctctgagacaactcagaggyggtacagcttgagtgagcagagcctccctggccacagatgccatgtcccatcccctagccatggaccccaaggataggggagagaagaggcttaccctgtggggctgaggattgatccttgagcccagctttggaattgggacaccagagcctgggtgtttctcagcccagaagccttgcgtgaccttgggcatgcccgctctgccttgccaatgccaatctcacagtctcagagtatttccagggattctgacctatgacactaatgctaaccattggacaccagcctggactcagctcagctcccctccctcacatccttgttttctttctaattcttattgacatcagacaggtatctgtgtatcagggagaagtcgtagtaggagggaatgttcatccagccctccccaccctgggcaaaacccctctgtgcattcccagaagaaaattcatagagaactcgtcccctagcgggtaagctcagaaggggcagggccctgtgctgcctggcacatgaaaggtgcttgatggttttgagtgatgatgactctggcacctttgtgctccaccagagaggcaggaggtgtggtggttagggtgctggagccagactgcctggttcacatgccagctctgcctgtcagaagctgggtgaccttgggtaataaggacaaaatgggttaatctatatcaaagtacttagaacacaaaatggcctgtgttagctattatcattattattatttttttagttgtaagataacacctgatcctccaggttgtttgggctgtagatcccatgtctaagagatgcacacacacataaggagttatttccttagtgaacaaggagtctcatgtgttgccctgtatccctataacctcatgcagtgcaagctcctcacttggaaactctgcagacaaggcagagagggctgggccaaggtcatacaatgctctgggctgaggaagacccaggccctggtgtccagttcccaagctgggctcaaggctcaattctcagccccatagcctcttctctcccctctccttggggtccatggctaggagacgggacgtggcatctgtgggcagggaggctctgcttgcttagggatggattgtctcagaggtgacaactgctccaggctcatatctccctctgtatacccagttctgttgttgggggccagggtttggccttcctgggtgtctaagggatcagatgagaggccactgaagttcggagggttaatctctggcactgtgcttgctgcacagagattgcagtggtcaggtaactgtaaataataataccaaaccataacattcacccagcactctcattcccttcctacctcatttacccccacgatgatcccacgaagtaggacttgccccttccactgctgctagcaggggcgggactctaagccctgcccctctgcacctgggaactgcctcttacttggtcttcctgctgtctcactcctgcctcattcgagctgtgctatttagtacagtccccacatgtagccagtgggtgcatgaaatgtgactaggtcaacttgagatgtgctgtaaatacaaaatatgtactggtttttgaagatgtggtataaagaaaccaatgtaaaacatcgctaatagtttttttatatagatgacatgttgagatgataatattttgggtgaaacaaaatatattattgaagttaatttcacctgattccttactgtttttcatctggccactagaaaattttaaattatgcatgtggcttgaaacatatttctgttggacagtgctgctctgaagtctgttattcacacagcaaccagggttatcctttaagatcttggtgattatgtcccttctctgatcacaactctttattattattacttttctttcttcctttttttttttgagacagagtctcactctgtcacccagactggagtgcagtggcgcaatctcagctcactgcaacctccacctcccaggttcaaacaattctcgtgtctcagccaccaaagtagctgggattacaggcgcacgccaccatacctggctaattttttgtatttttagtagagacggggttttaccatgttggtcagctggtctccaactcttgacatcaggtgatctgcccgcctcagtctcccaaagtgccggaattacaggcgtaagccactgctcctggctacttttcttatttttaagagatggaggtctcactgtgtggcccaggctgtcatgcagtggctattcacaggcgggagtatagcaccctatagccctgaactcctgggctcaagtgatcgatcctcctgcctcagccgtctaagtacctggtaccacaggcgtgcaccgccatgcccatctgctcacaaccctttacragctcctgtgacacaagataaaagccaattacttaccatggccttccagaccctttgaaggtgattcaccctcttgcttccttacagatcttccctcctgccatgtgtggctagcacgtgctcctatgttctagccacaccgtaactccttaaacttgctaagcttatttccaccccagggcctttgcttgctgttccctttgcagggagtgatttgccatctctccatatgttcactctctcacttgattctgatttctgctaagatgtcccttcctcagggaggacttttctgtccatcatagccaaaacaaatgcctctgtgctctctaatccctcgggcagaacattagctcttatgtaacattacatacatggcctagggtttttcatcctgtagtcatgaaaatcccgttggcacttgggaagctcttagagatacctagctcaatcctctctttttatggagggggagatcgaggtccagggaaggaagaaacttgcccaagttcataggtatagaaataataatagccagctgccatttattgaacatctgctctatgctaggggtttcacatccattcttttgtttattcccattattttcttagtagtctctgattttgcagttgaagaagctgaggctcagagaggttaggtgatttgtctgaagtcacatagcaggagggcatagactgggattcagacccagatctgtttgacaccaaagattgggttgttcctctggcctctgtgggttcccacattccaggacccaggtcctgtgtctcaggccagaagattttctatattggctggagcttctgtgggatgcaggcagtggatgagaagggaaacgayagcaaatagaggaagcacaagtctctggcctcagtgttgggtgcacacaaagcaaatgggagaaggaggagaggggctcccttcccctgccccaaggcccagccaggcaggcccccagcagcctggctgtctccctcccttgcgggctggagctgcctctccgcctctgcccgcctgatcggggcagagctcggcttcatgtattattaatagcactgccagccttcctgttttcacgctgataacctgcaggggagggctggtgggagggagggagcaaggtggcaaaccctggagcttctagggtccctcccccctcagtagagcagctctgcgggggttggccccaagtctctaaagttggtttctagagcctcccccatccaagcccaygggaagggaccagggcctcctaaagggaaatcacatgggaggttggaacgtggggtctgggaagggccctgttactcaatccatctaggacaccaatggctcaagtcaccttggccctccccagaggcagaagtgccsatgtctagggcacatggggctcagagctgaggattcaggggtgtgtgtgtgtgtgcatgtatgcacgtgtgaatgtatgtgcgtgtgtgtgtgtgtgtgtgtgtatttgagagagaaagagagagagagagagcatgagagagtgagtgcttggctcccaaggtccgctgtgataagagatctctgaggtccagccacacatagacttcaggccatatctgagctggcctctgcctgcccccgctcccacgcctaatctttttcctttctagtgcccaacctggaggccaaaggcaggttacagatggagccaccatgtccgggactctgatgggtggggtgggtaggggcccgccccttcgatctggcccataggctggaggtggctgtaggggatagcaggtgccagcygtgcatctctttccaacttcttgttcagtgatgtcacattggttgtttgaaattggtcatggtgggaggatttacattacaaaaatcagcaaatgctacaaatcagggttctgcacccctagagccagttgttagacatttagtagcacagctcttggaccagtatggaaggctctgctgcatctcatctagaacatgcctataccttttttttttttttttttttttttgagacaaggtctggctctgtcacccagcggggagaagtgcagtggtgcgatcttggctcactgcaacctctgcctcctgggctcaatcgatcctcccacctcagcctcctgagaggctaggactacaggtgtgcaccaccacacccagctaatttttgtattttttgtagagatggggtttcgccatgttgcccaggctggtcttgaactcctgggctcaagtgatccacccaccttgggctcccaaagcactgggattataggcatgagccactgtgctctgccacgcccataccttttctatcttttacctcttcccagactgctcctgtgaagtctttcctcttcgctcttgcctgttatttttcaataatgtaataagaggagtcatgatattggctaacatttcttacgtgcttgttaattattttctgggtctgttggaagagctttacaagattcacttcatcttcactgtcatctagtgagtattatttccagtttacagatgaggtaactgaggcacagagaggttaaggaacacttgaggtcacacagctggtaaatggcagagctgggacccagctgggacccctatctggctccatggctgctgctgacagatactatgtcatccctgcctccctgcaagggctgcatgtgggtgcctcctacaagtctctgtgactgtcctggcacttgggcctctctgacttcctttgctgtctccccggagctatgcacttggaattgtccttactgggcccaggtctctcctgcccccccagactgggagctgcttgagctcagtatctgggtgtgattcttctgstgccttcagtacctggcccaggaatgagtgcagagagtacttgctgaatgagccgctagtgggggtaaccatgtggcacagcacctggcacctggcacacatgcctgtgcacaatgcccagtaaggggcagctgtgcttatcagagcctgggctccatcttccagcacattttgatgagtgcctttcatatgccagtccctgttccaggagctggggtttatcgtggtaaataaaaccgacagaaactttgtcctcttggacaaagcttatgttctggtaggggagacatctaataaacaagataaagaatgaaaasgtaaagcatttagggatatgtgctcaggggaaaaataaagcagggaagaggctagaaagtgtccagggagattttgatgggttggtcaggagcctgtcggacttcactgagaaggtgccagttaaggaagtgagggagtgagctatactgtttactgggggaagaacattctaggccgagtgaagttcctggggcaggaacttgctggacatgtttgagcaacatcaagggggtcagtgtggttggggtgggcagaacagaggagaaaatcggtcaaggagttattggagtcaagagaggcaagtgagggaaagaaggggctagtggcagtggtggtgtagggtgggcatggggagggttatgagaagcaacagcttttccttctgccctatgaggagcaggagagggacagcttcgagaggagggagactgttttctgtagccgaaaacagtcttgcagctcttgactgggtctttggcctcttgtagacccaggtgcaatgcagaattgcctccatttcccctctagactcctaccagctgctcccctgtcctggccacaagaaagtcctgccctaagggcactgctggtctggaatggcatcttccttgtcctcaggtttctgctgccctctctgcctgcccctcacaccttagggaatactgactccatggtcaggctcctgaagtgctaactgtggactggccagtcttggagctcctgttttccagccccttccctccatgttcctgaggtccagcctccaggcacaacctgccccaagaacaatgcaggagagacccagggcctggagcggctggccgtgtagggacaaggtggcaaaaaaggaaagagattgggaagattgtgggttcagtgggcacaggggggctgggcagaggtctcctacccagcaggagtctaggactgtggatcagaggtggtgccagggcaggtgatgtctgggctgggagcgtgtggactggatttatttgtccaatgccacaccccaccccagagctctaagtgctcagcatcataaataaaactcacctaataaatctcccctgtaaattttctgcgtagaatttcattacttgtcttgtttccagtcattaggttttagtccaattcggagttgtcccgatggctgtgtaaatcatgcctgcaccctggagagcgtgaactgcagggagaaatcacgcctgggcctgcaggggtgacagctcaagcctgaacagctggaccctgtggggagtcggctgcttgcactgagctcctcctattctccttgccctggatggggaaggaactatcattaactgagcacctaacgagtgccaggaactttataaacatcatcctgaatcctcacaccagccccacaaactaggaattactatcaccatcttaaagaatggaactgaggctggaagaagggaggtcatttgcctgaagttacacagctcagctggtttgtatctgacacagtctggctttgagcttaggtttatctggctcctactgcatctactgcctcctagtgtcatagttagaagagactgtagagaacttagcacagtgccaccccttccacaagcattccttggttactagctagagtcaacccctctgttgtctgtttcctgtactgactttgaaccacttaggaggctttgctcacacccagtggccttccatgactctctacctgctgtgctttctgatacatggctccttgggcttttgcacactcatagctatgcatctagttccaggactattgagttcttgtttttcttcttttctaaaccataagctccgtgagggtagcggctacacctgcttgattygcccgtgtatttccaggatctagtatagtatacagcacataaaggtgatggataaattttttatcgagtgactggatggaataatgaatgaatgaatgtagtcacaccagggaggagaaggaggagatgtcaatatggccacacctcctctgtgcaggtcagttacattcccaaagcccagtggaggtctgagtgggtagggaggattctggaacctcatgtccaggccccaactcagtgccaatcttagctttcacctcaacatcaaattttagcccttgacccaactcaaactccaaacttagcctcaactcctaatccatttccaactctgatctcagcctcaagtccaaactcaacacctgaccccacctcagctccaacctaatcacagccttcacctcagctatagccccacccctatttccatttcaaaatcagcttctatctcagccacaacttaaatacagatccaacttccaccttagcccccattccagacctcaaccccagcatcactagtcaaaagcagtagctcctcctcacctgtgagcagggagcagccatggtcctcagatgttgactgtcccataagcctgtcatcctttcccccacctgccttacagcttggagaggggaggagtcctgctggcctcttgtgagaactcagtaatatttttccacacccgtctcatggttacagttcacaaaccacacacatgtccatcagcccaccaggtagatcccctaaccgctcagggagaggtctgcatttctttatgttacactggcagaaatggaggttattaaatgctttggctggtttgtgataaagggggtgctctaagccagcttttctaagtttcatgctgtccctagtctccctgacctgggtagaagatgagaggggcccttggttctgtgtgtgtgggtgtaacagcagggaccccttacccccagccctcagcacccttgggtggtctccactaagggctatgacagaaacattctgaatgtttcccaccctgagctcaggagagcttgtatcaagagagaggcgagtgatacaggactagtgaagtgtgtggtggatttgaggagtgtttggttasgggcctggcagcaaacagaatctactcctaatggtttctatgcagcgactgtgatgaatgggctacctacaaaggcctgggtgaagattttaggaagcagcaagagaggtggggctccagggactagcaacagtcagaagcccttaccacctcaagggctgatgagacgaggggagggaatggtgttgtggaggagggaatgcctggtgcaagccgtagtcatggagaaacacagccactgctaaaaatgttgcccaggaaggagggagtgaggagggaatccctgacctccctcttccccttccctccaacttctgccggtgcctcccaccagctgaacccaaccaggggcacccaggccaggcagttcyctggggtcagtctcctggggcacagctcagggctgagaagggcagggtgtgaatctgggccaggggatcaaatggagaataaacagcatggggagaaagcaagagcaaagggcaggtcttccaggagagacagacagacaaagaaaaagcaagggaggtggagagtgtgtgagagagggagtgagaaagggctcagccatttgtctgggcaggtctgcggaactcaaatccggctcatctgcatctcctcaaataaacttctgggaagtgaatgcctgaagcaggcagagtgcagagaagtcagcaaatatgtgcgtagtgaattccaagccttctgttcccagctcctgggaggggccgcagtgccttggggtgtcctgccgtgtctccatcrggtcccctgcctggctgctctaaccctgaggaatggcctccaytgtgggcctgtggaaacagggagaagaatctcttatccagcaggtctgagggccacaggaacataagtaacactgaagagtgaggctgatccctggggtttgcgcgagcctgcaaatgcatgattcaacagcactcgcctggtgcctctgggaggcaagctggatgaggatgttgttcccattttatagatgaggaaactgaggctcattgggaagggactttcccaaggctatgttatgagttagttgcagagctttgaacttgggcccagactgagcctgaaacctgaccttacactgagtcccagccccagtccctgaacatggtctctgaacatggctcagattttgccccaaaagcatctggaccaggaggttggagcggcctgggataccccctgaatactttcatactaattctgctatggacagatgcctgcaatcccctagaggcttggacattttccaaaggaaacttttactgaagaaagatcatctttatttatgaaatacttattccgtgctgggcaccatgctaagcactttgcatgaattatctcatttaattctctgaacaatttataagtttgaaactatcattatcctcgttttacaaatgaagaaactggggctctgcgagtaacctttccagtatcccacagctagtacatagtggagctaggattcaaacccaggtctcgatgcctctgtaggatttcattgttaagctgcactgcctaacagggaccagaaattgtagtttttcttcttctcctaaaagcaaacatccaggctgggcacagtggctcacgcctgtaatgccagcactttgggaggcagaggtgggcggatcatgaggtcaggagtttgagatcagcttggccaacatagtgaaacactatctttactaaaaatacaaaarttagctgtgcatggtggcgcacacctgtaaccccagctactggggaggccgaggcaggagaatcacttgaacctgggaggtggaggttgcagtgagctgagattgcacctctgcactgcagcttgggcgacagagcgagacttccccccacccccccgaaaaagcaaacatcttacatatccctaaccaggaggggccacaggtggccttgataggcacaactgccaggtcttccagccctggcctgggccacacctgggcaaggcctagccaggctgtgatagaggagaccaaagagtgtgcccttcctcaccatggcccaggggaaggagagcagatccagaagatctgtgggccatggaaggaatatccytggtcttgcacagracacagcatctgtacttattccatacatgggtacggtccacaaggtatgggcatgctccacgcttgtgagcgatgtctgtctgcctgccaaaagaagctgctggatgcatgcagggaacttytccctatcttcccagtgctgtgcagtgctaggcctgtgagagatcaaccaaagccccagctcagaactatggggaggagagataggcaaagggcaccttctaggaagatctgactagggctgtgcccccagggagagcccaggtttcttgctgccatctattcccccaagcagacccctcctggctctccctgtacatcaataactctcctcttgtgtcccatccctaaaggttcccaggaaggaagaggggaccctggatcctgaccttacaatctgtggatcatgaggtgtgcagatgctgtgcctgggagccagagacatggcatcttctttgtgattctgggcaaatcccttggcctctctagtctcctttcctcctatgcaaagggaactggctggcttcagtgatctctggkactccttcacacgaattttcccactgactctcccgctctgagccctgaagcttctcttcagcctgtccctcccctcccccctccaacttctgggcagaggctctggccatggtgctgaaggtggccatggcctctgcagggtcttggaagaccggaggtgagcagggtacccacctcaggacttgtgagggcagaggaaaactaccctaattaagaatttactatgtactaagcccggtgctgttcactttacatgcgttacgttgaytgattacagtgtctcttggaggaagagattatcatgggaaactgtttcaggaactgtgggttctacaccttccaggaagcagaaggctgttctgacttacttaggatttcaagtagccctggctcccagagatggtcctgggacaattaagggcagctgagaaaacagtgacatgtagaaatggttgataaaactgtgagggaacgtctgttgacactgattctgagcctgcggccagagatgaatgattgaagcaccaggcttgttaaagcgagagcacgtttgatttctctcccctgcactgcatgcgattttgctggagggaagttagcaatcagctaattgacattgaattaaccatgaaactcagcccctgccttctctctgaagcgctctccagcaagactttatcaaggctttgaattattgattattacttatagctctgatggggtgatttccttttatttgttttcacattgggtgtccttcataagtgtccctgagagtgggaggcacccagatgcagagcttcttaccagaggagcagaggagagaagtctaagtccagggaggacaggtctggacagtccatcctgacccagagaaataaatctgttatctgttaagccacggagctttttgttttgcatttttgctgctgttactgtagtaaagcttagcctaatctgactaacagggactccggaggccaggtcctttctgatgccccatcatgccaagcttatagggtgtgaatgtggctgtgctccctgccctgccattcaaactctatctgtaaggatgcttactcgatgcctactgcaattccttcagatacagggattcttccacaatatccaaaccaaatggcgttctggactctgcttgcatattcctgggatgagagtacatgctgtcctgaggcagtaaaagtgctcagcacccaccgtccccttggcatcatccatgtaacttctactggtttgggctctgtcccatggagccccacagagtaatttctttytttttttttttttggtcccatgacagccttacaagaatctggaaaaaaaaaaaaaaaagaatctgraattagatatccaaggcctcctctcttccaggaaacatcatttcaactcttcacaacactaaatttcaagtcccatccctaacttggtctcttcttgtattgggaatccaatatgtctaggagcctctggaaatacaatatctagaactggatttaacactccaggtatggcctgagagtgatagagcctaacagacccatcaccttcttcagattgggcattagacctttaatgatgcagcctgactgggatgaatagctttgttctatggcagagacacatactatttattgaattcatgtgctcctcatgtttcccagcttccttgtggccaggtggggccatgtgactagtctggccagtggcctgtgagctgaagtgatatgtgacactctaggatgacacatttgagagccagtgagtgatgttccaggctccccttccttgccctggcgacctggaagccaagtattccagatggcattgctataagacacaagcagcctggatttatgaatcaccactgggaagggagccaccctaaagagttgctggacccacagtgaactttttttcttcctttttttttttttttgagacagaatttcactcttgtcgcctaggctggagtgcaatggcgcagtcttggctcactgcaacctccacctcccaggttaaagcaattctcctgcctcagcctcccaagtagctgggattacaggcagccaccaccacgccctgctaattttttgtatttagtagagacggggtttcaccatgttggccaggctggtctcgaactcctgacctcaggtgaaccgcccacctcggcctcccaaagtgctgagactacaggtatgagccactgcacctggcccacagtgaacttggtatgagcagaaataaacttttatgtattaagtcactgaactttttgttgcagtagttgctgttactgtagcacagcctcaccaaacctaactgataggcccagcacactcctcactcacattgggaattgattctatttcatcatctgtgtagtgccccatgttaagccctgtccctccccagctagactttgctgtgattcttatttattggctttgagctccataaagttagtgaccatgtcttactctttgtatctctcccagggcctagtctgctgcacagaggatgttcacatttgtagaggaagggagtaagaaaaggaaattctgagtccatcaagatagaagcagaaaatattccctaggatatttctctggaatgaggcaatatggactcaaatctctagttccatcactgaacagctgcatgtcccttagccagttacttattctctctgcgtttctgtcaaatagtggtaacagtcccagtttctcagaagttgaggatgtaatcatatattttataaagactggctggcacattgtgttgtaaaaaaatgtcagatgttgtcatcaccatcaccatcgtagttatcactgtcatcatcagcgggaacaggggatattgttgcccattacatctaggagggaagcagagaagagagtcatccaggaagggtctcagccccaaggcagtcccagacggaggacttggcagatgcaagatcacgtagatgctctctggctcayggtcagatatcctgrgcccagccctgcagcactgtcctccagaggatgcacacctacccaggcctccttacccttcctcactggactttctctcaacacatgtgtttggcttgagatgcagcttgtcacatgtgtctggctgattccactaggacaactctgcttgcttctggcagaaacctggacaaggcaatggaatatatgggagtcatgtctctctgctaacaggcattctgtgtgtagaggagggaggatggcctcttcgaggtggactgcacacatgggcagatgtcatctgaagattttgaaaaatttttgtttgtgtaccctacacagtccaccacagacacatgtcactgtgcaagtgcacaccattttggatgcccaatgtcattgtggaagagagggagcctacattttttgagcacctattatgagcaagctgtaactgataccaaaattaatcctcacaattccatgaggtagagtttattattcccatttgagaggtgaaaaaactgaggcctagacagtgtttgaactggggacttgaatccaggtttgcctgacttcagagcctgcccccttttatttatttatttattttttggtttgtttttttgggacagagtctcacactcttgcccaggctggagtgcagtggcgtcatctcggctcactgcaggctccgcctcccaggttcaagtgattctcctgcctcagcctcccgagtagctgggattacaggtgygtgccaccatgcccagctaatttttgtatttttttttttttgagatggagtctcgctcgctctgttgcccaggctggagtgcaatagcacgatcttggctcactgcaagctccacttcccgggttcatgccattttcctgcctcatcctcctgagtagctgggactacaggcgcccgccaccacgccgggctaattttttgtatttttagtagagatggggtttcaccgtgttagccaggatggtcttgatctcctgacctcatgatctgcctgcctcggcctcccaaagtactgggattacaggggtgagccactggtgtccagccsctgcccccttttaatttatttgtttattatttctttttcaggacagtggatactttttttttttttttttaagatggagtctcattttgttgcccaggctggaatgcaatggtgcaatctcagctcactgcaacctctgcccaccgggttcaagcgattctcctgcctcagccttctgagtagctgggcctacaggcacctgccacaatgcctggctaatgtttatatttttagtggagacggggtttcaccatattggccaggctggtcttgaactcctgatctcaggtgattgatccacctgccttrgcctcccaaagtgctgggattacaggcatgagccgccgcacccagctaggttttatgtattttggaggaccctcatccagagtctcttcagatttgtctctttgggtttctcttcattaagcgtcacacttctcacttgttcaaatacttttactttcggtacctttgaaaggcttactttcaaaacaatggttataggctgtaaccaaatgatcctaattagctgccttggccacatttttaatgttttctaataattcctgtttctgcaagaaacgaatctggagccatggtcctgcagaaacttgataatgtctttcttgggcggtagctcactgtgcagctgctccacggcccatgtccactgtggaatggccgctgccatctgcccccgctgcctcttcctgtcttctttttaatacactgcctactcccaagacttgtcctctggcccgatcttccactgccctccaccttgacaaatgtacactttcctgtcctccctaaaatacatacacacacacacacacacacatatacatatatatacacatatatacatatatatatacatatatatgtatatacatatttttgagacggagtctcgctttttcgcccaggctggaatgcagtggcacgatcccagctcaccacaacctccacctcctgggttcaagcaattctcctgcctcagcctcccaagtagctggcatcacaggcacccgccaccatgccmggccaattttttgtatttttagtagaggcagggtttcaccacattggccaggctggtctccaactccttgcctcaagtgatctgcccgcctcggcctcccaaagtgctgggattacaggcatgagccactgcgcccagcctaatattttataatcaccaggcactgtggtatgttctgagccttggctttcttccctgaaaatggtacctgtctcttgggactgttgtgaggactgattaatatccacagaatacttagcacactgcctggcacaaaattagcattgagtgtttgttattaatataataatggcygacatatattgagtactgtgtttgtcatattccatggtgctargtgctttatgcaggatatctaaatgctcaaaacaatccttgcagtaagtgttagtaccctcattttcagttggggagattgaggcttaagagaagttaagtaggctaggggaggtggctcatgcctataattccagtactttgggaagctgaggtgggaggatcactggagctcaggagttcaagaccagcctgggaaacatagtcagatcccatctctacaaaataataaaaataaaaatrgaaacattgagaaaagttaagtgaattacccaagttcacaaagtaaggaagaggcagtgtagggatctgaattctgatcacctgactctagaggctgtgctgtggctgctcagaaccaagaactaataataattaataatctagaataatcacttccatatattgagcagttattatgtgtgagggcacagctcttatctatacctgtatttatatctatgcctcaatttttaaaactgtcctctctgaggcagattctataattagctggatttttttttttttttttttttcctgagacgaagttaaactcagtcacccaggctggagtgcagtggcacaatcttggctcactgcaacctccgccayctgggttcgagcaattctcctgcctcagcctccagagtagctgggattataggcatgctccaccataccaggctaattttttgtatttttccttgcagtgaaaccctcagacagggtttcaccatgttggccaggctggtcttgaactcctgacctcaagtggtccacctacctaggcatcccagagtgctgggattacaggtgtgagccatcgcacctggccaattagctgaattttttacacatgagactgagagtaagaaggattaggtaacttatgcaagacctcaagctagggaaatgcagtgtggggacgggaacccaggctgttgacatggatgtgaccactgcagtatatcaccttcatagcagggaagatatatgtattatatatcatttgaatgtggtgtagagcttggattaaaccattgtttatgcaatacatactgaaaacaaaaggattcacgatgttataagagaaagggacacataaagatatactaggcaaaggctaacactaaataaatagaggtcaaaattggtggccttccaatgactccagatgacatgagcaggccacaaccagtttgattcagcttgatcccatcttggccagccccacacattgtgagctggccccaacaggtctggtttgattggtgccagcttgaatcagttagttagatctagttgcagccagttgggaccagcctgaactggattgacctagtttaagtccttttgtgtcttcaggctgacttgcctttcagtcttagagttttggggctccctgtggaaactcttctcttggaatcctggctggatggctttgcttcagacactagcgagggggagagtgtaagtaaattattaacctgacaggatccagcccttggacccttgggggtgtaacagctggaaggccccakcctgtgaaccctrgcttggctcactctgcaaagtccctcctactcaaattcccctccaaaggtccctgtggaatcccctcgctgcttgccttccccgcaccctgtccagccccagaagtagatttttccttcattttctttttgaaggtgcaaacatagggggtccatgtgagcagacctagagctatccctgagcagtgtggcttgtctgggatgttagggctgatgtgtgggtggtgccccctgtgttgggtgatggttggtgttgctcacttcatttctagaccccgacaaagatgtgacttgtactgctacactgacaatgtaacgaagcattgatgtgcatggagactgggagaggaaggtgggcagaaagggcaggtgctggctaatgggatgccacatcacattatcattgtgcaggaaccatgccccctgcagaggataacaagggctggaggtaatgagtaccaaacaggcctgaggaacgccccccgccctgctgtgcaggctggactcctaccctggggcttgctgctccattcccagctggactgggttgcagggagcggtgggactgatcagactcaggaagcgttagaaatccagcaccagctgtctcctggaggctgaaaatcccctgggactggccacctcctcctttctcattcgtgccatgcctaaggttatgcggatgttggttagaggcctggggatggccacccaattggaagaaacctgtctaatgcacttacccacggccacagggagatcagtagctggccagcccatgctcctttgaaatgcctgtggatatgtgctgcatagacagagggtagtgcagagagagaggctcctttctagtgtggggtacagcccccccmmcccccccactgtggaaggcagactgctccagaggacacctggtgggggccaggcctagttctctcccttccagttctggagcagaatgcctgccccctctacctgccgtgaagcaggccatgccagggctcctggcacttcagaggatgcttcctatcccttctgtgggtctcagctctccaggtcctgtggagggactggggccacaagagagttggcgatgggcctatgtgtgttaattaacctggggtagtctttgtggactgtgccctgaggtcaaggatggactcttccccagggactgactgccttggggaccaactgagcccagaaacaactgtgcccagggactgactgctgactgtgccctgtgccctgggggaccratgatgcccaggaatcagctacatccagtcactaactgtgtccatggaatgactatgcccaggaacaactgttctcagagaccctttgagggctcactgtgtctggggctcatctgcacctaggactgactttgcccactgtcactatacctgagagccaactggacccagactctacctgtgcccaaggatagattatgcccagagagtatctgtgaccagggaccatagagagtgtctatgtgcccagagacagactgtacacaggactgactttgcttaaacactgtttctagggaccaactgtgtcctggtactagcattttccaacaatcaactatgttcaaggacagctgtacctggcaaacagctgagcccaggcactggccctgccgagggctggcctaggcccaaggatagattctatccagggacctgaggcctgctgtgcccagggaccagctgtgtcaggaaacaagctgtgcccagggactctggatagggggaagctggggacagagactctcccatgtgggcatagacttgtgtgcctggcatacaggctgcccagctgcatgccacatgcctggtgtgagtgcctctggcagcagctyttattctgggacagtgggaggagggccccttgccctttgtggaggtactctcaggctcctttcccattttggcacctagtgaatagggaaggagaaagagcacacagagggctgggcgctgaggctcatgcctgtaatcccagcattttgggaggctgaggtgggtggatcgcttgatgccaggagtttgaaaccagcctggccaacatggtgaaaccccatctctacaaaaaatacaaaaattagtcaggcatggtggcacatgcctttaatcccagctactccagaggctgaggcacgagaatcgcttgtatttgggagatggaggttgcagtgtgccaagattgcaccactgcactccagtgtgggtgacagagcaagaatctgtctcaaaaaaaaaaaaaaaaaaaaaaaaaaggcacacagagctattgagcacctgtcctgtcatgtgtcagcacatgcctggtcctttcttccccatatgtcattttgtccccaggactaccccatgaggcagcagttatcatcttcatttacagatggaaaaactgaggttcacaaagatgaaagttctttcctggtctttctgactccaragctcttacctgtagtgaggtctgcctatttccacactgcacgtgggtctccctgagtggagggagaggcaggggcctcccagcatcttacagaagaggaagctgaggaaggaccagatcccaggcatctggtctgcaactggcacactaaacctgttcatgccagtggccctgacttctcaggagaagggcacttggctggcctggtaggaagggcttcctggaggctgcattcctggttgctgtcttggaggcaggaaggccagggtgtggaggccgtctgtcccatcacaagccccctttcatgatgctcaacaaggctccttcagaggccggactyggctgtgcaaacacgcacatctgggctgctggctggggcggggtggcggaactcccccacagctggccagctgctcctgaccttctggacaaagggagctttggccctgtgggggttcccgggaacttggagctctggagggtatagcctctacccagccctccacggggggcagtcctctctggctgccgcctgtcattttcatcataactggaactctgcctctgacagcatttcctgctgagggcatgccctttccctccctcgagggcctgcacccagccagaactgaggaaaatagaacaaaggctgcaggcagaaagaaactcaagcggcaggcaaagaagcatctaagcagccatcccagtctaatccccatcctcttggagcttttaatttcgtggaggagaaagacacaagccagataatcgcgcacgcacacacacacacacaactgtaaataacaacagactatgtagtgtccttcaggttttaggcactggcttggtgctttacatattttaactaatttcgtcctcacaacaaccctataatagggagatactattattattcccattttacagaccaggcagttgaggcacagagaagttaggtgacttgctcaaggttacacagctagtaagtggcagagccaggatctgaaattaggaaatatgcattctttttttttttttttttttgagatggagtcttgctctgttgcccaagctggagtgcagtggtgcgatgtcggctcactgcaaccttcgccttctaggttcaagcaattctgcctcagcctcccgagtagctgggattacaggcgtgcactaccacacccagccaattttttgtgtgtttttggtagaccacgttggccagactggtctcaaactcctgacctcaaatgattcgcccactttggcctcccaaagtgctgggattacaggtatgagccaccacccccccggccacggaaacatgcattcttaatgatgcacatttgcaaaccaccgtgaggtccatctcaggaggagcttggatggggagtggggaagccactggggagggcaatgggattcaagcttcgagaagatcactctggctgctgggtggagggcagatgggggtccagactgcaggctgtcaaaagagacctggtgagagatgacagcgatgcggcctggattagggcaggggcagtgggcaccaggagaagagggcaagtttgggagagacgtagggcctagaatggtggcacctggtaggtgagtgggtgtgggagggtgccttaaggtggggttgaggactctaccctgtgtttgggaagtgagccaaccagctgtgtctcaggtgstctctccacctgcccggcaagcccacctcgactctcctgcttcctgggggaagaggtggcctgggaggcatgtgggaggctttccatgactgctgagccctagcttcctggagcatccctcagggttcggggagagtaggtcactggtaagtggaggaagccccgaacctggcctcagacacagatttaaatcctgactcctctgatgagctgtgagacgttaggggagtcacatatatctctggaccttaatttcttacgaaatttgggaaatgatgcctgcctcactgggcctgcatacgacaattaatatggaagtggactatgaaggtgagggtggaggagctgttttgttgttgctgttcaattgtatcatttgaggcttctttccacgtggcaggagaggygggctggtgggaggctcgggaggcctggacgccagcctctaagaggtcacgggatggtggacatgatcccatgatgggcctcagtctccggatctgggatgtgagcccccgatgggaggcagaacagccagggtggtcctgccaggcaggtggagagagtgctgctgcaagagttaggcgctgagacagagctggccagaaacagcatccctcgttcattccaagttcattcactcctttaacagacatgccactgaacacctgcacagtgtcaggccccatcctaggggctgcgatatgatgaggaaacaaggtcattcaggttctggctttctaaagctcatcgtacagtggggkcaacagatagtaaaaaaatcaacaaggrgggttgaaacagcaaaatgttctatgaagacaaaaaaaccaaaacccaaaccctggtgatgtaaaagagggtgagggggagaagggctccttcagatagggcggtcaggggcagtcaggggaggtctcccgaggtggtgacaggtgagctgaggctaggctgatgagaagtttaggggaagagcgggcaagctcaggtgactagtgaggaaggaggagtgtgacaggagaggcatggagagatgggagagaagccaggtcaggtgaggcaggagagaacgcggtcatgccaggctttgcaggcccttctaaggagtgtgaactttgttctgagagcaataggaagcctttgaaaggtttgaagcagggcgtgacatagtctgatccactgtctggatgactccagctgctgtgcagmgaatggattgaatggtgggagggactgtgatgcttagcgacctctggctgtgacrcctgccccrgccctgctgtgaggatgctccactctgtctgcttaggmcttacttgccttccacactctccccagccctcttctgggccagcagctccaggctgtgccagagttcccagaaagcaccaagaatcttgaggcagaggactgactggctggcctggggaaggcttggcaacccaagtgcaggtacagtgggcatgggtgtggctgccctgcctgcctccaccctccatgcaggacaggtaccccacgcccacccccacccctcatggggcttttgaattaaaaagtcttaactttttcttttaaatggcagctctgtgtactgtacatggtaattaatacattagcatttatgcaaaataccatcacagccgggctggtatgtcagctgccttcctgagctgcaaaaatgtgagcgccccgaggtacctcagacaggcccccgcccctagcagacagctcygtttgacctgcatcattcactaacctgtctcggggagcctgtctacatgcacacatctgtgtatgttggccaatgtaaatgctgcttcttgtgagtgtctgtggtatgcatatgtgtccttgtgtgtggatgcacacgtgctgcttgtgtctctacaagcagatacaaggatgcccttgtacacaacacaygtgctgcttgtatagacatgagtgttgtctacgagggcatccttgtgtctgtgtgtgtgcctgtgttggtctgggcatgagtgcatatgagtctatggttttatatgtgtacatctcagaatgtgtgtgtatgtacatttygtttttttttcttccaggttgaagcgattctcttgcctcagtctccccagtagctgggattacaagcacctgccaacacgcctggctaattttttaatttttagtagagatggggtttcaccatgttggccagtctggtctcgaactcctgacctcaaatgatccgcccaccttggcctcccaaattgttgggattacaggcgtgagtcactgtacctggctgtgtatgtacatttctgtgtgcctgttgtgcttgtctgccggtctatgtatttgtgactgggtgtgtctgtgtgtttctgtgcatccatgtgggctgtgcatgcatgtgcatatgtgcatggatatggatgttcatgttcatatgtgtatatcagtggctgcccacgcttgaatgcctctgtgtgggtcactaggtatgtctgtgggatctgctatttgtgtctgtgcatctgtgtgtcagtatgactatgtgtgtgtctctgtatgtgcattcctatgcatgtctcaatttgtgtgtgtgtgtgcgcatgtgcgtgtgaaatgcttgctagactgactgtgaaatgaagttgcagcacagtggaaagaacaactcactggagacagtgacatgcgtattctctggaccctgggcaccctgccgctgatgggctcacagggcagtgggagagatgagcccttcagtgggcagtgaggacccgggttactggttgatggcagaggccagcgcagggtgctcctcggaagctcagttggccctgagtaggagtaggggtgaggtggggttggggagagtttctgaggcggcggctgttgagtgggatcctggagggtgactaggagttagccagatgagaagtagagtctgaggagcacggatgtggcactgtgacagcacctggcctgttcagagaggctggagaccaggaaggagctcattgtcaggagtcggggtagctggactagaccacccagggcgcatatcctgagggaagcgggactcactggaggccttcaagaaggacagggtcatggtcagggtagaaatatcactctgctttcacagtgaggaaggactcagagggatatgccaggagacagagattggagccacggcagcagggggaaaggaaaggggatggaatcagagggtattcccgaggtaaaacgattagtatccagagattgattagacaacaaagtgaggggagggagagggaggagcaggagttgggggacatccagtttgtggctgcagagattggatggttgatgaggatgttcacggagacagtgaacacagaagggtgaagggaagagttttctttggagggaaggtgatgagttttagacatcttgagtttcagatacctatgaaatgtaatttgttcattcattcttcattcactcatacatataccatgtatcaggcatttgagaaaccaagatgaacgagacagagagacagtggagtttagaaagaattacaaaggctccggaagctgggaccactgtaggagaagggagagaggagagacctgtcatgcagaggcctgtgggtggggtaaataggttaaccttttagggaagacagtgggaaggcatggaaggattgtgcaagtgtgggggctgccatgtcaggtgtgtactttagaaaacctttcctcttcttgcacatgtccattgtcaaggggtccctggttttctaatctgtaaaatggagctgatgatctgggccgttgccacacagttgmacaattgtgaagtagattaatgctgggtcctggtaatgtgtccctgccctcaaggagcttactgtccagtgtagaagcaagcacagaaacagacactacaatgtggtagatgctgtgatgtggccagcacatagtaggtgctyaataaatatttgttaaataaatgattgattgaatggataacagcacaaggatccgtaggagctgaaggaggtttctcactcaccaggaggtagaggggttaaaaaagacttcctyggtgaggtgctgcacaagctgggtcctaaagaatgattaggaattagccaggggaagaggggagggagcagcacaaaggctggaggtggaggaggtgcgacaggacatcatttagtgtggctggagcagaagctgcacagtgaggagaggaggggtgcagtgggatatgacagaggccatatcacaaaagatcctgagtgccaggccaaggagcttaagtcctccactcccccaataaagaacgtggagccactgaaggcttttaagcagaggagtggctgattagttttgtgttttctagaaagcactctggcctcttggcagggaggttggtgatggagtcttttgtggcttagttggggtaatgatcgtgctgctgtacgtcttggatttatcttaagggatagggcaccaaactttttttcttttttttaaaaatttatttgwgacagggtyctgctctgttgcccaagctggaatgcagtggtgcaatcatagctcacagcagtcttgaactcctgggctcaggggatcctctgaccttggcctctcgagtagctgggactacaggcatgcatcgccccccacccccacccccgaccccagcaaatttttgtattttttttttttggtagagactgggtctcactatgttgctcaggctggtcttgagctcctggctacaagtgattctcctccctcagcctcccaaagtgttgggattacaggcatgagccactttttaaaactgttttaaaacatagattgaagcatctacagaccaggcagtgggaaccctggcttctacactttaccctgctgttctctggctctgtgaccttggattggtcacttagcttcttagggctttagatggttcttgggtaaggagacacagttagaaaagggaaggacattgggaagggctttgcgtggcttcctgggatatagggtcccctcagggcacaggaggcacactgggatagggggcagctgccttccttcttccttctccttgacaggaagaggaggagaagagtgaggacaaggatgagctcatgtattttcatgctgtggcctcgacacccagccccttagtcccagctcacagaggctgggaggctgctctggagtgggctgacccctcccgcaagcaggcactctgctattgttcaaaatggaattggtcccaggaagcttggagcttgtgaaagccgctatgaattttgcaaaacagctctgaggcggtaaagcatgtcaggaaaatcaaatgcggaaatccctatttagaaaccccactctggacaggcatggtgcgccgggaggaaggactgggtaggggaggggtatggcctagatgcccctcccctgtagcctgggagggtgcccagcacagctaggaggggagaccccttggccccaccttctttccaacttacctggtttcccagatttgaggccctcacaaagcacccccaaccttttccaatgcacctatactttttttttcttttgaaagcagctttatcattttgcaaaaaaggatacatatgctcattgcaaaaaattcagacaatatggaaaagttcaaagaaaaatgtaaaaaccacctcagattttaccagccagagataaccacataacattttggtgaacgtccttccagacttctctccttgcataaatatacacaaatagatttcacgtatgcaactccaccctgagtgaaatcagacgacacatgctgttctgtcacctgtttttttcctccccactcagcaatatgtcatggacatccttcatgtcaattcatacagatccacctcatggttttaatgcctgtattatgtgtatggatataccagtatctggatatacctcactttacttactcagtccccagctgatggagatatatgtttttccaattgtcttgatccctgcaatgaayatctaggtgcatatatctttgcatgtttcattgattcattcatgctacagatgttttttgagtgtgttctgtgtaccagcccaatgccaggtacataggaaatgtaccagcccaatgccaggcatagaaatcatgaataaaacagacatggtcagtcctggctgtggtggagtttatgatgtagtggggagacacggtgtctggcccctgccatcaggaaagacagcagttttttgcaatgagcgtgtgtattaagcagttacacagatacttatccaattagcagttgatctgtagtacgarggagaagtacacatagtacgaaggaaacgtacaggctatgasagaataaaacaagagaagctaacctgagcttgggagtcagggagggcttctctgaggaggtgacattcagcttgaaagatgagtgggcaaaaggcagagtcaggatgaagaggaaagcactggtgagcatgggaggggracagcaagagggtttcactcagaaggaacagtgtttttaattattaacacacgggaaattcctcaaaatgaaattgctgggtcggagggtaagcagattttgcattttgtcacatattgtaaactgcttctcaccaaggttttacatgtgttccatcccgtaaagggtatgccacgaggttgttgtgaaggttcagtaagagagtgagcgtggagggttaagcatagcgctgtcacataggcagtgagctggccactgctsttgccattattattataattatctttgccaatctaatcggtgaaaaatgatatctcatctttgtttttaaccaatgtgtctttttttcgactccacaggaaattgagcccttgagggggaaatgaaccatctttctttcttaagccacctttgtcaggaaccttcctgtgccccttggggaggcaggaaatgtctaggatccctggcctgcagtcccatcctcacagcaaagcccctaggacttagaaatgactccaagtcccacgtggctctgggcttccaaaagcaagcrccaatcagagaaggtggagaggagatgggagaatggtttggaacctgtgtgggacggtcgtcccgtggagaggggcaggcagagaggtgggggccctggaggcagagtcccatgccattaggagtgcttggagatcccaggtgctcctgaatgatattaatgcatctatatgaatattaatagcatggycattaatattaatgacaataataaacaagtgtgaggattatttttaaagagggctgctgctccagctgttgcctcccttcattaataagctgctgagattctcagccatcctttccccagacctctggcaagactcagtggcatcctcaggacctctgtctgggtaggggtgagccgaaagagcattttcccaacattttggatggaaggagaatcaatgcaggaaaccctgagtttccgtccaaggaggtccgggccatgtgagtgggcatggggcaaaggagggatgaatcggcttgtgtatgggagccagctgtgaggaccctacttccttctctcgcaggcctgcggccccagccgtctgcatccccagaggaggctgggccaggagggggtttgcaagggaccaatctcttgcaaaggtggtgagaggaattaccctgctaaagtgatcatgaattatagaaaggaagaggggggaggaaggcccagaatatcatatgtgtaaataaaacggagtggcggccagacatgaaagccagccaccaagctcttgcacccacagagcctcttctcctgtggacccacctcctgccaagttccaccgcaagtcacttccagcctccttcttcaaaggatttgttaataagtcaatgacggaacatctaaaggggaaaaatatttctctttatrgttgaagataattgtcccaggaaaaaaagaaaacaacaaacctttaattacaactcacatggagaaagcttgatttgtgggcagagcccaaatgctgaggagctggatgtaaaatatttgtaatatttagggaacctagagttttacataaaagtaaacagcattgcctgaaggcacaatttccagcaacacaataaaatgtgcagtgaatttatggcggccatccattagctcttaccaaggcaacgtcgcccctatctgtcgtccatcattataatagagggttaatgcaccgaatttacataaaaaagtcatattgtctgcatgaattatttacacttgaagctgtttttacagcttggtttcaagctggattctgggagagattctgccagtaaattactctgtggagacctggttctataactgtgcgcagagccggcaatgaaaagaaaggaaaatgggcaggccctggcgggtcgttggtgctgacgcctctcgggtgggggctggaagcagtggtggaggcttctggaggtggttggatgttgctgcagatgggactctgcctctgggcctgtggcttcctggttgccactcagctgcccgtgtggccaaagtgagttcaggcccagagaaccatagcagtcctccagaggtgtctgagggctcttggtggccaaagtctaaggccttttaaggatcagggggatccctgcagagggagagaagctgctgcaagagttggagcaggaacccaactcagcagtgtgagcaagacccatcatccccattgtacagatgggaagatggaggcctcaagaggcacctactcaagaggtgggaagtctattcatcccaggtgggcctggggactgtgggaggtacatgcacttcagacctggggggtgggggggctggcacggagcatctttgggacacacagagaaagagagtctccatgccacgcatctcagcccttattgttttccgggacctttccttaactgatggcagttttagtggttgggctggcgtgggatgcactgatgtgtgccactgggttcttaaatctctcgaggtatggggtactggggagaactgctcatgtttccaggtgatgtggagttatggggagctggtcatgcagtggaaagacctggatttttatttttatttatttatttatttatttatttatttatttatttatttatttttgagatggagtcttgctctgtcgcccaggctggggtgcagtgatgccatctcggcacaccacaacctctgcctcctgggttcaagtgattctcctgcctcagcctyctgagtacctgggattacaggtgtgcaccatcatgcctggctaatttttgtatttttagtagagatggggtttcgccatgttggccaggctggtctcaaactcctggcctcaaatgatctgtccacctcggcctcccaaagtgctgggattacaggtgtgagccactgcctagatttttaatcaagtgtcagctgtgtggccctgggtacgctttgggccctcagtttcctcatctgtaaaatgggatttctaatcttaaccctcctagactgtcccaaaggaatggtgagaggcaccaatgggatacaatactcggaaggtgtctggtgtgttagaagcaaggccacaggtgacagggttggcagagggaagtgctgaggcctgggctgatagaggaacttgaaaagaagagagtgaaatggacacagagagacaaggctagataatcagacacagagaggtgaaagaatcatagagacagagagagrgsgmgagggagagacaaagagcaaacccacagaaacagagagagagagagagagagagatgggggtggtgtggggaagaggctgtgttccaggagaaagaagtcagaggcaaggtcaagctgcttaaggctccaactgcctggagtcctgtggatgcctttctggccagtgaagaggttggcagggcagggcccaccgtggggcccgtgccaccccttgcctggaccctctccctccttccaggccaagaagtgcctgggctcctctctggcctgggggttcctgcctcttctccctttgctttccttacagcacaaggaggccagagccggatgccagcgcccttcctcccccatcccgcagcacctgggatgggcgtgtgctcgtcgctgtcgccgtgctctcgtctcccactcctggagcagccacagcaggtcccaggggcctggagacaacaaatggctccctgctgatgggctgcttgccgcctcctgtctgccagccagtcctgctgcacaccggcagataatcaagtagggcaggggaacctctcctgcccacggtggtgtgatttaaacctgaactttgctttctttcattccctggagaaacaggatttagattgtaaatctctttcttcctgagaacatgcgcatacacccaggtgcacacacacttgcataaacacataaaggtgttcacacactgcaaacttgaatacttacacgcaaacatgtccacccgtttccacaccacacatgtaagcaatcacgcacgatgcatctgcatgtgcaaacagctcacggccacaggtaagggcaggaggaaaatttgtcagtggctggaacggctgtgatgtgtggggtgggtggaagctggtgaagtggacaagggatgctgaaattgcaagaaactctctagacctcaccccgccttgttacatgggagaggaatgaggtttgtgctgttgcatgaacatgtgtgcctctgtgtgtgtccctgtgtgcaagcgtgtgtgtgtgtttctgtgagtgttttgcaagcgtaagtgtctttgttgagtgctgaggttgacagtctatggatggggtagtgtgtgctgcatcgtgctggccttgggactggactcaggaccrgactggtgtccatagtgccatggccatgctgtaggcctcgggcaggctgtcgcttttctccgggctccagcttctgctggttccccagggttctgccagttctgactgtctagtttctctgtgtgaccttgagggtgtgtttctccaaggcttgaatgagccgggcttggggtgtgcgtgtgtgtttggtgagcatttgcgtgtttatgctgggtatgtttgtgtgcatgttcrtgtgtcgatgtgttgtaggtgtttgtgcatgtgtttttgcctgcatgtgggcgtatttgtatgttcaggtgagtgtacttacagcagcgaggatgccatgcacctgtgtttgtattgtgagtctgtgtagagtctggcgtragcgtgtgtgacagtgagcttgggaggtgatctgtgggtgtgtgtttgcctagtgggaggatttgtgagggtggatatgggaggctccccgttcttactcctctgctttcatcttctccgtaacattgatcaccattggacacactgggtattagtagttacttctttgtttatggtttctctcctgaaagctagaatgcaaaccccatgagggtaggagttttacctgttttgttcatggctgtatccccactattacaacagtccctggcacatgatggtgtagctgatgtccaagaacattcactgaatgaatgaatgaataacttaatcatctccttcaagagttcccttaagtgtcactcttaattagtgttgacctccacttaaaatttctgcctgccccagcggatcatgaggtcaggagattgagaccatcctggctaacacggtgaaaccccgtctctactaaaaatacaaaaacaaaattagccgggtgtgttggtgggcgcctgtagtcccagctattcaggaggctgaggcaggagaatggcgtgaacccgggaggcagagcttgcagtgagcagagatcgtgccactgcactccagcctgggcaacagagcgagactccgtctcaaaaaaaaaaaatttctgccctcccctccccacagctctctagttcttcttatgttgttctcatttttcttttttaaattaccttccagtataccaagtgatttactaattgttgtttactttttatttttattttctgagtgggagttgcactctgtcacctggcctggagtgcagtggtgcgatctcagctcactgcaacctccgccacctgggttcaagcaattctcctgcctcagcctcccgagtagctgggattacagatgcacaccaccaagcccagctaatttttctattttagtagggacagggtttaccatgttggccaggctggtcttgaactcctgacctcagttgatccacctgccttagcctcccaaagtgctgggattacaggcgtgagccaccatgtctagctttgtttatttattatgtactatcctaagtttttaaaattgttagtatccctgttagaatgaaagccctcacaaagagtggaacctttgttcagtttgtccactgatgtctttcgggtgcctggaacagtgcctggcagctggcaggtgcttaattgatatttactgagtggatggatgggcttctgtgtgtcatgcgggcatgagtgggcttttgaagtgttttctgtgaatgtgtttataaagtgtgtgtgggtgtgtgatagtcaaggactgcattttttttttttttttttttttttgagatggggtctcactctgtcacccaggctggagtgcaatggtgcaatttctgctcactgcaacctccacctccctgggctcaagtcattctcccaccccaatctccctattagctggaattataagcgtgagtcaccacacctggcttttttttgtattttttggtagagatggggcttcgccatgttgcccagtctggtcctgagctcctgatgagctcaagtgatccacccaccttggcctcccaaagtgctgggattacaggcgtgagccaccatgcccagtcaggactgcatttttaatgatgtgggtgactgtgtttgatgatgtgggtaactgtgtactttgaggcccgagggcaagtctctgatagagctttcaggtttggggcatcctgcttgggtattgtcaaagatttgcaaacagacccatgaatggcttccctaggaatgtctaggaatcttttccttggtgggctgcaaacctggtggccacaggcctgagccctgtccctggcagcctcctgggtccaccccttcctttgcctgtgggcacatctgggcctcatgcttagggaattccctcaccctatagcacagtctgagccctgggctgggaggcatcaggagaagggcaaaggctgtagtcagtgctggaggacagccacatgagcagcagctggcctcagcacctggacagtctgggaagaggggccttggggtgccacttggacagggggtaatcctggcaccagggattcaggaggcagtggtcagttcagaggcatcagggtttggtggcaggtggctaagccctgatgaggggttgggaaagagggtccaagctggccctatgcttgggctgtgggggcatcgggggcccaggcatcaaagagtttatggtgtgatgtgggcttgggggccaacatgaaaagcccactgtttcagtcttcagggagtggtggggtctgtgcctcagtccagtcccatttaatatgaaggtggtgggcacagagcggctgggaggtggggtgaggggaggccaccctgtggatgacagtgtcaggacctagaaggcactcaaccaagtgaaactttgggctgaggctgaaagacacatgcagcaaggccagagacaatatgcccccttaggccagcatttaggaaatattctctaatgcgtgagtgtggtggtcagggtcagacagctgcactcagctttcacaatctccagctgtgtgaccttgggagggttatgtaacctctctgaacctcagtttcctgacaggcacaatgcagatactttaaaaaaaatttcatagtgagattggaaggatcaagctgtcattactactgttattcttgttatttaaaaagctgtacaggtccaggaaggaaggactgtcttgacaggaattcagacaaaaaaagatccagggttttggccgatctcaaattagtatgagggtctaatatggatggtgagatctgtgacatacaaaagaaggcagtgatccctgaagccaacatgggttcaccaagaccgggcacagctcttaggttcttgacagcttaatgactcgtgggtaaagaaaacgagccagcatgggtggagaggaatctgtgatttattgagcaccaactgtgtgctggatacttcacacgcatggttttatttaatcctcacaagcttgtggattaaacaagacrtgacaatctccattttactgatgagaaactgagtctccgggaagtgacttgcccaaggtgggtggagctgggattcaaacctgggtctgtctgaccctttctgccatatcacactgtctcctaagatgttgggtagagtctctcgtgacttttgaggacatgaaggatgtctgagagggcgcaaagagggctcccattgggccaaacaacagccatgaaatgttcacgtaagtgtaaccaggtcagtctacagaaggcctctagacactgccatggggctgtccaccctgctttgatcagtctatgccaaggacctataagaagacatggaggatacagacttataaaaggtggagtggtagaaagctccaagggacagagaaaacctcagcagaatcaggatttagaaagatctcgacagactggcgtggcaaggtgaatttagctgaggaaatatcacagggaaaaaggctgaggcccatcttgactacaggaaaaattgtagaagggatgggcagctcatgagaaagatttagaagctcaagtgccagtaagttcagcatgagtcagtaggctacattaatagaagtatggtgtttgggacaagggaggggggcctctctctagcctcagtttactctctgccctggggcagtttgtactgcaggtatttgaaggtcatgtgctattttctgtttttccagttctctccctttcttttcaagttattaggggaggcagagtccttctggagtttgacccttggattccayccagagcagcctccaaaatgacacctttgaaggtgggaaagacactgcatattctctgggtttttgtttgaggtctgtcttggatttgttctttatgcccaattaccctaagtcaagggagaagaaagtgctggtctctgaatgttctggaacggggagagctcctggttccctagttcctactggccaggygtatccattccttttccagctgtctccttcccttcttagagccctttttctggtggtcagtggcttgccagggcctggccaggctggttctcctatgctggaggaggggcaacaggagggagccttgcagctgctcacattggggctggatctctgcttaagctgggatgtcacctgccaagctgaattcggcacaggaagctcctggctggaagacgcgctgtttaatttggagattctgttccactctgaaatgtgcttctcctggcagctgcaatgaagtgaagctgttgagcttccctctcttatgccagaatcacagccactttttcctgagaaagaaacagagctacagacagttttactcattaaatactttttttccccttaaatctgtttttgtaatttttttttttttgcgtgaacggaaaagtaaaacgggtgatattgaaataaacaaggcatttgtgatgggaaggttaaagcagattgttgggggtggggaagggggttggaaatgccccatgtgtctgtatgcaggctgctcgtagcctgttgaggatgagagtgagagaaagtattcatgaggctgcccctctcccagcccagaggagtcaatttctccaagtgtcctgggcttcagtgagaaaggcagtggagaagggagctctcgtttattaaggkcccaccaagtrctacgcctgtaatatgggtgagctcattcagtccttatggcaaccctgggtggtaggagctattttacagataaggaaggttgaggctcagatgacttaaggtcaaccctgcagggcatacagagctgggatttgaacctccatctgtctgacctctgatgbtgtttttggctatactttgctaccctgagcagttgtgtatcgagctgggggatgtaaagggaggagaagaaagaagatgaagagataccagccagccttaaggagtggacatcctgcctggtgaaactgaacaagacacctaccgcatgtgagtgaaccaagccctagttgctgggctccgacaaacatggctggtttggggaagggtatgtaagagtgggtgtggagggttttggcctgataatgaaggtaggcttcttggaggtagaggaccctggaagttgagtggagttgagggaacagcctggcaacatcctgggccaaggcaggcaaggtgtgagtatggctctggtgagaggaggtaagtctgagtcgggtagtgatggttgtggtgagaatatccatgttggcagaggaggatcaggttggaagatgtagtgcaaagaaagagccctgagctgggaagcaggtgcccagttcttgtcctggctctgccattgagttgctgtgtgatcttgggctagtcctcttccctctttgggtgtccaattttctgtctgtaaaatggtagagttggattacaggatccctagagacctttgcagggtcctaaggagaaagaaggtgactataatatccagaggaccttgaatatcaagacttggcattagaatcatgaaatgttaggaytaaaaagatctccaggaatcatctacttaaactatcttcctttacatcctacaggatgagtaggagttatcaggcaaaggaaagcaaaagatggaagagggaaaagarggcattccaggcaggagacatagtgtgaacaaaggcatgggtggaggcacggtgcagtgaacattaagcaggttgacattgaagattaaagaccaatgtggccgagtgcagtggctcacgtctgtaatcccagcactttgggaggctgaggtgggtggatcacctgagatcaggagtttgagaccagcctggccaacatgtattttgtaaaaatacaaaatttagctgggtgtagtggcgcacacctgtaatcccagctacttgggaggctgaggcagaagaatcacttgaacctgggaggcagaggttgcagtgagccgagatggcaccactgcactccagcctgggtgacagagtgagaccctgtctcaaacaaaaacaaaaacaaaaacaaaaccacaaaagaccaatgtggggtgtgggaggaggcgagtcatcagttaggagagggagatgggaccagacctcgggaggaccaagggggtttgactccatcctttgggtaatggggactcattgaagctgtgggagtgacatgctcagaggtacaattttgaaagatgactttggcagctttgttgatcatggatttgataggggctgggagcagatacaggccaaggatacgtgctgacaagacaggtcaggaagctgtgtgtcagctcagcaggaggtggtgatggtcccagtcagggtggcagagtggggacactgaggatagcasctgttcacaaggtatttgggaagtggaatagataggacttgttgattgattggctatggggagtggagaagagtgaagatacaaggactctcaggttctggcttggtgatattcactgagatgggacacacaggaggagagagggrttttttgggaacaaagatagctgagttttagatctggtgagtttgaggtatcaatggaacagtgtgtaatgtctcattcattcattaattatttactgagcatttactatgtgccagccatgcctggatactgcttttccgtagctgtcagcctagaggggcattcagaaagttcttctatacactgaatattgagcagctgaacttttacccattggccttcttctgcccttcaggacttcactggcgtctaccctccttcagagattagagatcagtgattgtggttccttgcatcatctttgtttctgggaacatggagctgtggagggaatgtggactttagaaaattataaaggcatggattttagcccaagcaccttttgtatgatctcatttgttaagtgggtttaacgacaacttttgtttttgtttttgtttttttttcagatggagtttcgctctgtcgcccaggctggagtgcagtggtgccatctcggctcaccgcaacctccacctccaggttcaagtgattctcctgcctcagcctctcaagtagctgggattacaggtgtgtgccagcatacccagctattttttttttttttgtatttttaaagagacaggatttcatcatattggccaggctggtctcaaactcctggcctcactgatctgcccatctcggcctcccaaagtgctgggattacaggcatgagccaccacacctggcctaacaacacctctgttactgacagtagagtgctggagtgggttcctactggctaacagaacccactggagtgggttcctactggcaaacgtttgggcatctcttcccaattctgcatgcattgacatcccattggtagcttgaaattgaccatcgtgggagtatttacaccacagaaattggcaaatgctacaaatcaggactccttttttctttcaaaaagctggttggtaagtatttaccagctaacagtaaatatttatggcatatagagttgtggtttggatgatggacgtagagcacctggcacatggtacccagatatacacatattgcttagcacagtgggtacctaagtgtgactaccttttcctttgatgtttcctctctatgggaatactgttgcttcatttgctcacaataacaacctcccttccaccagggcctgctcctctcttttctcaaacaacatggtcccaagtgaagctgccatcttcttactcctcttggcctccataatggggtagagttaaaaggatggggattttggagtctcatgagactaaatttgaatcttggctttgcctcctactagctgtgtaatgaccctgggcaagaaatttaatcactctgagcctcaattaagtcacctgtaaactggggatgggcatgcctccctcattaagttgttgtaaagatgaaatgaggtaatgggtacatgagggcctggcattgaggcggcagtttcagtgagagcttgacccatgctggtctccttcccctgaaaagtccagtgtggacttgggaaacagctctgatgatggggtggggggtgggagagggaggaactggggctgcagccttgggaaggatggtttctggtggaacatgtaggtcgagagaggctgtgggccataggaccttccaaatgtattctgagtgcagtggaggggaactcccctggccacagttcatgcttccagggccctcacctgcagatctgcagataaactcctatcatcagcttggctcgtgcgtttctggggcggctgtggcagcctgggctgccctgatttaccaccccagccccaagcagattaaatcacccagagtcatttgaattttacttggccttgtcacacaaatcttagaaactgctgtctggcaagaaaactttccctgtactttttggaggaaaactaagagctctagaaattgaggtgaagtggaaaaaggaggtggttccaggggggtttctgcatcttcagatcagaccaatgttgcaggttagaggagggattgtggtgtgtgtgtgtgtttgtgtgtgtgtgtgtgtatgcaattgctgcagaggcctctgggacaatgttgtttctggctgtgtgacatagggcaaatcacttaacccctctgagtctcacaggactgtggtgaaggtcaaaggggctagcttgtggaaagcattttgtaggcttcaatcagttctgtgactactaattggaaagatgagacaaatgactacataaataaattatatatggcagtggttactatgcgtcaagcagagtaagagctctaggagccaaatggaggggcacattgccagaggtctggggcttgacttgggccttaaaggaagcctaagtcccagggaagagaagtggaagaggctgtagtgcaagtgaggttgtcgacgccacctctgtctccatcagtgtgtgtggctctgaggtggatcctgattggtttagccaattcagataatgcccccttctctgaccttggcacattggctggttccaaaccaaccatacatacattctcctagtcactggaattgattcagattggccccatcagacagaaactcggggttttggtgagatggctggggaagcacgtctaatctctttgtatctggatttgaatgaggaaacatgtgggcctagtttctggcaggcatctggtgactaggaacactaacctgagaatgtagccaacatatggaggtgggaagaacctggaaaatcacagaaaaatggagtcccagccccagtcaaactatgcctgatgtttgttgcatctggagtattacatgaactaatcaatctgctttattaggccagtttggatacaggggctgatacgggggctgatggagggatctgagtagggagccgagagtctacttggtgttaggcagccatgaatgaggagaccctgtaggcgggagtaaagggtgggtgagggtgcgtagtggggtgagggtggctgaggtctataggaaatgagactagaagaaagtctgggattgaataatggaatgactcaaatgcaaggttaagaatttgggcttgattttgtaggcaatggggtgtagcttcagatttgtgagcagaggaagggaaaggataagtgatgtgaacacagtgatattttgggaagatcaacgtaagagtgggatatatatatatatatatatatatatatatatggattggaaagagaaattgggggctgagactttaaaaattatcatttatggatgctacacatagttcatgtattatctcacttaatccttaaaagagcctcccccatccctcttttttttttttttttttaagctgactttccaaaatcttgcgtaacttgactagaccacataattagcaaatggtggagtcaggatttgaacacaggtcatctgacttcaaaccctgtatccttattcaccatatttatggtaacacagttgacaaattaggatgggctagataagatagtggctacagaggtggagagaatggaacgagagatattaggttggtgaagttctagatgttttgtcattaaaatcagaaaccagatcaggataaccattgttatcaacatttaaaaaactcttttccaaaagtgctaggcattgcaattagataagaagatgaaacagaaagtataaatgttgggagagaggagtaaataatcatagtttgcagataagatgattatttatctggaaaactcaagacaatattctgtaaaacaatcagaaaaaatagagtttagtaaaatggccagtaacaaaaaaatttacacaaactaacagtctttctatttataaaatgactatctagaaggtaaaataaaagctccatccatactgtaaaacacaaacacaaaatactcagaaataaactttacaaaaaagtgtgtagcattacatgaagaaaactcttctgagtttgaataaatatggtatatacctagttcttgagtagaaagatttaatgctttaaggatgtcaattctcctaaacaaatgtgtgaaattaagataatccaatcaagatcccaacaggattagaattttttttgacaaaataattatgaagctaatctggaagaataccaaatgagaataaggaaaattccaaaaaagaaaaatgatgaatatttactctatcagatattaaaatgttttataaaggcacaatataattaaaattcttgtctaggaatagacagacagatcactgggacagactagagtctagaaatgggcccagatatttaagggaatttttgtttgtttttggaacagagtatcactttgttgcccaggctggagttcagtggtgtgatcttggctcactgcagccttggcttttcgggctcaagtgatcctcccacctcagccttctgattagctgggactacaggtgcaggctaccacacccagctaattttttggatttttttgtagagatagggttttaccatgttgcccacattggtcttgaactcctgggctcaagcgatctgccaccttggcctcccagtgtgctgggattataggcatgagctattgcacccagccttaaggtatttttatatgataaaacagcattttaattgagttgggaaaatatgggctattttataaatggcgttgggataatgggccagccatagcaacactccttattggggtaagaactctctgactyggtctaataagctcaagccatgaagaccacatggcataaatatgagtgaatattttgatcatcttaaggtggggaagattcttctaagtatgacgtgatatttgaaatcataaaagaaaagattgataaatttgactatatgaaaattaaacatttaagtaccttaaagaacattataagaaaattttaaaagaggggtatatacatatgtatgtgkrtatatatatatatatatatatatatatatatatgacaacagtttaattttatttctaatgtacaaagagctcttacaaatcattaagaaaaagataaatatctcattagaaaaatgggcaaaggacatgaacaggcaattcacaaagaaaataactacaaatgcctgaaaaaacaaaaagacatttatttccccctccctataatcttagcaatgccaatagaaacaagcatcatttgccttctgttgatctggccaaacattaaggctgacaaaacccaggcttgatgagggtctggactaatgtgtgggcacggttgatgagaattttgctgttgtaagctttctgaaggacagagtggyaaaatagaaatagcatacccttaattgcagccatctcatttattggattttattctaaggcaattgttgcaaaaatgagcaaagagaatatgcacaaggatatttatcacaacattgtttatgagaacaaaattctcacaacatccttaaatgatcatcagtaaagacccagttaaataaagtatgatacatataatggactactatgaagtaattaaaataattttgtagagctctatttattgacatagaaagatgtctaggacatattgttgagagagaaaagcaggtgtcagcgagaacagtatgtataatacaattcctcgtctataaaattatatacatagatctctatgtgtatatatgcatagagatatgtctggaaggctgttcaccaaaatgcttggagtggttgtatctgggaggtaggatttttactttcttttttgtacttttaagtattggttagatttttttttataatgaagatatatcatgttttttaatcagaacaaagaataattctatttgttgtagcattttggaaataaggcagatactaaataggaggaatcagcatgtggtgatttaacagatgtggataaggagtcaagacataagccaagaatttgccctttggtgcccggaagcttcatgcatcatggcaaacccagagcaagagttgatgctggaggaagaaggaggccctgggttttcagagctttgttctgtggcagtggctggtgggcagtatggctgcctcttagaaggggagggctggggtgggcttttccccaaggacagagctagggatgaaatctcagagggagagagtgcatcggcaggtkcaggagaaagctggaaactgagcctggaacacagccatggtgacaagacgggtgaagaaacaggatgcgtggtcaggaaggcgcggggctacaggagcatggagtgtctcaggattccatgggtgtgggggcgaatttctagggaaaggtcaaccatatctaatgatgcaaaggcacggaggctggggaaagggcacaggacttgacaaataggaccttgttgatgaccttggaccgagcagtttcagtggaggaatgaggctgtgcattgtcgtgtgtgggagtaagggagtttgttgtgggagaaaggaggattttagcttgggggagctgatttaagggaaagggactgagccttgaatagagatgtcaataactggctcgtgtgcctccctgctcactccccagccctggcaggcatcactagtcattctgccgagcccagatgaagccataaaatctttctcctaatagccagctcagggagccgctaccaggttcttggagttggctgctgagatgaacctattttccatgcctgggcttgaacacacgcttgcaggatgatgagaagaaacacatggaaggggcgacggaaggagcaggaaagccgaggcctggtggagccagggcctcccatccatgcaggcatagacggtgagctcagtctggtgagacttccaggccagagcctggatgagtggagcactctgccagtgagtctgagctgaccaagcactagaacaagagaacaagttcgtccttttggtgatgctgtgaaaaagcccaactgtgtgtgaactaccagttggtgtacagatatttgaggactcaccacggcccaccatctggctgtccagagaaagcatcgtcagcactctgttgtctggaacactgagcatggaggggtctgcctgtgggttccaactgcagtgcccgagarcagaacaaggagttgtggctcagtagtggcttgttgggaagacttttaaggaatatactcagtgtgattcggctgctgggcctctaatggtgttttgattgcatcagtgggagcatggggttctggatagtggagataaatgctcttttggactctcagtggccagagcttctctggagcagtggagagaggcagacacgcgggcagagctcacccacagaaaatgaccagggtcaggggaggctgggcatcatgcccatctaggagaaatgctcgaaggagctcaggccaaggaattagatgtttgcttttaacctgccgaagcagtgctttcaaacacattgtccttggaattttagtttcttgcagttgtttcacagaaaagggttctatgagcagatgtgttcaggaaatgcagcacccacagctcagtgcacgtgagtacagtaaaggctttgagaagtcctgcagcgaagaaacttgtttaatgtagcattttctcaagcttattcaactacagaagctttttcagttccatatcgatttgcctcctgcaggactagtgacggacctggggcagagggagcagcgcatcctgtgtggtcccagacatacagaattgtttgggcaaatgtaagaatgttgcaaagaggcaaattttggctcagttcaaggaagaactttgaaagcaattgcagatgtttaacccatgaaggaggtggtaraggaatttgagttcccagaggcctcaagcagaatgtggacttagcaggaatcctgcagaaggaagccaggttctaaggggttgtcatcatagatttctgtggttccatgagtcctggaagaggggctccttggctgccccatagtggtactcctccctcaraacctgtggcctagcttgtattgctgtgtacggcagccaggcggacttggaatgcttgaaatgagcagtctgcgaaggtaagatgtgaacacacgaatatcctcattaagtcccaaatacacatcccaaactttacataacaggagcagcagctggagacgcccacagccctaattgcttttctgtactaagagaacgtcttctcttcagctctgcttctcccattcatttaggtaattactggagggagccagctgtggaaggctggcgggcaggcaggcgcatttgtgacaccacctaatgggtgccgccatgaggatggggtgccacgggagctggagcctgtccgtgctcttcatggggagtagggtgctgaggatgggaggccagctgctcggcttcagtcctgatctcagtgggcccaaagtgagctgccgggatggaatgcctctcctcccagggacttgacaagcacgattccaagaaaggacagatccagagccaggtacaggcatggggaggggaacgcatggaagaatcgactctgctcaacgaattgctcaaggtgctttctctgaatctcatgttgggctggggcactgaggccgatcaatcaggaagagcccactctctaagctcacaggtcaggggaggaagcagtcatgggccagaaagggctgggatcaaaggaagctatcaggactggggtgtgcagaggacacagagactgactctgtcttggtgacagggaatctgggaagatgtcttggaataagagatagtaggattgggccttggaagtgtgtatgaccctgcagttggtgatcccttctgcaaaatggggccaaggaaaacttccaggccccaaagtgacatctggtttgtccccttgcttcctggtccctagtaacaacctgggactcatgaggatcctcttgaggtttctttaaggcagtcctgagcatggggctcgcagctggagccagcctggaacctgggcccttggtggttggccagggtgggtgccctggaagagtcagctttgagcctgtcttcagaggggccctagggagggctgtggcctaggcgctctgcccaccaggcttcctgtgggtggcaagtgaaacttttcctcttggttctctcccagaagccagcttcattcccccagccccaagtggcggctccttgggccggaaacaatgtgctttctccacgccttagagtggaagtcagcagtttggcaccgtctggctggcagcctccaccggcttcctttggcactttattggcaaaggcggtgacatttctttcagttgggtgggtggagctgttatgcaaactcccgctctcctcattcgccagatgaatattcatgactcaggcaatctgtaccagccagactttcctgagggcggcagcttttcttctcttcctctctctctttttctttctccttctctccttcccagctctttggaaagctgaagtgcagctatatttaatttacaaatacagagccatttagcttgccttttgagatgcaggcactggggaggaggtgctggggaatgggaacagtggttgaggagtttggtcctgaccctgtgcctctaagctccagtgtccagcccctgggccctagatcctgggaagctttgggagtctggagcttctttgagcttggcctcttggggccttcagggatgaaggtacagcagctcacgccaccccattccacactggcctctgaggtcaacatggaaattctcaggcaatgatgstttcctgcaattcatggcctgggacccaccaatacatcttctcccgctctgctctcccgtttgtcaaggcccacccagatcctgctccaagctctaggtggaagcccagaaggcactggagcatttgctagtcattggctttccggggaaagaaataatccttgtttggggtccaattccttggggayacattactccctttctaggaaggacaggtccctagtttcctttgtctcttcccaaagaggcaccaagaactctggcagaggggtcagaattaccagaatttgccaggaaatgtggtcttagcaaggatgtgcttgcgtgagcacgtcttgtgtgtgtgtatgtaaatatttacgcacagcttaagtgagtctgtgtgcctacatctatgttcaagtgtctgagtgtgtgtctgtatgtgtaagggcgtgaatgtgtgtgtcgcgggaagtctgggaatgcttgcatatgtgcgaatgtgcctctccagttcgcgttgcgtgtgtacctttggggggactggggatatcgtgtgtaaatacgggtgttcctggggggcccagacgtgtatgcgagtgtgtacgtctattaagtgaattgtaggtgtgtgtaaaatgagagtctggaggagagaaagagagagtgtgcatgtgtgtgtgtgtgagtgtgtgtgttagggtgtgtttccctgacctccatttcctcccaaaccttttcctctccaggaaggtggagggggacgtttccccctttgcaagtgttacagattctatccgaggacgtgaacagaaggtttcccagcacagagcgtcctgaaattactttatattccccccctccttgtttcatctaatcaaaatagcagcattaggctcacccattctccctgcccacccctcagccctgggggagggagcgaggcgggcgggccatcttgcctgaccccctttgagagcaccttgcaggcctgagccaaggagctgtcttccaaatctcctctttcctcagcggcccatgcttcagtggcaagagccagctgcctccctgcctgccagcaactgccaagctcttccagaacccacatctaggcccggcctcatttacaaatatgcaaatttgcatcttttctggtatgcaaatggagacatgacaaatagctaattagggtcaaaagaagcactctgaaccaattagttgtagggtctatccctttctcctgggagaagactgggccttcctgctccctwcccagcactgactcccaaatgcccacacactctggcatcctgtctggctggggccctgactgtgaagagcactgaaacagacgtcagtgcatgggcctcagtcttacctctgacctagctatgttaccctggactcatttgactgagcctcagtctcttcctctgtgaaatggagcaatgacaatgactatcttgtccctaaccatccaccccagcatagggagacttgggaggacttggatgtaaatagcttttgaaaactgtactacaggccaggcacgatggctcacacctgtaatcctagcactttgggaggctgaggcaggtggatcacctgaggtcaggagtttgagaccagcctggccaacatggtgaaaccccatctctactaaaaatacaaaaattagccaggcgtggtggcgggcgcttataatctcagctactcaggaggctgaggcaggagaatcacttgaaccrggggggtggaggctgcagtgagccgagatcacaccacttcactccagcctgggcaaaagagcaaaactccgtcttgggaaaagaaaagaaaagaaaactgtactacaatttgtctgataggcacatcacttgtaatcttacaaagtactttctgcccttgatctcatttaatcgtcccatcaaccctctgaattagatgaattcaatgtagggataggatggcagtaggtttcattccacatgccaactctggccaagtatgaatggtgcttggagtggtgtgttgagaaggattcagaggccaagtctaaattcaccaaaaaagagactgtgagctcttagtgacatttcccatgggcaagtgtttggattctgggaggtcatgtgctgcatacttacctacctgaaagatatggaatttggagcaggaacctgggttccagtcctgtctgctcccttgattaagttacttatccttccttggctcagcttcctagtataaagcagggaaaataaaacctatgtctttgggttattgtaaagattaggcaagggaaacttaggcaaaatctctttgtcatctgagaggggatgtccatttaattggcatgtcagtagggcaggcatattgtccatttcacaggtgaggagcttgaggcctggagagggtggatgacctgaagaagaagctggcagcatcaccaggcagggctgcatggcaactggggctgcttctctctctgccactacaggatcctggctccctcacaccacccccatgctgatgccccacacgggctgcaacaagccctgctggcctggctccatttctgggtgtgaaatttggctgagtcggcacctggtagaatggagcaattgctatcctggagcctggggcctgggacagggccaatgcgcagaccaagggttgatgggcggatctgaccaagggttggtgggtgggcctggcgggcttggccagggaactcgccaaagctgggcagctggcaggagtggggcaggagagggcctggcttgaggacagccactcagggaagctgagacccagggcctaagctcaaaacagagcccagcagcatgagtgtctgcctggttgctggcgtgcctgagcatgtcggccggtgtctccgagcttgtctttgtgtgtgtgcacgtgtctaagggtatgctgggtgcgtgtgttcttataaatgagtgtgcatgtctatcagtgcaagagctggtgcacccatgtagttgtgcacatctgtgtaccaaggtgtgtctgtgtcagtgtgagcctacacatctgtgtataagcaaacttcttgcatgcatacatctgtcagtatccgtgtgtgtctgtgcatttctgcctgtatctgcaaatgtctgcttgtgcactgtccatgcaggtaggtccacactggtgtgtgtctgatgacctctgtcagtatctgcrgacatgagtctgtgctttctgttagcatctgtgcaagtgtcatctacgtctatgagcatgtttgttctttccagtgcctctatgtgtcttgtacctgtatgtaaatctgtccatgcctgtcgtgagtgtctctgcagctgtgcctgtatgttggtgtattttgcagtgtgtacatctagtgagggtattggtattcacttcaggatgcaggcatggctgtctcagggtgagcaggatggaatcttccctgtgtctgcagtggctcccggtcatcacttccatctttgcgctgtggctgaggcctcctggactctcatgttcctttcctctgcttgaagggaagctttgctcaaggtttcccagggtgctgcctctgacaggaccaggccctggtgtccctgaaggaggacccgctttgccctttggacttgtttatccctcccctcactctttcctcctctcatctcctttcctttttcttttcttccttccattcctcatccttgtcccttttttctctccctctttctttccttctctccttccttccttttttgcaactcgcttgaagagactgggtcttgggctgctgcgggagtgacaaatgacgtttcagaagccacacttcaacctctggagaggggtccccactcccgcccccatgcagatgcagctccagagccacccagtctccgggggctctgtaaattaaagccattgcatgccccattgcattttaatcatcagcccccagcagtagctccragtgagaacccatgaccttttctccttcccttttgaggagccctctcccaccgctcctacactgctggtaaaaggcagccgcactgcctgctggaagacctgccagcttgggcttcagagcacttctgcctcagatccacgacgatcccttctgwcatcgtgggacctttcctgggatttgatttagggcgacgcttcctcctgtctgtgtcctgagtcctgccttccctggctggtcctctttgcttagtcacccagatcattcccagacagctgcgccctggatatggctcctctcatgtgctgcctggaaatgtctcctctcttctcacctgctgagaggtccttctgggcagggactcgggcagattcattcctgcctgccccacatttccctagcccagggcctggccygttgcagtgctgaaggatgattctggtaagaaacaaggtactccagctcacatcttgcaatgattatgcctcccccactctcccttctccttgcagttctctctcttcactgatgattttggatgcaatttaaaataaaaatattgattaaaaatggaaactatataaataaaaataaaaacacttaacatcaatgtgtcatttgagctttaacataaagagaaaacatgtgaaggtgacaatttgtggacaattccaaattagcatgaagttctcagctggtaagtatcttgacttttttcccctctcttggggtctgtggaatcctgaccaggcatgtggtgcagtagaatgggaggaacttggcttcggccttgataagcctgggttgaatcttccacttatgggctttctgaagctcagtttccttatctgtgtaatggggagaaagaccctacttcatggcgtgattgtgaggctgatagaaaagggcacacaggggccaggcccagtggctcatgcctgcaatcccagcactttgggaggccgaggcaggaggagttcgagaccagcctggccaacatggtgaaaccctgtctctactaaaaatacaaaaattagctgggcatggtggtgggtgcctgtagtcccagctactcaggaggccgaggcacgagaattgcttgaacacaggaggcagaggttgtagtgagccaagactgtatcactgcattccagcctgggcaacagagtgagactccatcttaaaaaaaaaaaaaaaagtcaggctggtcttgaactcctgacctcaggtgatctgcccgcctcggcctcccaaagtgctgggattacaggcgaaaccctgtctctactaaaaatacaaaaattagctgggcgtagtggcaggtgcctgtaatcccagctacttagraggctgaggcaggagaatcgcttgaacccaggaggtggaggttgcagtaagctgacattgcaccattgcactccagcctgggtgacagagcaagactctgtctcaaaaaaaggaaaaaaaaaaagaaagaaagaaaatggtgcacaaggccagaagcagtgccttgtgtctatcatttcaccttcagaatacagccagagtccaaccactccttccacagacactgctatagtagaggtccatgcccagtggtctattctctacgcagcagtcacagtgatcctgttaattagcatttaagtcgtagcacatcacttgtctgctcagagcctgcagtggtgcgtatctcattgggagtaaaaaccaaggtcatcatagcaggctcaaggcctcacatggtcaatcatccctcaccccagggcccccatccctgtctttactattctcccccattgcacttccctccagccccactgccctcctggctgttcctgaacatgtcgggcactctcctgcctcagggcctttgcacacgccatgccctttgctggaatgctcttcccccagatatcctcatgcctccctccatcacccccttcaggtctttacccaagtgtccccttctccataaggaagaccctgttctttctgacctatttttatctgtggcacttgtcaccatccagtatatatatttttttgctgactgattttctatgttgcttgtctctccctgagagaatgtgagctccttgagagcagggatgttttgtctttgttttcaacatctggaacagtgcctggcaagtcatgggcgctcaataaatatttgttgaatgaatgaattgctcatcattttggagggtgccaaaacataggagcagctatcttccaacttgggcaatcagaggtgagaattctgcaattctgaaagggcattatttcagcattactttgttagggaggcagtgggggcccttgggaggaaaccccatggtccttccgcttggggcaaccagctcaggaggaagtaccatgtgctggttcccaactcagcgggagagtcaacagtgtgttctcgtgggccagccaggcatcagggatcctgctccctggaagcctctctgtgagctccctgccccgtggctgcaagcatatccgaggctaaggcgggccttccaggaggctcacactcagccaggcttctctgtggaggtaagggcaccagaacgcggaataaacttgtactaaggtaggtattttagctggtgctggaaagttgggggaggattagctaccagaagagcacgggccgggcactgcaggcccagggagcagcgcgggcagagccgagcatgtaggaggctcttggtgcactggctggggagggacaggcagcgagttgtggctggaacgtgtctacttacctgcgagaacctcctgaagccaggattgagtctgctccatgtttgcctgcccctgtagtgcttacaatggtgcctggccctcgcaggtgcccttgacgtccgctgtgtggcctgttcagctcaggccaggagtctaggaattgggtggtctaggcacctctgatggtgcagatcagacctcagaacaggccttggagaagacaggggttggggggtttggctgggaaaatggtctaatctatttggttgttgcaaaaataattgcagtcttgccattaactttggtaaaactgcaattacttttgcaccaacctaattcctttattttatttttctttccttttctttttttaaacaatgttttgtaatctacctttattttaaaagtagtttcttccaagattggcacaagggtttctccagagctagagatgaacccaggtcataatgatctccctagtctggacacattcatggctaaatatggctttgtctggattttagaacagggttctttacttttttttttttttaaatgccatgaacttctttagcagtcttctagagtagtgttttattctttattattatttttttttagagacagggtctcactctgttgctcaggctggagtgcagtggcatgatcatagctcactgcagcctctaacttctggcctcaagtgatccttccacctcagccttccaaatagctaaggctaaaggtgcgtgccatcactttcagctaattaaaacaatttttttttttttttttgtagagatggggtctcaccatgttgccacactggtcttgaacttttggcctcaagtgatcctcctgcctcggcctcccaaagtgctgggattacaggtgtgagtcaccatgcccaaacccaaatagtgtttttaaatgcataaaatgagatacataggattacaaaggaatggttacggttctaaccatagatcccaggttaaaatggccagttacactcttttcgaggacaaatattccactctgtgaaaacagagcacaaaccttggcttctcctcctgcacactggagggtggggttgggggaggtgtttgtgcatatttttgcagggctgtcctgggggtggagataaatgtctgagaggcagagtttggaaccctaggaggatgccacttggaggcagatggctgggctgcctgggggaagggttgagcaccccatctctggaggtggtgagctggaggcccatctgtcagggattctggggtcaggctggggtgggtgatttctgcccaggtgggagaggattttgatttttcctgagctacttttggtggtgaatctaggaggtacgcagggctgtaggaactttctcttttgccaaaccctgagccacgccggcagccctgggaatgagagaatggttactttgtgcaggcttccacccgccaggcccatagcaacaaatttaccccagtgccatctccaatttgcctcagaaccagtaattgatcttgttctttggaagacaatggcttcagggtagggaaacaccttgctcctctgtctgtcttccaaaaccattcctggggaaggggatggattgtaaaccatatcacccatcctcccgcaacagctgtgcaggctttcagttctgagcctaggaggggatccctccttctttcctctgtggcaccgtcaccctccctggcagcttgaaggccttcgacatcacccaagagcctttgaaattgtccagtccaaatcccctgtgtgggagcgtggatggggtcactgaggcctagagagggcaagggctttgcctaagtcacatagcctcagggtagcagggcgggttctggaacctcagcactgactcatcctgctgtgtctggagtagggagagctggcagtgggaaggcagccccgggtctcctttgacaaacacatcatgcttcccacctaaaccacctctgtgggtggggagctggggactggtctattagctttctcccrctgtcccccgagggtgcatttgtctgttttgcattttttccaggctgtagttagacaactcctggtcctggggggagcgctgcaaagagaaaatgtcagggcgacatgccgccaagataacattagcgaaatatcaagtcctttatgatgtcaagagggattccttcccgctgccgaagctgcctaatgacatcataaaataggcctgcagcagccgcagtccccctgagtcatccatcagccctgttcatggagggtcccagcccgcacgcggggtggggggtgccggattttaaacccaaaggaggctccaacagagcagtactgtgatgaactgagggacagaggacacccacagctcccagaaaggggcagcctcctggcggcagtgcccctccatggctgacctggacactaggggacaggcatgtctccaaggcccctcggagaccttgaggctgagttggctgccataggaaactaacacctcccggggaggaccgcacccagcctagagtacctccgtggtgctaaatgagaaaagagagccaagcccagacttctggtttcctgagggctgacctatctcttgagggacagacaggactgctgggcccacgggccccatcatctggtgcaatgagaccaagagtcaccccactggagacagatggaggaggtctttggctcctttgaggctggcatgtactcttgcatgttttgtgtgtacacttgcgtgtgcccatctagctgtataaatctaagagtgttcacagcacattgacaaatgggttggtccgcatgtgtacagcccgtgtgtacacactcatgcctgcatgcctactgtccacctgctttcatttttgtgtgtctgagtctacagctgcctagatacctttctctatgtccatgtgcttgtgtttatgcatgtcaaagtgtctgccgatgtggggaaggagatgtggaagcagataaggaagagtgaagggagaagggggatcccagagggtgagtgggtgcgtggggtgtaggggtgccaagcacgtccactcatcacgctaggcggaggacatcagctgtgtgttggattcacctggggaagctgtaaaatctacccatgctccagtctcccctcagatcaatgaaatcaggacctctggagccagggcccaggtaccagcattttttcaaggctccccaggcgactgtaaagtgccactggggttgagaaccaggggtgtactcaagcctggctattctaagtgtggtctgaggactcgcagcatcagcccacctgggagcttcagagaaatgcagaatgccaggccctgtgccaggcctcttgagtcataatctgcattttcatcccacaatctgtatttgaataggatccccaggtgatctgtacatccattaaagcttgagaagagtagagtggtgcttctccacataagcaggcaacagaacgtgttttaacaaaccctctggggtgattctgttgcagaatttctgattcagtaggtctggggtggtgtctaagaatgtgcttttctaacgagttcccaggtgaggctgatgcggccaacctggggcctacactttgagaaccactggtatgattgtagcatatgaaggaggcagacagggggaaaagggagtggaggcgggggtgttggggagggaaggtgggatggaaggggagaggacagcttagtcacctgggaagatcatgtccctcgagagtctgccctgtcattgtcttagggtcttgattttcctga

SEQ ID NO: 12220 - DNA, 51696 bp, Homo sapiens
tccatccagaggccacgctttccattcaaaccaggacttgcttcaaaggcagaaagaaggcagcggcgttctaacagataccaaggcaagagacccggtcacatccttccttactggtgttgtttccctacattggccaaccacacccaccgaaaaggggagggcagggccccagagttcctgctcctttgagtccccccactccctgtgagaggaaggtagagagtgctgatgaaacgtgcacataccaagaagtgaaaggaaaacagatgagcttgttttctgcagtgtttctgcaagctgtgaaataggcacaattctggtggttttaaataagagctaaatgcactggtttttgtgcttataactggcattgagtgatatcaaggtgaatggtaaatgcatgctaataatttaacgttttaatttttctatactctcaaggtgaatggtaaatgcatgctaataatttaacgttttaatttttctatacttagaacaacattaaacagcaaattttaaaaacaccatgacaggccaggagcagtggctcactcctgcaatcccagcattttgggaggctgagggcagggagatcacttgaggtcaggagtttgagaccagcctggccaacagggtgaaacctcatctctaccaaaaatacaaaaattagctgggcatggtggcacacacttgtaattccagctactcgggaggctgaggcaagagatttgcttgaacccgggaggtggaggttacagtgagccaagatcacaccacaccactgccctccagcctgggggagcaacagagtgagacttggtctcaaaataacaaaacaacaacaacaacaaaaaagaacacttgtcatgacaagtcaaaagagagaccacagaagaaaggaaaaagccttatggcttaatacctttaccaacacttctttcctgctttttgaggaatgggcccatttttcactttgtacggagtcccacaaattctgtagttggcctgcctgtcatacgtttccgtgaatgctaaggaaaggatggtggctggaggcggagctgtgcaagaagaaacagcaatacaaaagggggaaattcggccgggcgcagtggctcacgcctgtaatcccagcacttcgggaggctgaggagggcggatcacgaggtcaggagatcgagaccatcccggctaccacggagaaaccccgtctctactaaaaatacaaaaaattagctgggcatggtggcgggcacctgtagtcccagctactcgggaggctgaggcaggagaatcgcttgaacccgggaggcggagcttgcagtgagccgagatcgtgtcaccgcactccagcctgggggacagagcgagactccgtctcaaaaaaaaataaaggggggggcggaattccgcttacaacaacagcatacataatatgatcctgttcatgtaaagtgggatatattgaagtacggacatatataacactatataatgaatatatgtaaacacacagaaacatggcatcaaattctttttttttttttttttttaatttgagacacagtttcattctgtcactcaggctgaagtgcagtggcgcaatctcggctcactgcaacatccgcctcctgggttcaagggattcttctgcctcagcctcccaagtagctgggattacaggctcctgccaccacacctggctaattttgtattttttagtagagacagggttttaccatgttggccaggctggtctcaaacccctgacctcaagtgatccacccgcctggacttccaaagtgctgggactacaggcgtgagccaccgcgcccagctggcatcaaattcttaatcatctccaagctgtacacttttcagttgattttcactttttatcatacacattaagttcaaataatagagaaacaatacatccatattatgtatatgatcagctgtttttttttgttttttttgttttttgagacagagtctcactctgttgcccaggcgagactgcagtggtgcaatttcggcttactgcaacctccacctcccaggttcaagtgattctcctgcctcagcctcctgagtaactggcattacagatgtgtgccaccatgcctggctcatttttgtattttttagtagagacggggttttgctatgttggccaggctgatctcgaactcctgacctcagatgatccgcctgcctcggcctcccaaagtgctgggattacaggcgcgagccactgcacccagccatgaccagcttttttaaaaagctgcattttcatttggggaaggggaagacatgccgatggagtcagacttggactcagctcttggctctgctgtttccactgtgcaggatttaggccaagttaagtaactcctctcagcctctgattctccatctgtaaaatggggatactgactggtaaccatctcatcaggctgttgtgaagggtcgtgtgcttacgtagggcctgctacagagatcacttggcagcgagtcgccatgcggggctagggctggggggctcatgcctgtgccagaggacagtgcccccacaggctgtgcaggaggcctctgggaagggaggccagaggcagagaaggcaggccagagatggcacgcatgggcacatgggctgggaggcgcattggggacgcagaggctctctagagttcttagctgtgagtgttagtgccaatcaggcaaaactacaggctctgcatgggttttgccatgaacccaaatcagcacttatcctctgaccctgctttccagtttccctgctggtctgtctgacctgtgtgtaactggtcagccttttgcagggcggctgctgattcacagaggaccagggagtgcctttctggtcagcactgtggcattctggacaaaagcacagcccgctcctggaggccgacgaatagaataatggccttcccgggaggacctgtgccttacacacagacatgtggagagaaagatctggaacattggggtggagggtggactttcataaacaaacatgtacacacatgtctacagcccgcttttatgctgttctgtttggcctggtctttccttcatcccagtaaggttggatctgggcacttttccctatagactgcttgtactccttgcagagggcacctcctatgtgccggctgataaatagcaataagtaagacggggtccttgcctcgtggtgttctcagaccaccaagaacagttccggggtgtgttagaaaacaggcatgcaagaggtgcggacaagaccaggggcttcaggaaaggcccccaggcagcctcccaagagaagagcaggcttgattcaagcgagggcgagaaagggcatttcaggcagagattgccacatcaaaggccccgggtcaagtgcaatcctgccccactcaggagtgcgaggggggtctgtggggctaaagtacagagggctggccgtggctggggaggctgcagtggccggggaggagacagcaggaggaacagcttcttatcgtgccatgtgaaagagccctgcttagtggggcagggttttgccaaaataactggatccctcctgtggtccttgctgaacgcagttgggctgactcgaacctggaggctttacagggctgagccaccccctgcagaccccagccaaggagactgagtggtgaggagtgtgatgaggctgccgctgcagggactttgcaggggcgttgagacaaaccttctcatagcaaaaatgcagtacaaaagtgtgccactccagacataaactgggtgctactgagtcctcaaggaacactttgaaatcctccgcctggctctgcccataggcaggggactggcctcagggtaaactcctccgaggcacggggatgtctgaggcatggggatgactgattcattcacttctgcttgacaatgcactgcctggctatgtgggtatctgataaatgagtgtgtgggtggatggatggagggagggagggagggaggcagtgagagagggagggatggactgatggatggacagacagacggatggatggatggacggatggacggacagatggatggatggatggatggttggatggatagacggatggacagacagacaggcgaataagtaaatgaatggttggataggtggataggcaggtgggcggatgtgtgggtagataccagtgtagatgaatggaagagtgtgtaattgttttataagattaaaatattcttttgatggcaggacacaacacagtgacactcagataaatgaaaggtagaacttttgtttcttacagctccaaatgagaggctgtcaggctgggccacacaggatgtgcaactggggacagggtccaagcaagctggagctataggcggcagctatgtgtggcacgtagggtggtgttaacgaggtttccttggctccctatggattggctaacttaaataagtttgtgagttccagatgatgggagctgtccattattgtttggtacctggctccaaggccatcagggcaggtggctagtggcccagagtgtgagaacctggtaagagaaagggccagaatgtgaacttaatcagctgctcatgaactggctggcctccagccaggacctcaaaactggtttaaagtagcctttttaaaaaactatatgacagagatggatggagatgtgtgcagatggacagatgtcttttagagatttctgtcaatgatatttacagaagcatcaacattggattcagatccttgaggattttcaactcatagatacagagctctacaatatctaagttggaagagacttcagagggtctctggacgctcatgcaggtctcaatatgttgtggatctcagagctcttcaatattttagtgaaagctatagatgaggctccataggggataaagcacagacacaccttttcagagggcttgtggactctgggcagcctgtccatagacctctgtccccaactggcaagtcaggaaactccagattaaggagccccaatgtggttgaacagccaggtgcacagatgagtcaaccacacagccaggccagggagggccttcactcaagagcctacagccagttcacagccaagccagggctagcgcccaggccacccataaactgatctgagactctgtttccctgtctccatgatgatgggatcaggcttgattgctggtttgtaggcttgttatgaatcaagtcacagggaagaggagctgatgggctggggggacgtcctctggccctcctgtctcttccccagatccactgggcccactcttatctgttctcttctgaaggaagggttttaaggcttcaaaaaaaaatgttttgaaagtccctgccctttccagctcctaccgtctcagccctgggagtgtaaagtgctgcagatagttagtaagtctttgagcaaaactgagaaagccagcctgagccttgacatgggagaaacctccgccatacatctccgaagaaacggccgcgtgtctcaggggagcgcaaacacccgcacccaggaaacaggacagcttctgccactgtcgcccttgggagccgtacgtggcatacaaagaaatcccaggactccgcctgcccacctggccaccctctgtttacaccttccgcgtaaacgcscactgtttacatccaaaactcagacacaaaataaccacctcaagaagataaataatgataagaaataaatgttacgcgaggcaaatttattcacatggggcttcccaggccactttgtggtcagccgggagggacgtttttgccgtcccacgactccaacgggcagccgggctacgcaaacatggaaatcttccaagagcctccctggcccccagggctcagagggtggcagagcggagagcgaaggtggccgcagccttcccggccccacagccagcctggctccagctgggcaggagtgcagagctcagctggaggcggagggggaagtgcycaggaggctgatgacatcaytacccagcccttgaaagatgagctgttcccgccgccactccagctctggcttctgggctccgaggaggggtggggacggtggkgacggtggggacatcaggctgccccgcagtaccagggagcgactgaagtgcccatgccgcttgctccggagaaggtgggtgccgggcaggggctgctccagccgcctcacctctgctgggaggacaaactgtcccagcacagagggagggagggagggcaggcagcggggagaagtttccctgtggtcgtggggagttgggaaaagttcccttccttccggaggggaggtctgacaggcgatggggagaagggttcccagcaggaggaatcgccctgtttgtctgttgtaggtttctcttctctgaatcaaggtgacagacaggcttgtgtgtgtccagtgtgtgagggatttcgtgattggattttcacatactttgagtggacaccttggagtaaggcagcgaggtgtgtgtggtgcagcagggacgggtgctgggtggaggctccagaacctggcttttcacccacagctgtgccactccttggccctgtgtgaccctggacaagctactcaacctctctgagcctcagtttctctgtctgcaaagcagccagctcgctggctccctgggggtggcagggttaaatcagaagcaggcgggggtgggggggtttgtgaatgttggctgatgcgcctccaggaggcaggtggtagtgactacctcagatgggcttagagaccctcttcccacggtcctggctgaccagggcagggggataggatggtgcaggggttccaagcaccggctttgcatccggcccaggttgcagctccagccctgctctcaccctgtgggtgacgtttttgggcgagttattttgtcctgtctcctgagctataaagaagacctggaagttcctctttatgcaaagatagaggtaggctcttgcctgtgaagcaccacgtrtgtcataggcactaaataaatggcagccgtgattcgagttgctgagagtaggtcgtttccgcagcctgggtggaggtgaacagcaggtgttgctgttccaggcaggtcagaatgtgcctcactgagtcacaggccgcctgtggctccccagcctacaggaagtgggagccctggcctgggtgtggggtgatgggggcctccctggccaaccccrcccctaattccatttctgagttggagaagggcttaggtggtgggggaacaggtaagcaaccccagaggacattgcaaagaggccctgcccgaggttctctggagaaaaaactgtgctgcgtccttcgggccctggcagcagcaagagacattccacagttgtgagccccacaagcttggaggaagcatttgctgtttcccctgcttggggtgagagcaggggacagccaagagaaggcgtctttggatgaaaaagaggaagcatgcgtgctgtccccacaggcagcaccccaggcctcatcccagctctccctgcaaccctgcactccaagcctctcactgcactgatgaggaaactgagtctcagagggggaacatgacctcagccagcccttcgctcagtgtccagggaaatgcctcaatctctttgggattccctcccttgcaaacggggaggttcccatggttgggcctgcatgatggatctgaggactttgaaagtggtatttgcctgccggtgggacccaacctggaaatattaggttggtgcaaaagtcatctcggttcttgccattagaagtaatgccaaaaaccgcaatgacttttgcaccaaccgaatagctgtgccacgtggtttttgctaacacagtgactggctcagtaacaagtttggtggctccagaggtaacattagggcggcctcctcacctgtgctgcttgtggtcagggaggggcccacctgggcgcggcggggggagccctgcagatttgcccagtgtcatagcctgtttgagctgctataagaaatactttagactgggtaatttatcaaaaaacagacatttattgctctcggtgctggaggctgggaagcccgagatcaaggcactggcagattgggtgtctggtgaggacctaktcgtcatagatggcaccttctatgcatcctcatatggtggaagggtgaacacgctctcccaggcctcctttaaagaccaccaatcccattcacaaggagggggacctcatgatctaatctccccccagaagtctcaccttttaatrtcaccagcttggagattaagtctcaacaggtgaattttggagggacacaggcatttggatcatagcaccgggggactctggttttcagaatgaaagtaggggccttgtctatccgctcaagctgcctcctctgcactgaaaacgatgcctagcccaacatggatggatcagtgtttgctgaaatgctgaatggttaaatgaataaataaatattgctcatatagcaggcaataaaaaagcatacagaacctatcactaagtgaatgaagctactctgaaaaggcatatgctgtatgatttcaactatatgtgacattctggaaaaaggcaaaactatgaagacagtaaaaaataaaaaaatcagtggttgccaggaattaggggagggaggagagaatgggaggagcccagagacttttagggcagtgaaacttctgtatgacactgtaatggtagaggcatgtcattgtgcgtttgtgcaaacccacagaatgtccatcaccaagagtgaaccctgatgaaaactatggactttgggtgatgatgatgtgtcaacgcaggttcatcaattacaacaaattgactgctcttgtgggggatgtcagtaacgggggaggctacgtatgtgtaggcacaggggatatatggtaagtctccgtactttctgctcaattttgctgtgaatctaaaactgctctttaaaaaaaaaaaggcacacagagcagatctgcatgttgttttgaggattcagaaggcacttaggacaattacggtacctcagggtcatgagtcaaacaatcagacctgccaagacttgacaccccaaatgcatcacttctgacatccattgggtccaggaatcccctgcctcatgaatatccatcttagtgtgcatgcctccaagaatggggagctcactactttgcgaggcagcgcattccatcttaggagagttctactgtttaaaagctcttcctccaactgcccccactgagcaatgggtccactttcatttccttggggtttgtaccattctagtcctattgcttctctctgagctaaatatccacagctactaaatctgccccccttgaaaagtgttaaatcctcaattcctcctctgagctcctctggttttcctggggacctaaggctctgcttccccaaaacacccactccagggttgttttctagaacaaacgtaaggcatgaagtatttctttgactctttcatcacagtgggttctggaagattctggaggctggaaacatatgtgcctccccctccccacacacattccaaaaaagtcatcacagcagaaagcacggtggaacaaacagctctcggttcgaattcaccgtcacttactggccaggaaagttatctgagcctcagtttcttctcctgtacaatggggagcatcattcctatttttgaggaccactaggaggcttacctctgtttgtgctgatgtagtgaaaggggatgtcaggcacactgcaggagctcaggtaccagacggactgtctatggaggcaggagtgagggcctggggcggtcacagaggttgcatttgctttgcagtaaggccatggccgcttaagggtgtcyagaaaaaagccctgtccgacatgcacacactcctgtgtccaggcaatgagcctgtgggcactgacagcaagagtccttctcacgcttctcttcagggctcaaactttagatttactccggcctgtcccatcccattcactgccaacccctctgagcctctctgatctgtgccaccggtgaagggcagtcgtggggcacagagaagtggcccagctgagtgacatctggaaatgagcagtgcctgaggggacgcccgtggggtgttgtgacctgtacagtgccaggctccagcacagccccgtcgcttctgtggttcttatcatggtcatgaggtcgcttctcctcttccctgcgggtttcctaagtggtcacactccagtggcagggtggtctgccggagaaagaccaaaatttgtcatactttagaatcacctggagactggtcacccacgcaggtgcgggggtcctgctctggggactgtgatttgaagtctgggtactattcactgaaatgacagactgcggcaaatctcaatcaatcaaggttcatcgagttgataaacttcaattgacatttatcgagagtttgagggtgcacctgggaaaaacatgagccacagaaaatgtgtgtggcctatgctctccgaagagtcatgagacttagtgttgtaaatcaaagagaaactgactgaagcaggtctcaattatttttgaagtttattttgccaagattaaggatgcacccaggaaagagggacacgaaatcacaggaaacatctctggcccatgcttctttcaaagaagggtcttcactattcaaagggaaaaaagcaggcagtaggggaaagaaggaaaaatcgggggaaggtggccaaaagaggcaagcagttgcacccctttgagccttttcgttaacttcactgaatgcacatttttcatgtgaaagaagcaggtggaggaatcatcaattccgcattcacctggtgctcagtcaatctgcatttttatataagataaaataatcatagggctgggcacggtagctcacaactgtaatcccagcagcttgggaggccaagttgtgtggatcacctgaggtcaagagttcgagaccagcctgtccaacatggtgaaaccctgtctctactaaaaatacaaaaactagccaggcacggtggtgcatgcctgtagtcctagctacttgggaagctgaggcaggagaatcatttgaactcaggaggcagaggttgcagggagctgagatcacaccactgcactccaggctgggtgacagagcaagactctatctcaaaataataataataataataataatmatmatcatcatcatcatcatagcatataggaagctgtcagctatgcactcgtctcaggtgagcagagggatgactttgggttctatcctttgttccatacctgtgaagctaagctgttaatttatatcatgagggtgaaatacaacagagctgcttgaaggcaaagatcctggggcccacaaggaatttcactgtgagcaaaatgtgagggaagtaaatagttatccatttagacacaaaacgggaggcgggttgcatgacccagctcccagctagacttttccctttggcttagtgmgtttggggtctggggattttaattttatttttctttcacagtatttacacatgtccttgaagtggagaaagcatgtaggaagaggaggttaggcagaaggaggcctgatctcatcttgcctttgtcttgcttttrtgctgtacctggggagatcagcaccatcagcgtgactctaacagacttgagtgtgaggagctaggcttggattgcagacctcaagttacaattgatgtgtccttgttttgtggtaagatccacatcttgaaaggtttcacccagcaaagaacaatttgtgggggcagtcatggggagatatccgaggccttttcctttctgtgggggtctggctaatgtctaaggttgtggagtaacagctgtcattaggaataaggatgacaatgttggctgactcagtctccaggcttaactttccctttggcataaagagtttgggggtcccaagatttctgttttcctttacagtactcaaggacttgctaatatctcaggggatttcagccacactttgaaacaagctaccttagcaaatggtctgtcctggacccaaaagccactctcctcaggcccttcctcctagtcccaccagccaaaaaacttggggaccccaaacctgttcttcactctctggcacctgtgctcatgtgcctgctgcctcaggaaaggacagaaaccctccccgatccaagttattagcaaactgcccatctccacaaaaatttaaatggacagattgttaaatgcacacagctcacagccagctccyttcaaggtagatttgggcccaaacatttcgggaagcatcaggctgtgccccgccatccctaccaaacaggaatcctctcgagggaaaagactgggcctttccctcagcccctagcacccactcatgcttggcacctgctgtgctctaagagtgcaggggtcactccctgaccacagagggaggctctctggggttctcccggagcctcggagattgcaccttgtgcatgcgctgctgcacctggggtacatcacccccactctggagcccactggccrgttagcaaagtgagaggtgagagaaggacctcttggtcttctttgaacagaaagatccagaaagcaatggctagaacacaagaacaggtcaggggaggcaggagagggtctgcacacctgctacaggtgtgctcacacgtgggccagggcctgcagatgagggatctgtgctgatcatttgtgatagccaaaagtagwgaaaacctggggggactcctcaaatgaactgtagcacattggggagatggactctgtgaagatgattcctctctccacccacttcccttctccctcctcctcccgctcctcctttttcggaagccaggcacagggattgaatcccaccccattcctcccctgctgtgtgacctagggcaagggatgtggtctctgggatccttcggttccttcagctataaatagtagtagaattgcaaactacctacgaaaactgggaactccctgcgaaggccggtgcattacagggcagtcctactctgaaatactgtgaggctattgaaaagcaaggtgggtcgacagattgttaaatgcaaagaggtgaggacacagccggcggtgcatttagggtgcttctgcaggcgtccttatacrtggatatgtgcacatctgctcctgaaagctcagaagatgtctggaaagcaacaggagacaccagtgagcctggctgtctcttgaggcaacaggcagggacagaatctggagggagacctacccctcactgtattctttttcccactctgaaatgttaccatgaggatgcatatctctttgcaaaaatttaaatataaaaagcaaaacaaacttgaatagaaataaactacttgaaaattttagaaaacactgttacatcaaagagacagatcatcaaaactgaaattatagatatttgagaaacaactaactataagaacactgcttaccaaacttatgggatgcagccaaagccatagtcaggggatgagtcatgcctttaaatttttaaattattaaaccaaaaagattgcaaaaaaaactgttcaattcaataaactagataataatgatccaaaaaagtagaagaaagaaaagaattacaaaaacaaaatgacaagttagaaaggtaaaaagcattaatgtcagtaggccatctaaggatggctctttgaagagcagacaggagaagggcaatcccaggaagtgctatgtgctatgcagagaattagaataagttgatggcagagatcagtgggtggcggctcgcttgggtggtaaagagtagcctgcagccaaagttgggcacagcagtgcagtcttcactgggggaatgcctgggaarcaagatttgcctgggtaggagtttccatcagcacccccagaaaggtctcctttctaccctggcccccagttctttgatgggttttgctgatgctcctgtgtctctgaacagcaggcgcctcacctatagaaaggtaggatagcaggagttaaygccccctcccccattccatggcccctgcctgggattctaccatctctgcttcatatgctttataggagttcggtctgagcccacaacccaaacaggctcacagatgtgctagctatttcgccaccagtatttttttaatagtcaatatttagaaattggcaccaactggcccgattgttcaacagtcctgggttaggttactaggccaattacttgctgagtaacccaggacaggtcactgacctctccgaacctctcctttctcacctgtgtgataaagactactgctgtgccaacacaataggactgtgtatgaaagtacccagactgtgcctagactcaggaagctggtttattccttcctcccctaaccacttactgagagactgctcagggctcccctcagctcagagatctttccccacaaggagctgagagcctggtgggagagacaggcagagacccaagtggttctaacacagctctctgaatctgtaaccccaagtcccatccccagaggacactgggacagtcacactgatggtttgtccctaagcctccagcatcaggagccatgtggcaggatctccactcttcttcttcctgggcctctgtctggaccgacccaaacacacacacacacacacacacacacaygtgtacacacacaagttgcttctttgctgcctgcatgtcctcacaccagcttatgacacacctacaatgtttgatgtgtcattgtgggcaggtttcaagttggaggacctagacctaggtaaagtagagggtctccctaagtaagggagggtgcacagtggagagaaagggtaggggagactgcccagtgccattgacatatgcctgagccccagggcacccttggccccccaaaacaatcacaagtatcccccccgacaaacctgccaagtaggcattgtgtctccacttgacagttgaggaaatggtccctagaggggagacagagctagctagagactgggctggccctggagcctggcctgggtcttcccatcgcatcctgcctccstacataagcaaaggtcgagaggtgggaactcccaaagatgctcaggcagggccaggggagaccagtggggcagggaggggacaggaggggaaggaggagctggggctggagagatgggtaggagcatgagtcccttgcctgggcctccccatggtgggcggtgatccaaaagccccagtcagagccctctgccctgtgacgggggcaccctgcatgtcccctcactccctgccctccagtccccgccagtcctcatgttttccatgaggatgagtacagccgcagggactttccctgcaagtggtctgggccrtatcttccgggagtctgtttggactgtggtgtctgtggctgagggggtggaggtgagggcacccaggcccatcacttgacagaacaatctgtggatttgggggaaagaggaggcgactgtcattcctgagagaggacgggaaccaacaggaaggattcctgagtgccagggatgaccacactggatcctcacaacagccctcctgccggggacaatgctccttatcccacaagcggggacctgggctctgacaggaggccacacacttacagtccctcccttagtgaccggcagagctgggatttgaacacccctggtgagactccctygtccagaccccttcgttgtacagcaggtttgcctcacatgccagagtcggggtggcctcagggcacagccaggagatgtccccaaatccmgaaatgtggtttgagtcccagtccctcatctctccagcctccaagccctcacctatgcaatggtgccttgcccggctcacaggttatgaaaaggggtgagacgagayagtgtcccctaaatacatctgacagcacttttgaatggaaaagagaaaaagaaaatactataagcatccagattgactggaggttggggagttggtgggggcggggacaggcaatccataaagcaagaaaaatcaggctgggttcaggcttttctgcagcagcgaatgcatcagagctgccaggggggcagctgtagacctaagagagttcctttaagcacaaattggctgattatcttttttasgtaaataaacccataattcattccaaacacttggcttatttaaatatttttattgccaaaggaatatatgttcttcacagaaaacttggataccatgacaaacagtaaagaaaacccaaaagcaacctatgatcccatgctcaaagacaaccagcgccagtaataatttggtattttgccttctcaacttttgaactttgttgtatgtacaatttggttacccagctttttgttcccctaacrtgttatcagaaacattctctcatttttggtgaactcttagaagcatccttttttcatgtctgcttgacatttgttgaatggatataagatcatgtatttaaccaactgcctggtcctaaacatttaggttgtttcctgtgacccttcttctgcatgatgaggaacatctctgtgcataaagcttttcctgtccttttgattattttcaaaaatgccaaacaaaaaaaaaaagggagggggttgaaggttctgggttttcttcactgaattatccaaatattaaatgatctagagacaggtttgggagccactaaaccctctcctcctgtctgaccctattcagagaagacattggaagctgccatctgctttcctctcacagtctgtaagtggctcattaaatacttgcaaactagattatttttatgttgtcttggctacaggagtttctgcaggaatcagaaacaggaagaaaaggcaggtccttggagacagaggagctggcatctcatcagatgcaatttcttattaatagtcatccctaacattgattcggcatctactaataatcaatcccttcttacagataaggaaactgagtagcaataatctatcccatcttacagataaggaaactgasactcagagaggttaagggcactgcagtaagcgcagacacagagctatgactcccgttctccctgtgtcagcccctgcgcagtgygagtgggaggtgagccactgttgcgtgccctctgccagacayaggcctgcaggtcagactcacaggrgccaagcagagcatctgggaggattttgtttctggctccaaaaatgaaataccaaggaaagtaggcaagctcatgcatgtcagaatcctcaatctcagctcaggaagtaggaattttccacctttgttagcagcagagatgacaaaccccagggccccacatatagcctgtrccttagtcactgcctcgggccaggttgcaagacccctcctaccaactgagctacaaatcacagttcctggagggtgggcctttatataacagggaacagaactcttctgtacctcscacytccccgcaagaagtaggccaggcatggtagctcatgcctgtaaatgaagcattttggtagaccaaggtaggagggtcacttgaggccaggagttcgagacaagcctgggcaagatcccatctttaaaaaaaaatttaaaaattagtgagctgtggtggcaggagctgtggtcccagctgcttgggaggatgaggtgggaggatcgcttgaacccggtgggtagaggctatggtgagttataattgtaccactgcactccagcctgggcaacagagcaagatcctgtttcaacaaaagaaaaagaagagagaagaggaagaaagaaggaggagaagaggaagaagaaggaggaggaggaggaaggaggaggaaggaggaggaagaggaaggaggaggaggaaggaggaggaggaggaaggaggaggaggaggaggaaggaggaggaggaggaggaggaggaagtaggagaagaagaaggaggaggaggaggaggagatcctacagcactgtttggaggattatgggaaaattaggcccacacatctgatatacaatcggcacatcctacaaatgtaaaatgtgtgtcttgaaccagaaagcccaaggagtgaggggctgtggcattgagtggggtagctatacatagccctagggcttaaatctatagaatttaagtaatcctggtccaaattcaccagaaacattgcctagactttacttgaatacctttagtgacagggaactaactactaccaaaggcaactaactcagctcagcaaacattcagtgatagctgcgcttccccaggaccagagattcagataagcaaacaccctgttctgtgctcaagggactgatggtgtgtgacaatcgagatagtgtgaagaaaaaggacagcatatgtgtgtctctgtgcatgcatgtgcaaacactgacactgcagtatgtattcagaggaagtcactacaatggtgaggcccacctggcaccagaatgaacagatttaagaaagctagtcaccgcagacggtcacagctggaaggattttacaaaataatctatcttatcatcctcctttgccctagagatggggaaactgaggcccaaagagtgaaagccacctgctcaaaggcatattgttgagtctaataataaaaataaccatagcaatagcaacactgagggcagctgtcccagatggacgctggctccatgccagcccctgggctaggcgtctggtggcactacctcatttcactgccataacaactgggtcccccatcttgcagatgaggaagcccargttcagagaggtgaagtggggggctgggggtctatcccagaccttgttgtcacctcctcactctcccagtagcgccagccagagcacctgtcttgggagccccgaggcagggacaggctatgcatccaggaagcycccaggctctaaggaggcggccctataactgctggatgaccaaaaatcaggcagcgatccctaagtcccttctgagccccaggctccagrctcctccaaccaggtctgccttacgcttttgaccacaatcaacccggctctttctcggttcttttcatctctctggtggttttgtatgcagagtcacccaggtccccacttacgagcctgtgagatgggataaatcacttccctttgctgagcctcagttccttcacctgtaaatgggcataacaagttcctccaggacaatcgtgaggctcagggaaaggactgtcgtgcaaacccaccatggcatgagctgtcgagtgcagtgcccgctgccactaaggaatgagtgccactctgggattgtggaaagtgcagasgggcagggttgagatgctcgtgcatgactttggacaggtcacctccctctcagaggtttagtttccttacttgttaagcttggactaaaaatatctaaatggtgagatttttccaacttctttggctctagcatgtctgtggtccttgatggtttacaaagcgcttttgcacttgagacccctaagtgctaattctaccacatccccatccacttcatagtgggatgaccttagccaaggctcttcacctaaacytccataagcccctcgctggaatttgagcctgttttgcttttttaaagtgagggcaatgctactggccccacccatcttacaggacaagggaagcccaaggacatgagagctttctgagctgcatcccaggccctgctctgccactgactcgctgaggctgggtttccccatctgcaaaataaggacatraaaacccatctagagctgggcatggtggctcatgcctgtaatcccagcactttgggagtccagggcaggcagatcacttgaggtcaagagttcgagaccagcctggccaacatggtgaaaccccatctctactaaaaatacaaaatattagccaggtgtggtagctcatgcctgtaatcccagctactaggaaggctgaggcaggataattgcttgaacccaggggacggaggttgcagtgagccaagatcacgccactgcactccagtctgggtgacagagcgagaccccatttcaaaaaaaacaaacaaacgaaccaaaacaaataaaaacccatctagagtgttgtggggattaaatgagttaatatctgtgaagtgctttgaacagagctggcacggccgggcacggtggctcacgcctataatcacagcgctttgggaggccaaggcagggatcacttgagcctaggagttcaagaccagcctgaccaacatggcaagaccctgtctctactaaaaatacaaaaattagcagggcgtggtagcatgctgctgtaatcccagctactcagaaggctgaggcaggagaatcgcttgaacccaggaggcggaagatgcagtgagccaagattgcgccattgcactccagcctaggtgacagagcgagactctgcctcaaaaaacaagaaccaaaaaccccttaagagaaatggggttttctcttatgagaaaaataaatatccccggtgtttcctctgacttgcccagggctgcacagctcacaggggaggggtggggaccgggacctggcacttggctcctgctgctctgccctatgcccttggggacttctggacaagggtgggcttctctgggctgacagaggagacagaggcaatggtgtgctggtaaatggttaacaactggctctctggaaaaaaatgccctaactgtagcaaaaaaaaaaaagagactagaactggcacattgcagatgatataggcatttgctgtcactatcagcatcagcatcattacttgtcctttcaacaaatatttcctgagcccctgtcgtaggccaggcccagtgctaagaggtggggacacagtggagggaagacagaaagttaagtgtgctgtttccataaagtgtgctgacagccatataggagcactggggctggggtgtctctacggtgcctgggagggtctcctagagaaggtgacatcaagcaggttctgaaggatgagtaggagttggaaggagttggaagagctcctgccctttgtggagcaggagagggaggtggtccagggacctttctggccgaccaascctagagccaattgcagtgagccattgtgacattggacttgaaactggtcactgcgagagtatttataccatagaaatttgcaaatgctacggttagggcatttttttccagaaagcccgttgttaaccatttaccagcaccccactacctctgtctcctctgtcagcccagggaagcgcacccttgtccagaagtccccaagggcatagggcagagcarcaggagcccaagtaccaggtcccagcccccacccctcccctgagagttgtgtggtcctgggcaagtcagaggaaatgccgggggtatttattttaaaaagtgtctatcaggactctacattatgccaggggtctcaaaggtgaaagaggcatgagtttgtccctcaagcagctcaggaggagctggaggaggtttcctaggcacgagcttatccacaccatgacacatagaccctgaagtgttttaaatcaattacaaaaagcaaaaatacaaggaagctgacagatctttactttgggagaagtggaggcttgggaacaaatgagatcatcaaggtctttttgtccgttttctaaggagttggggtcattggctgagatcctgcagatctggaggtaccaacatgagactccgagggccacctcctctgcccctccctccccaccccctttaaggccctctctggaatccatcccttttcctccatctccccagacctggctgaggcctccgttgtgcctctggtctggtgcctcagccccctcgcttcctgcttccagattttgccaactgccccccacctttgaccatgtccaggcatcctggctcaaaagccaagatgagatctatacttgagagcgtatatgagagggatgcaactgaggctacctggagtgcgtggacacagccatggcctcaggtcatcatctcccccacgaagcctcccacacctcctgtccccawcttgggcacacttcccaccacctgggagacccctgagggcaggcaccatctgtccttcaccactatatccccctataaagagagataatgcagtgaggtgccggggttcaaatcccaactccacccatcaccagctgtgtgactctggacaagccacctctgtgtgactctggacaagtcacctcactgctctattcctccaatttttataaaattgggatagtaccagtgcctgcatctaaaataggtgtggattacatgaattatttcatggaaagtgcttagaacattgcttggcattcatagtaagcctccaaaaactgaagctattattattccctggttgctggcccagactaagcactcataaatttgttgaatgaatgcaatgtaaacagggaaatgctctgtaaatgctggtgcaagctcatcagcttcgttgtcgtcatcagcattgtcctgatgctattcatggtgggtgtcctgtctggagccctgctggctgtagaccaccaatgtgggcacagtcctagcccctcgctcaagtagggtatgcgaggactcaggagacgtcaacagacattcacagtatttacactgggaccttggaaccagtgtggttgagtagacacccggaggacagagttctgagtttatttgggaggggttgccggggagagtcagctgtctggaaaggcttcctggaggaggaagatttgctagaggtgcttgagtggttggtgcaagggggcttgtggggaaccagagcgtcctggtgtttagagcagcaaggaagaggctgggtaaggacaaaggacaytgggacagacagaaagcctgactctagaaagaaggggccaaggtcactggagaggagagagaggaaggattaaggacgattgagtgggtcataggggttgagggctctgtgtagggaaaacagtttcccactcaatcctttcgatgccactgtgattaaatgtgtgggtttatttcctcagaaattgtcttacaattccgttcagttctgacattatctgcccggaggcagcacaggataagagctcagtcccacaagactgccgccacttcagaacccatcgcaagtctcaagtggcctgcacttctgaccaaccagctgtaaggcagggttcccacaaccccctccacgggttcagtaatttgctaggatggctcacagcatcagggaaacatttacttacattactgacttataataaaagacaccactcagccacagccaggtggaagagaggcacagacccacacgtggggcaggggcctggagcttcggtgctgtctctgggggcaccaccagctcagcacctccctgcgttcaccaactcggaagctctcccaatcctgtcttttagggattttgatggagrcttcatcatataggcatgatggataataaattcaatctccagcccctcttcccttcctggaggatgtggggtgaaagttccaagctttgtatcatggtctggtcattctgatgacagcccccatcctgagcctatccagccaccaccaagagccacctcattagaacaaaagatgtgcctatcatctagaaatgtcaagggagttaggagctccgtgtcaggaactggtgtcaaagaccaaatatgtatttcctaatatatcacgatatcacaggttgtgagaagaatgcmatcaatggtcaaactccagagctgcacactctccaatatggcagtgaccagccacatgcagtcaccaagcacttgaaaggtggctgcttcaaactggtatgctaagtgtaaatacacactagattttgaagagttagcaggaaaaaataataatataaaataactcaatgactttttgtattgattacatattaaaataatgttttggatatatttgattatatctcatatataaccaaaattgatttcacctgtgtctttttactttttttaatgtggctactagaaaatttgaagttacttctgtggctaactttatagttctattggacatcaccgaccgctctaggctatggaaaattctgtagaacaaacaactggaagttggaagaaaagacagtaagaaatagcaaggaagggtgtgctgttgggagttgcttggaggttggcggcacagggctgaaggctagcaaaccgagcgatcatgtcacacaaacaaattcactattcggacagatacgacgacgaggagtttgagtatcgacatgtcatgctgcccaaggacatagccaagctggtccctaaaacccatttgatgtctgaatctgaatggaggaatcttggcgttcagcagagtcagggatgggtccataatatgatccatgaatcagaacctcacatcttgctgttccggcgcccaccacccaagaagccaaagaaatgaagctggcgagctacttttcagactcaagctttacacagctgtccttacttcctaacatctttctgataacattattatgttgccttcttgtttctcactttgatatttaaaagatgttcaatacactgtttgaatgtgctggtaactgctttgcttcttgagtagagccaccaccaccatagcccagccakatgagtgctctgtggacccacagcctcagctgagtgtgaccctaggaggcacaatgtgctctgtatccagaacacacttggcagatggaggaagcatctgagtttgagaccatggctgttacagggatcatgtcaacttgctgtttttgttttttcctgcctggtgttgtatgtaaggtcacttgtggatttatgtttcagcgtactggaaactttccattttattcaagaaatctgttcatgttaaaagccttgattaacaaggaagtttttataatctaaaaaaaaaaaagaaatagcagggaaggctgtaggtgaaaagaaacttaagagacctatcaaacaacccaatgtgtaaagtcatttgcattctgattcaagaaaaccagctgtgaagaaagtagcgtgaaattcatatgattgaaagttgtaatacttcctggatagttgatgccatttaggaattattgtcagtttcttcgagatgtgataatggttgtctagttatgctttctgaaataagagtccttagcttttagagaagaatagtgaaatatttacagatgaaatgacagacatgcaggatttactgcaaatattacaggaggggtarggtaggtttgggcatagagaaaaagattggctgcgagttggtaattactgaagctgggtgaagtatgtggagtttcattatgctagtctatctacttgtgggtatattccaaattttccataataaaaagttaaaaagcaaaaaaaagaaccatcatctccacctgaggttctggcccagactgcttatgttcaaatctcaactctagtcttgctagctgtgcctctgtttgctcgtctgcaaaatggggatgataatattagtccctacattgcaggggtttctctgtaatgtgcttaaaaatatggaaacaatataaatgaaatgaagatatgttgcaggcactttgcacattgtcacggtgctcccagtgccttgttccagggaggttatccttatttaccaagaggttaagtcacctgccctaggtcttccagtcagtggaggcaaagccaagacatgtcccgagttcatctgacttctgagttcaggcatgacctgaatgttcttgcctcgggctcagggctcaacatttcctgtcttctctgcttctccagtcctgagagattctgggcccgtttccctgcagatcagctctaaggaacatgcttctctcctgctcctttctagaaaaggcgtaacattggcagaaccaggaactctggaattctgaaggttgactccctcaattccaaggggctccacctcctgagcggaattggatagaagacaaaggtcacatggctagggtgaggctttgagatgggcgagactgtgagcaggactgacaggtcagggccaggacccaggatcttcagaagccacagggagcaaggcagggagcagcctcctttgtgccacacccagtgaaggggaacttgctaagacagatttgttcctcccatctccagaagagccgttggatgccaatgggtgaggagctgaacctctgcagactcagtgtgctgatcccattgcctctgcttgcatgcctctcaggatggggagttcactgcatccccctctttaaagacattacggttgtacaaaggtctccagaatcatctrttacatcccctcattctyccaatgaggaaattaaagctcagagatgccgaggcatttacccaagggcacacctggtcctgggcctacgacccrtagacaatattccttccacctctttgctatagagtctcagactagggatcttggctggctgagaaatcagggaaggcttcttagaggaggtgagattggaggtggcccttgtagggtggcactaagatgtcgcttgatatcctaattttttttttggccctgcccaccatgtgtgtgcctgtgctgccatgtcacactaagcagagtaaaatgaaggaaggaacggatgaaaggggcaggaaagcgactcccaggagctgaaagggcaatagtataggtcccttcagcacctaggatatgttgtgggaagcccttagaccccagatactaccctgtgcagatagggataaaactccacctgtcccagctcagtgctctccccggctcctctggcctgcttgctgggcagggcccaaaccagttcaggattcctttttctctgtgacctaccagttagggttctctgtttactgtgtctcctcctccttgttttgtatacccagctgggtgggaagaaggtcacagcccaggtttgcacgtggtggaggagcagggccagtaactggttaggcagagaccccgcccaccaccctccactcccaccctagcagggcctgtgccatccccaggacaccggagaccaccagggggctggagaggctgcgggagaaacagccttcctggacacacccagctacggctcacttcccagcctgagctgttccttaggaattgcttttctgggaaacacaccctcttccagacctgcagccttcctttctatgtggtttttggttttgctctctggtgagggtttctattttttcctggtatacatgaatggcatgcaggaaagtggaatgaggacatcatgaccaccatgcaaaggccattgctcttaaggtttgatgtaagctccccactctccacccccactacccctctgcctcggcctgggktatgaggtcttggttttgacaatcagacaatgttagcacactgctgtgtcttccacctgcaatgragcactgtaggacgattttaaaaagcaaagtggcaggccaggtgcggtgactcaagcctgtaatcccagcactttgggaggctgaggcgggcggattacctgaggtcgggagttcgagaccagcctgaccaacatggagaaacccccgtctctactaaaaatacaaaattagctgggcgtagtggtgcatgcctgtaatcccagctacctgggaggctgaggcaggagaattgcttgaacctgggaggcagaggttgcagtgagccgagatcgtgccattgcactccagcctgggcaacaaaagtgagacttggtctcaaaaaaaaaaaaattacaaagtggctgaataccaagatcctaggaactaggttcagccaaactggctgtgtgtcctggtagaatgcccaccctctgtctctgggcctccatgcccatctctgtagcatgagggattctgatgaaataatttccaagagcccttcccacactaatactccaggattctgtaaggttaatttggcaagaattccaacggcrgaagaaagatggagggaggaatatgtccagtctaataaccctatgctcaagtcagaaagcccctcgggcagtgtccgagagggctacagccctggccccagaacctgagtccctctaacctgggtcaaacccctaaaagccactccagcaagagacaggcaaagcccgggctcttgctccaggctggcattgccttgccgtgtggctgtagacatcgtttcacctctcgaggcctcagttttcccttctgcaaaagacaggctgggggaggttgggcattttcttcttaactaccaggagtctttcctccaataaaattgtgatggaaaccggatgtcacacaaagggaaaggaaacactggcatttctggagtgtttgaagcatgtgaagtattgtttaagggctttgcaatcattaatgtactttgtgctcacattaaccccacaaagtaggtgctattattatccccatttgacacatgaagaaactgaggccctgaggagttaagccacttgtccaaggtaaagagtgggagctgggcttctgatagggagtgggcctcagtcatgaaaccacaagacttgtgtagttccaaccccctggggacatctccaggcacttgacccatgctcttccaacattcatgtatgcacgcacacgtgtacacacacgtgcacacacaaacacacacatgtgtgcacaaacacatgcatgcacacacaaacacatgcatgcacacacaaacacacacacatatatacacacaccaacacaaacacamatgtgcacaaacacacgtgtgcacacaaacacacacatgcacacacacacacaaatgcacacacatgcgtgcacactgtggctactcctctgtagcctgctggccacactcggctcaagccccaaatcaaaggtgactagcaagattgcgagacagatttctggagatgggaaactgcgtcatcaaattgtctcagggayggaacacccatcagagccctgggggagagaagagacacggggtggctgccaattttgctgacctatgctgctgactttccagcagcccccgactcctgtggccagctgagcccaggtccaagctgccccctgcacagggcttgttccctggagggctataagccacagcatcccctccaagacagccagtcctgtgaacctgctcaatccctcactattccttggggcctgccctgggagaagggagagttccctggaccccttcttgggacttgcggtgacaggggtgtggctcacttgctcaaatcccttgtgtgaggggaagcatgcaagcaagtgggtgctggggccggggcaagcgcttttgggctctggccctacagtaccgtctagggttgtgttacaattaatgctcttttagmagttgccattcactgatggctaagtgttaaccaactcagtggagagtgagggtgacagccttttacaccytgccctcttggtacctgggtccttgtctggcatccaggaagaatcaggtcacacggacttgaaggatggtgaatgcagaggttttattgagtgatggaggtggctcttagtcgggtggrgagctggaaaggggatggagtgggaaggtactcttccagatggctgaactcttctccaactgtccagctgcctcttccacattcagacacttcttctcttctctccttctctgccatgctgctctgctcctctgccagtggagtttggggtttttatgggtatrggatggggggcatggtgggccagggtggttttggcaaaagcaacactcaggtgggaaaacaggaatgtgaagttctcatttagggccgtgggcccaggcttgtgggtggggcttttgccagagagctgtcctcctctacccagtatttccctgcctcctgtccatatcacctgcaccaagaacctcactgggtgggagccaatccagagccagagaaaggacttgacacttggcctcaggcagacccaggcttgaatcctggccctgcctctgatgagcagggtgacctgaactgtctcaggttgcctcgctgactctgctttcccatctggaacatgggaatagcaatgcatcagccactcagtgcagtgttgaggctggaacaggtggggcacactgtgagctccatttccttttgcctccacccagcaattatgtctgctggggagaagaggagaaataaggatcacaccctgccctctatcagtcagtcaacgaccatttattaaacacctactaggtgtcaggcacttgacagagaaatgaaataacaacacaagcaactcttatagctataccctataataaatgttatagaagcaggaggcaggtagaggtggaagagaaccttctgcttgcagggggatatcagtcagagaaacagaaccaataggagacacagattaagagatgtattgcaaggaactggcttatgtgattgtagggatgactaggcaagtcagaagtcgcttgggaatgccagaacactcagccttggaccgaagctcctgcccgcaagctgaatttcttcttcttccaggaaacctcagatctgctctaagtcctttcaactgattgactcaggcccatgcagggagttgaggacaagcttccttagtgaaagccagctggctgtgggctgtcaccacacagacaaactgcttcaccccaacaccaagattagcttgaaatggaataactggggcctgtcatccagccaggtggacccacagactcaccgcagcagagcacctagaggcggccacggagggttagtgacagagcagaatcaggcagggcacccgggcagggggcagacccagcaaaggctcctagggcagattgtagaagaggtccttggagatcagggagtacagcaacgtggctgtggcactattaaattaaattaaattaaattgaaaataaaattaaattaaaaaggattggtggctcacgcctgtaatcccagcactttgggaggccgaggcaggtggatcatgaggtcaggagatcaagaccatcctggctaacacggtgaaaccctgtctcttctaaaaatacaaaaaaaaaaaattagccaggtgtggtggcgggcgcctgtagtaccaactactcgggaggctgaggcaggagaatggcgtgaacccgggaggcagagcttgcagtgagccgagatcatgccactgcactccagcctgggctacagagcgagactccgtctcaacaaaaaaaaaaaattaaaaaggattggaataaaggaatggtttagtaaacaaaaataaacaaatgcaatgccttttttgaaggcgtcattactacagccatgatggagcaacacggataaattcccatgacaggaggtttcatgtaaaaccacggtgacagaacacagttggatgtggcatacataaacagctgtgcccagggatggaactctgggagattttcccattagttttaaatgctctttcatgtagttattcttttatttttatgtttttgagacggagtctcgctctgtcgcccaggctggagtgcaacggtgcgatctcggctcactgcaacctctgcctcctgggttcaagtgattctcccgcctcagccccccaagtagctgggattataggcgcccgccaccacacccagctaatttttatatttttagtagagacggggcttaatattagttttaaatgctctttgctgtagttttttttttttttgagatggagtctcgctccgtcacctaggttggagtgcaacggtgggatctcagctcactgcaacctctgcctcccggttcaagcgattctcctgcctcagccccccaagtagctgggattataggcacccaccatcatgcccagctaatttttgtatttttgtagaagtgaggtttcaccatgttggccaggcttgtcttgaacttctgacctcaggtgatccacctgccttggcctcccaaagtgctgggattacaggcgtgagccacagcacccagcctagttatttatttatttattttttttttaaagagagagatgttattttttttaaggggaatgagtggtattaggatgtcaaatgaaattgcttatttaataaaactgaaaagcccagtttggggaaagaaacaaaacacactgagcagaataatctaaccacagtgaacaggaaaaaaagccaagaataaaataagttccggggtatccaagggtgagcaaagccaggccggcaggcctcctcctcccttgcagaaagcaggatggatgaggggctctgcttctccaggctccctcatgtccccactgaaagtgtttccagaacattccaggcccataaagtgtccaaatgctggaaggacttacatgtatatgtctgggattgaatcaaatcttctgactcaattctctttgggagttctgagaatggaggtcacttcccagaaccccgtcttccccctacagacagctttggccttcttttcagggaagaaaagaaaagggactcttggaaaccctgctgagggccacgcagctctggttgttgaggctcatatggtttatgaggcgccatcacccccttccgccaccccctgcctgctgtggcctgaggcttaccttcgtgactgccctaaaaacagcatccagactcagtaaccacgtcaatcagcttttagaggaaaacatttattctggggaggtgtcagggaaaggattcaggagatcttggttctttctagctctggccttgacatcgacttgctgggtggtctgaaggatttcacttatttacagagcgaatattgttcaagagtttgggatgtgcaaaactcagctgcaggcgtgatgcagggtgggaagatgagcaaggcagggtcctcctctccaagtacagcgaatatggtgggacagatgcacatgcactttatgcacgcatgcacgcacaccatgtgctcagctgccactgagaggagataggagatgcagagggagagggagaacagccgccctctgactaaggatggagcccagctgtctcaagagctctcctggatggacagactggtggcgtcccagcaaaatcccccatctctccatccggctgtgtaatgaatgactggaaacctcagctggcctgtgagcaggagatctggccaggtggaagggaatccctgacaccccacagcccctggtgtagctaaagcagacgggcctcctgggctggtgcaggaagaacagcttatgttctcgaacacattgaccacgtgctccatgcatctgacacacacggactcgtctactccacacagcaccctaggagatggggctgtttaaaataccaatccccactgtatagttgaaaaaaacgaggtgcaatgaggttaaataacgagctctagagaggaggactcaattcacagtcagcttccagagcccatcggcctaaccgccaggctggcttcccgtccgtaatgcacgtttccagctagaggctttcaggctgtgtttcccacacttagccattgacattcacgttcacagtttttgccacatccatgtcacctgtacaaccatttctttagtagtgacttacttttgaactgcaacttcatgtcaccaatttaaatggaaaatgagtatcacttatcataaaaaagatgataactgtacaaaataaaagcaatagaatgtgaacaatgctattagagcctgggtagattcggggaccagccaaggctctgaacctgctcagtctgttgaaaaaggagattacgcacatagaaaggcgttgaagtgcacggacaccacgctgagacgttcttgttggcctaatcaggaggaacgactagattattcaattcaaggttgtttaccaggccaaactacttcccttgctgggaaatgcttcccagctctaacgtgcagtcagaaaatacgggacacaagttgacatccgaaggaaaaatatcttttccttctccacttccgagttcttggttgggggccctgaaacaaaaaacagatgaacaagagaaaagtgaacaaattaatttaatgtaagtttaatgtgacatgggaaccttcataaggaaatgaagtgattaagcctgagtgcctttttgtttttttgagacagagtctcgctctatagcccaggctggagtgcagtggtgcgatacggctcactgcagcctcgatcaccccgggctcagctgatcctcccacctcagcctcccaggtagttaggaccaggactacaggtgtgtgccaccacgcccacctaattttttggtactttttgtagacacagtctcggctgtgttggccaggctggtctcccactcctgggctcaagcgatccgcctgcctcagcctcccaaagtgctggggtcacaggcatgaaccactgtgaccggcctgagtgtttccattagatgtcatgaacagtggagaatcatggggctgtggtgggaccagggggcacgagcgaagtacagagaactggagaaacagcaaggcctgtcggggctcctctcagtgtccccagtgctcggagtggacggtgcccctttcctctggctgtggagtctggtgtcctgcttcagggaacaatcacatagtccttctgcgcctgctgtttcttggattctttccacttaaaatattcaacatgcgaagctgccacattttggggtagcgtgccctgaatcattggctacaaggtcgcgggccccacatgaggcacagttggcccttgagacagtgacactatgtatttcgtggaggccactgcttcaaaggccctaaggtgtggattcctgggaaaccaaaacaggctgtctccaaggctcaagtggaattgatttctaacagcccaggcccacggtgtctgtgcgagtaaatgaagaaagtgtttttacagtaagtcttcttggatagaattctgagggagagagagaatgagtgaatcagaatgttggatgttccctctaaggcatctgtttaaaaaatcaggggaaaaacccaggagcagagtcatcacctgtccccagctctgaggatctgtgtctgtgaggcacatgagtccaccctcctagctctgtagacaaggaaactgtggtccagagagatggagatcccacagacaacggcccacctggagcaccccctccccgcctgactttatattcccaggatgcattcatcagggtctcagtaaaaaaaagagggcacattccaattgggtaataggaagaggatgttaatgaagcgtttctttacagtgctgtaggcagcatattggggttctgcgaagagcaggcagcaccctgggtgcctcagggctggtacggcaaagcctcagcaccctccctacctccttcccccctcgcgatcaggcccctgataaaagcagtgaactctgctccaggyctggccagcataaaggcccccaagagaggagccaacaacaccccatcctccctctcaccctccctcaggctcctgctggggctcccactggccaaacccaaagagaagccggaaggcaaagagctccgtggtacccatcagggctcccaagcaggggccacagaggagaagccaggaggtgacctggagcaggacacagcagctccctgacagggatcctcacccagggcacgcctctagtagcagatggagaaaacaactcagtagacttcagactcccaaattctcccagttccttaacccgcctgccctctggacttcgggagaaagttgagagggaaagccctcaactttgttttgaaaatgagagcaatgtttacagccactagcaagcaattaggatccagctgggctgatgtggccagatctggggacacccagccaggtagatgcacaacagacccataatggaggccagcgaggaaacgctggacacgtcccccatgactgagctgtgaggacctgacttatctgtgcggcggtcactgtcgtgtagaaatggaagctgtacatgcaggctgaggcttctcagctggacagttcagcccgagtgagccccaagaggacaggggaggctggtcttcattcttcccctctgaatcaccagcaaatgatagaccgtcaataatttgttaaatgctttttaaaatgaatgctttaagccgggtgcagtggctcacatctgtaatcccagcactttgggaggccgaggcgggtggattgtttgaggtcaggagttcgagaccaacctggccaacatggcaaaacctcatctctaccaaaaatacaaaaattagccaggcatggtggcaggcacctgtgatcccagctactcaggaggctgagacaggagaatcgcttgaacccgggaggcagaggttgcagtgagccaagattacgccattgtactccagcctgggtgacagagagagactccgtctcaaaaaaaaaaaaaaaaaaaaaaaaattacgcttcaaacacatgatctctcaccactgttgaattttctttctatgagcccaggagggcctctcagagaggaaagctcctaggtcttcctttccctctgcaaactccctgccttgaaggatcagaaggactgtgctgstcgttgcatcctttgcaagttccaaaccctgatcccagctgtgcttaggggttcctgcaaaycttttccaggtgttaattacctcccacttcatttcctgtttaccaactcagctttttgttttagtgtgtttgaattccctgaactgaccgttgtctgatctccacctcccaactgaattaggggagctgggcttctggaaacccaggtgccgggtgttgcagagtggctgaaagctgggatgtggcagatccgtggctacattcatgcacacacacacacccacatacccacacatgcacacacacacacacacctgcactcacacacttgcacatgcatagaccacagctttccacacccttcctagacaggggtcacttggtrtcctggagagagtgtgaagtctggaakggaaagaggggggattaagccccacctctagccatgggactgagacaagtcacccccacccatctgcgccttgtttcctcctctgtgaggcaagcacagagcccatgcctccctccctggatgggagtgatgtgaaacttgaagaggggtagagayaagggtcgtcaatggaagccccttgggcaaaaaggccctttcaactaggggcacagaggaggccctgggctgagaacttgacagcaccttgtattggtaaccagccggagggactggaaatactcagatgtgtctgtctcccttattaggttcaaagtccctcragaccctgtctccatcacagtgctccagtccagacccctcctctgagctccagaccctgctggacccaacagccatccccatccccacctgcctggaattctccaaagaacctcccctttaacagttccagcctttaacagttccagtctaaacacatgacctttctcctctaaatcagccccccatctctgcctttgcaggagatggaagccatgacacctgcctcgcccctgtcctcaccccatccatgtccaatcaagcactaggcatgtcaggtttaccctctaaactcctctggaatccagtctctcagtctccatcatcccaggtcgaagctaatgggctaactggtccttgcttccactctacccccactgcagtcctgacttcctgagcagcagccagggcctaatccatattcacaccaagcgccttcctgactgagatatcctcctgcaccatcatccctccaccctgtttagttctgctcaccctcagtgttctcatcaataatccactcgccctcacaggcgcgtttgggaccccatgttctatgctctcacaggaccttttgcttgatttttcactgtaytyaggtcagtttgcagttattaagtgactgagcaatgtctggcttctccagtagactgtcagctcctagccattgtatccytagcaccgctgtgtgggagcacttcacaaacgtccattgagtcagggactcagcagtctccatttcycctccctgctggagaatgmgtgtattttgcaatccccagcccctgtgccatctaaccrtcttttcttctctgttcagcccaggtgtggcctcactcacatcccactctgagtccaaatgttctctccctggaagatatcaatgtttctgtctgttygtgaggactccgtgcccaccacggcctctttcaggtgagtcaaagggattcctcagttcactagttagrggaggtgggcagacaccctggagaactccctggaaagctcaactctcatgccccggacaacagttgaaggaaccagtgatgttaagcccaaagacaaaacctctcaggtgtccaagtccctgtaggcctgttgggagcagagggaatgttctgcggaactagaggaagaggggctcagggagaagaagggcacattcctggttgtcatatgtgatctatcccagatgaacttggaagtgaarggaagagagttaaacattaaagtaaatacccagtggatcagacagcaatgtgccagattgccttggagacaaaatatctccaacacatggctgacatttggtgggagatcagaacaccctaaagagagaatttaaggggagggggaggaggacctgagccagagtagaagcagaggatagggagatctgttcttggggacagcatttgcaagaaacaaggctgaggggtccactccaacctctccaccctgctgcaggtgctgcctatgatgaagatgagcagatggccatctcagctggggccacagtgcactggacctatagtttccaattccgcactcagcaggcatctttctgatgatccgatggcttctcagagccagggatgggccaggatccatccccttggctactgtcttgctgagaaattwataagcagcatctggtgctatactttggtctctagtgagttagctcatgaaagatgayagactctccaagccaggggtaygcaggaaatgggttttctgtagctacagaaatggggttgagggttggaccaaggsgactacccaggggaagtcttaccttcagaggactctggaaaggaggctgcaagttttcatgggtcaagaattcagagcccagtagagacagcttatctctgttccaagatgtctggggccttggttggaagattcaaaggctaggaaaccaggagccaccaaaagcgtaactggggccagaggatccactytcaaggtggcaagttggttccccccatgtggctgcttgagtatcctcacatggcggctcacatccttccaagtaagcaatgcaaaaggccaagaaagatgctgcaaagcatgttatgacctagcctcagaaatcacacaccatccctgccaccattagtaagaagtccagcccacrtccaggagaagaggaagcagattcctccttttgaaatgaagaatatcaagtaattcggggggcatatgaaagccaccacacaccacagggatctttttagagcatacttcttataccatcactgtagttccttaagactcaggggcaaagcctcacttccttagcacccagtgaagaccacgcttactccctcactcaacctcttgctacttcccacctctccygtccaacatctagtgtcactttccagaacataccaacagcttccccagttctgtgcctctgctmaggctgttccccctgcctggtccacttgtcctccttcttgtccsktcaaaatgcttcttatccttcaagacccagctctagagtcacctccarccccttacccaccagccycctctccaagtctgtgtcccacaasccccctgctccctccagggcmccctccaccctctgggccacagttgtcaggagtcaggcagggcaggggccrggtggtgtcttctttgtgttcttgcactcagggcagagctcagcacagagcagacgctcaaaaaacatttaaaggatagaagcattgatttgtgggtcccccagtctggctccaggatgccagccagctgctcctagaagcaaacggacttttcctgggaaatcccagaggtgatgatcagtatctctcccgtgactcgtagttcagctcttcctccatgagcctgactatcagtggaccttccagaaagagccccttttccttctctcacccacagcacagggcactgggaaaatgcccaatgagtcctgccctctgggttgtgctttggacttttcagtgtgtcttcgcatccactcttcarcttgaatgttgcaacagccatgaaaaaagaaatgcaaagcgattcaggatgagagcaataccctactccaaagaaggcaaaatagaagctcagagaggtcaagcawtttkcccaagaccacacagctaggagtggaactcatggctgtccaagccccacgcctctgctgaaggtagagatgaattacagcaacaagtctagaaaggtgcctgccctatggtctgtgagtcttgcctaagaatgaaagaggagccagtgggttaaagatgaggtcaccaacaaacggtggtgttggagtttaccactggttattttaatgggtttgcaagaattgttaattactaatgtttattgagcctagtgcagtgcttggggyattttgcacattgtctctgatccctatcacaaccctgagaggtagtttttttaactcccattttacaggtgaggtcattgtggttcaaggacgttaagtaacttccccagcrtcacacggcttataagtaaggcagccaggatgtgaacccagtaggactatctggctgcaaagtccccaccctccctcgccatctgtatcctccaatcaycttcagtgctttgctgatagaaggtacggaaatacgatgccacagactgtcsaggaagacagaaactaggcagatgggctggccatggtctccaagccagactggaatctccaggtctggaatgatatcatttttctcttttaataaattaactcacccaccacacggctttgagaggctcaaagktgaccaactcccttgggagggccccggttgataaggaaggaaygtgaatcctcccatcacggaagcttcaaggaggtcaagggtccaacacttgagattgttagtgctgttggtggatactggccaaggaaatatcccagtggagcctcgagatgargaacatgaggcccccgtttagatccaaggatcagagggggctctgtaagacccaggggagtcaggtgcactggagcgcgggctgcagaaaacagcctgagctccacctcggcttctccttgycctggctggttgtccttaacccctgtctccttctggaccagtttttgtccttcccttgtgaccctgaggggtaacagcctcttttccactttctttcagcgccgacatgctcaatgtcaccttgcaagggcccactcttaacgggacctttgcccagagcaaatgcccccaagtggagtggctgggctggctcaacaccatccagccccccttcctctgggtgctgttcgtgctggccaccctagagaacatctttgtcctcagcgtcttctgcctgcacaagagcagctgcacggtggcagagatctacctggggaacctggccgcagcagacctgatcctggcctgcgggctgcccttctgggccatcaccatctccaacaacttcgactggctctttggggagacgctctgccgcgtggtgaatgccattatctccatgaacctgtacagcagcatctgtttcctgatgctggtgagcatcgaccgctacctggccctggtgaaaaccatgtccatgggccggatgcgcggcgtgcgctgggccaagctctacagcttggtgatctgggggtgtacgctgctcctgagctcacccatgctggtgttccggaccatgaaggagtacagcgatgagggccacaacgtcaccgcttgtgtcatcagctacccatccctcatctgggaagtgttcaccaacatgctcctgaatgtcgtgggcttcctgctgcccctgagtgtcatcaccttctgcacgatgcagatcatgcaggtgctgcggaacaacgagatgcagaagttcaaggagatccagacrgagaggagggccacggtgctagtcctggttgtgctgctgctattcatcatctgctggctgcccttccagatcagcaccttcctggatacgctgcatcgcctcggcatcctctccagctgccaggacgagcgcatcatcgaygtaatcacacagatcgcctccttcatggcctacagcaacagctgcctcaacccactggtgtacgtgatcgtgggcaagcgcttccgaaagaagtcttgggaggtgtaccagggagtgtgccagaaagrgggctgcaggtcagaacccattcagatggagaactccatgggcacactgcggacctccatctccgtggaacgccagattcacaaactgcaggactgggcagggagcagacagtgagcaaacgccagcagggctgctgtgaatttgtgtaaggattgagggacagttgcttttcagcatgggcccaggaatgccaaggagacatctatgcacgaccttgggaaatgagttgatgtctccggtaaaacaccggagactaattcctgccctgcccaattttgcagggagcatggctgtgaggatggggtgaactcacgcacagccaaggactccaaaatcacaacagcattactgttcttatttgctgccacacctgagccagcctgctccttcccaggagtggaggaggcctgggggcagggagaggagtgactgagcttccctcccgtgtgttctccgtccctgccccagcaagacaacttagatctccaggagaacygccatccagctttggtgcaatggctgagtgcacaagtgagttgttgccctgggtttctttaatctattcagctagaactttgaaggacaatttcttgcattaataaaggttaagccctgaggggtccctgataacaacctggagaccaggattttatggctcccctcactgatggacaaggaggtctgtgccaaagaagaatccaataagcacatattgagcacttgctgtatatgcagtattgagcactgtaggcaagagggaagaaagagaaggagccatctccatcttgaaggaactcaaagactcaagtgggaacractgggcactgccaccaccagaaagctgttcgacgagacggtcgagcagggtgctgtgggtgatatggacagcagaagggggagaccaaggttccagctcaaccaataactattgcacaaccayctgtccctgcctcagttccctcttctgtaacatgaagtcgttgtgaggrttaaargcagtaacaggtataaagtacttagaaaagcaaagggtgctacgtacatgtgaggcatcwttacgcagacgtaactgggatatgtttactataaggaaaagacactgagktctagaaatagctccrtggagcagaatcagtattgggagccggtggcggtgtgaagcaccagtgtctggcacacagtaggtgctcattggctcccttccacctgtcattcccaccaccctgaggccccaaccrccacacacacaggagcatttggagagaaggccatgtcttcaaagtctgatttgtgatgaggcagaggaagatatttctaatcggtcttgcccagaggatcacagtgctgagaccccccaccaccagccggtacctgggaagggggagagtgcaggcctgctcagggactgttcctgtctcagcaaccaagggattgttcctgtcaatcaatggtttattggaaggtggcccagtatgagccctagaagagtgtgaaaaggaatgrcaatggtgttcaccatcggcagtgccagggcagcactcattcacttgataaatgaatatttattagctggttggagagctagaacctggagagctagaacctggagaactagaacctggagggctagaacctggagaggctagaaccaagaagggctagaacctggaggggctagaacctagagaagctaaaacctgagctagaagctggaggactagaacctggagggctggaatctggagagctagaacctggagggctagaacctggagggctagaatctggagagctagaacctggagggctagaatctggagagctagaacctggagggctagaacctggagagctagaacctagaagggctagaacctggagggctggaatctggagagctagaacctggagggctagaacctggagggctagaacctagaagggctagaacctggagggctggaatctggagagctagaacctggagggctagaacctggagggctagaacctagaagggctagaacctggagggctagaacctggcaggttagaacctagaagggctagaacctggagagccagaacctggagggctagaacctggaagggctagaacctgtagagctagaacatggagagctagaacccggcaggctagaacctggcaagctagaacctggagggaatgaacctggagggctagaacctggagaatgagaaaaatttacatggcaaagagcccataaatcctgaccaatccaactctgaattttaaagcaaaagcgtsaaaaaaaagattccctccttacccccaacccactcttttttcccaccacccactctcctctgcctcagtaagtatctggaggaagaaaacaggtgaaagaagaagtaaaaaccatttagtattagtattagaatgaagtcaaactgtgccacacatggtgaatgaaaaaaaaaaaaagaggctgtgttttgtcacacagggcagtcattcagcaccagagcacgtgatggtctgagactctcttaggagcagagctctgccgcaatggccatgtggggatccacacctggtctgaggggcaactgagtctgcgggagaagagcggccctatgcatggtgtagatgccctgataaagaacatctgtcctgtgaaagactcaatgagctgttatgttgtaaacaggaagcatttcacatccaaacgagaaaatcatgtaaacatgtgtcttttctgtagagcataataaatggatgaggtttttgcatagctctagcatttgttacaactcccgaaacccccgagtttggtccctggggtaccgccttgcacactcagaagcctttgggaaggggtgctattcatttctgctcaatctgttaacaggcttctggcatgtagatcagtggtctccaagcttttgtgattgtatattcctataggaaaaaaagaattgattatgcatacccrgtatgtatacttattaatctgtatgaagatgtacattctaaaatataatcaaccagtagaaatttaagaaagaagatgtaaaaaaaaaaaatattaacagtgcttgaatatttccttccatcttacatttctgcagggataactcattaccaagttcccactacatgaatgtgagaccctcatgaggcctagaatcataggcgcagcagcgattcaatcatttattcatgcaatatagacttactgagtgcctaccacttgacttcccttcaaatcaggagtatcttctacaatatcctgatgaaaagccacttgtttcatactcccagtgatggggaattcattatccatgccactttgggatcccttcattattcatgtattcattccttcactcatttattaaacaaaacttgcctagtctgtctccataaatgcccctcctccatccatgcatccatccatccatgccaggaacctggggctcatcgctcaacgtaccctctccttcatctgttccatctggtgggtcagcacctcttttatttttttctaacttttattttgagttcaggggtacacgtgcaggtttgttacatagataaacttgggtcatgggggtttgttgtacagattatttcatcacccaagcattaagcctactacccattagttatttttcctgctcctctccctcctcccaacccccaccctccactagacctcagtgtctgttgttcccttctttgtgtccatgtgttctcaccatttagctcccacttacaaatgagaacatgtggtatttggttttctgttcttgggttagttcgctaagaataatggcctccagctccatccatgtccccgcagaggacatgatctcattcttttttatggctgcatagtgttccatggttgtatatgtaccgcattttctttatccagtctataattgatgggcacttacattgactccatgcctttgccattgtgaatagtgctgcagtgagcactcatgtgcatgtgtatttatgatagaatgatttatattcctttgggtatatacccagtaataggatcagcacctcttttagattctactcactaagtgtttcctaaatctatgtttccttctatgtccaaccatcgtctgtcatgggtgcctccaatactaactactaccatctcccaattcttattcttcactctgcagccaacatggtcttttaagaatgcaaatacattcatggggaggctataaacatagagaactgtgttcaggagccaagactttaggattaggtagacctggattccacttgtggttcagccttgggctcttatttgctgtgtagtcttgggtacctcagttatcctttctgagtcaacatttccttgtctgcaaaatggggataataatggtatctacctcataaaattgttaataggattaatgtatgaaagcatctagcacagtgcctggtacatagttggcactgaacatgtactagctttgatgatgatgatgatgatgatgatgatgatgtggtggtggtgttggcagtgagtgtgatgggggcatcctccaagggaaacccttccatagtgtcccacccctcttgcgataaggttctacagctgtaacatggcttgcaagacccttcatgatctggtccctgtcttgtctctatgtctccctctctctgctccaggctcattctctaccctccagccatttggacacaagaacctagacagatcccagaagatatttcattctgcctccagtgcccactcttcccacccagactgcaccccctcactaagtgccctgaacttggaggaagttgtccacaagtgcccaagggagctcactcctccagggaattttgttcacagatgcctgcattactcaagggagtctgcaatccaggggaaaccacatgcctggaaacctgagcagggctcttagcaggcaaaaaaagaaaaaaaaaatgctgggagagcctccccagcgaggcaacaggagcagcccctcaactcctgaccctctctggctccagcaagctggcgcaatgagaagaagtccaggtgggctcaggagaccaggcaaggggcctagctcctgagtcttccctggccacagaggggtgagaataggatgcagagatgcaaactggacaccagatgacctcatgggaattcatgctagtgctggagcctcttgagcacagccttcatgactcagagggggagtgtctccattgtgtagatcccagccatgtgctgcattatctccttgttacccaattcctgacccttacgtagctctgatccttcaccaaggatgagggtggggagcagggatgagcaacagaggtcatgatttggcaacagcaatggctgaaagtttaatcgtttgttcatgagagttttattctggttttagttttttattttgttttgctggctgaggcaaaatagtcccaggtcaaagggaccccatcaaaatacttcacgctcacaaccactctgggagtttgcatgatcactggttcatggtatggaaactggggcccagagagggaagtaactttccaaggccatgcagttcttaaggagggtgctctggaaattctctctgttcttggggtgttcatgccttaacaaaccgaggatacaaattctgtcacaggaaaagtcctcgaagtgccttcttgcatgacgagcttatgacccagggcttgggctatttctgccacaataaaagctttgcatctcataggccttgtgcatacttgcttcctgcagatcaccttcccagagctggtggatgtaattcacatgccgtagagtttacccacttcagcttttacttaataaccaattcatgcaaccatcactactgtctaattccagaacactttcatcatcccccaagaaatcgcatattcattaacagtcacgtcccattctcccttcctcatggctttgggcaaccactaatctttctgtctctagatttacctgttgtgaaagaagccaggcacatgttgtaggatgctgtctctgtagagcctataacacatgccttttgtgtctagctccttttacctcctaacactgagctagaatgtttaattgttgggggagaattttggggaccagtccatgggttccctaccatgccacttgtgtgatctcagcaagccactttactcatcttccctcccaccacctttggccttagttttctcgtctgtcaagtggagagataataagtcatgactctaacaggtttctggcatgtagatcagtggtctcgaaggactgccttatgtgatgttgatgctgtcctctatagtttacgaaggccccagcaccaacagtacaggggcttggaggcaggttcctggttcacatcttacctctgccacttcccagctgtgggaatttgaagaaggtcagtgaatttctctgagtgtctcttttctcatctattaaatgaagatccaagtattgtgaagattcagtgagataaagatgttgtgatgagttgaagagtatccctccaccccaactcatgtccacatggaacttcagaatatgaccttatttgggaatagggtctttgcagaagtagttaaattaagatgaggttacacaggttgagcattcctaatccaaaaatctggaatcacaaatgcccccaaatccacaactttttgagcactgacatgatgctcaaaggacatgttattggaacattttagattttggatttctggattaaggatggtcagctagtatgtattctgcaaatactccaaaatccaaaaacattcaaaatgcaaaacacaaaaacttctggtcccaagcatttctggataagggatccccaacctgtactggactaaggtgacccttaaatccaataactggtgtccttataagaagaggagaaaaacacacagagacacagagagagatggaggcagagactggagcgatgcttccacaagccaagaaatgtgaaggattgcccagaatcaccagaagggaggaagaagcaaggagtggcttctccttcagaccctccaggaggaaccaacactgccagcaccttgattttggacttctggcctccagaactgtgagaggacaaatgttcattgtttaggccacttaggttttgatactttgtatggagccctgagcaaatggatacaggtattttagtctttttgagcacatgctcaccatccagttgcccattaaggtacctgcaggccccttctctcaacaatgagagggcacactggatgtttttctcaggtctttttagggttagagatacttgttcgtgcagatttcctaagaaataataccaaatgccatcttactaaattgtagaggatttttttcaaatggaagatactgaggcctttcccatattgcgggccagcccaagcccccagagcgtgaatcatgggccccgggtgctgagtgtaaatgcccatccttgcggacctaggacctgggatctgctgattctttcttccttccccagaaccaaaaggcaggccaattcaaagagtctcagaccaggattcaaataaataaataaatggcctcagagcccagctcccagcttccagacagcccagccaccaaccccacccaggtgggaggctacttatagacaaccctgaaagatggtcaaagatggggttctgagactctctggatgcctcccttcatgctgagtcaccctttgccgtccactcagccggcgagcaatgagtgtctgtttcctctcttcagttctggccaagacagagcacggtgtgtgtgggccctcctcataatgacactaccatcgtcttgtgcaacagtaaaatgataaaatcaggaacagttactgtggggtgcctactaaaggccagttgcatcaccacattatcccatgtgattaccaaattctacaacatgctccactttacagactgaggctctggaaggtggaattgaaaatggtccagattctccaattgcacacaaaaaatgtgttgctttctaccataatttcccattaaattgtctctttcacaaaaaaaaaaaagaagaagaagaagaggaagaagaaaatggtccagattcaccttctcagcagtgacggagctagggtgtcaacgctgctgaggcagctccacaccgtacacctgcctgcctggacttccaaatcagaccttaaggaccagggacgggacttgtttttgcagtcagatttgctcactgtcttcctgacctccctaagtacagtagtccccccctttatccatggtttcaattacctgtggccaatataggtctgaaaatattaaatggaaaattccagaaaaaagcaattaatacgttttaaattatgcaccagtctgagcagtgtgatgaaacctcgccccgtcctgctttgtcccacctgggacatgagttgtccctttgtccaatgtacccatgctatataagctacccaccattactgtatagcaaaaagcatagtgttataaggtttggtactatctgcagtttcaggcatccactgggggtcttggaacgttttccccatgcctaagggggaactgctgtacagagcctcattcctttctgttttgaagaccactggatcctgttctgtttcttcatagaactcacaatcacgatcctgtacaggtttctctgttagtctgtctctatcccaagtctgtagcccccatgagggctgggacagtcaagaatgaccccaagtcttcaagaaaagttatggttatcttcagcaatttcagttcccctatactcagagttctgcagctcacagaagcaatttcagtttccctggatccggagttttgcatccccatcatggggaccaatatgatttatatgaaagataaatgctcacagcatcaactttataatacggtaatccaattccatctctttaaaacatcataaaggaactactggtttctaaggaaaacatcttattccatacccccattctttgctgtacacatggcttaattagg

SEQ ID NO: 12221 - DNA, 29298 bp, Homo sapiens
  misc_feature (1)...(29298): n = A,T,C or G, or insertion/deletion polymorphism (see Tables 1-2)
cccggtgcccagaaagggcagccgggatagtgaggttatttcctgcccgcccaggggcgccgccgaaggatctccagaatctgtgctcttcggtgcagccagtcctggggagtggggcgtggcgttgaaggggtcggccggggcacgaagaagctgtatcggaggcgtgtgtcctgggggttgccagccactaggacttgcagtgtcaaaggctgggccagtggcccatggcctgacagtgtctctgaggctgcagtggccccgctgtagcgcaagctgactgccccaggcagtaccacatctgtgggggagggcatcagcgtgtattcaccattgagggcataggagccatctggcagcttcagggccaagtagatgctccggtggccagsgtttccctgctgccggacaagaatgtgggtggcccccgcggggatagtgaccacattgttgtatccgtacctgtgtggaaggagtagatggggagctcaggatcacctgaatcccctcagccttctgagctgtgcttatgtgactgtatgtgtgtacatgtgtgtagatggctgtcacccaatcctatgtgagctgttcggtctggatcagagctacatgcacatgtgccctactgcctcttatctctggacctttacacccactgcccccttattgagttgcccttccaagccccacttccttggtacctgtctaattcctaccctccttctgagactcagctcagaggtcacctccaaggaagccttccctgatgcccacaagggcactcacaacaccctgttccaacttcggatgaatacatgggaaaccgcactgtagctgcctactcgtctatctcccgctagactgtgagctctttgagagtggaaacagtgctgagttcccctctgcatcactaggacccagaatgtccaggaaggtagagggaggaatgatggtgaaagaacctgaatttcctgaaggagcctgactgcttgctgcaaccagaacsgtcccctccgcacaccatgcacttgtcaaacttcttcttggagccaatgatgcgatcacagccagcatggatgcatcggccctggacacagaccgaggagctgtccggggaacagggggtcccatctaccacctgaggaaaagagaaagaacaatgctgaaggttcctcctaagtcaaaaggggttggtaaatcaaacgagacccatgtcccatcagggaagcaatgttgtcggaaaagttggatgaagtaggggatgtagatgggtgagtgccggccaccatgtgggtgataatcataacaataataattattatcacatataacatctagccagcattttcagagcactgagtatgaatcaggcagcatgctaagtgttttataaacacaaatgtaaatctcaccaccactatttgaggtttttagggatggaacgttgaggtttagaaaagctaaagaacctgtccaaaagccacacaaatggcaagcagaggagccaagatgggaagtgcagtctgtctggtcccagcaccaagccctaaaccttgatggcactgtccctaaatggacgctagagggcagccagcctgtagaaattctcaggttggggcgaagggagcaaaatgctgctggggcttgtttttctttgtgcagccttcaacccaccaccctatcacagagagggagtgtagggacttcagtcatctccaggaggcctgtccattgagggactggctgtccaggagctgaatgaaaccaccactataatttgacagaggagcccatggaagaggggtgaaggacttgtcccaaaggccacacattcgattctcaccaaatgcagcattagaagatggggagtcagaggaaaagaaaccacgggaaataggataggctagagggacctattggccacatatctggagtctggggctcgttttcctgatacccatgtacagataagtctgagtggaatcctggactgggctggcgtggctgtaggaacagggttactttgggtgatctttgttatcagaaagcagagggagcactgcgggtgtgtgtgaccatagacagggcctgggggtgtcctgaccctcacccgtggctccagcacatagtagtagcccagtgccygggcctggcaggtgagtttgcactggtcctggggggccacgcctgtgtagcgaggaacccagtccatgggccctgggaagctcttgaagaggtcggtgcggtggttgtaggcagcacactgctcctcgcggaaggtcagggctggaggggtaaaacagtcagagcccctccttccttcctcacatcaccccacatccctccacccaacccctgagaactctagacagcacagctctgctcttccctgcagacggccaaggacaattcccagaggttaaaggcactccccacagcagcaggggaatcaacacccccttggtcttgcactcaagggacagtccttcctgctctactgtcccctcccaagggctcccatcccccctactcctcacctgagccagttgggcagtcctcagtgttgcaggagcggaagcgggtacggcrgccctcacagtacttgccaccattccgggggacaggcctcgtgcagtctcgggaggagaactggacaccacccccacaggtccgagagcagtcaccccatggtccccaaggaccccagccaccagcctgtggaatctgcaaaggcacagaanggaagtggggcataagtgaactctctcctgggcttaaggccagtccccacacccccgggccctttaccccacccctgccctaggatctcacattgaagtcctggagctggtccatgtggaggcagcgaccacccatgcaggcctgtgcgggcccgcagggtgtgccatcggcccagggcgagtgtttggtctggcacatggcatggccattgaggtggccagagcaccagagggcagcacagggcggcggcagctgtggacaatggcgtgagtcgggcccgaaggtcagctggcactggcggtcagcatcatagtccttgccagggaaagtcacaggcagatgcaatggagcctctggtttgtctaagagacagtgccctgggaagggggttggggcacaaagtcagcaacgggctgaggggagcattcaggattgccagcagaaagcttaggctccctggggcctgatggagcctagaaaaacaatcctaggactataagaggatttaaatttttgttatttataatttttgttttaattacttacttttttttttttttcctgagacagagtcttgctctgtcgctcaggctgcagtacagtggcatgatcatggctcactacagcctcaaacttctgggctcaagcaaacttcctgccttgggctcctgagtagctgggattacaggcatgtgccatgtccagctaattttttggaattttttgtagtgataaggtcttgctatgttgtccaggctaatctcaaactcctggtctcaagcaatcctcccaccttagcctcccaaagcattgggattacaggtgtaagccactgtgcctagccctgtaagaggctttaatgggcagctatagtttattggatgcttattatgagatgagcattggctaaatgcttgaccagcactatttaatcatggcaaatacctatgagataggtaccgctattatacttatctgacatatcaactacaaacacagagaggtgaagtaacttacagtcacacatctacacctgcttaaagaacagaataagaggccaggcatggtggcttaatgtctgtaatcccagcactttggaaggctgaggtgggaggattgcttgagcctaggagttcgagaccagcctaggcaacacagtgagaccacatctgtatttaaaacaaaacaaaacaaaacaaaacagagtaaggataggaactcaattctgcctattctaaccaactatagaatatttgagtttgcttctcatcaacatctctgcctagtggcagtcatcctgctattcttgcatacctcactgcgtgacaaggtaatcacctccttcatagccagcccattccagtggtggacagttctggccctcagaaagtcagttctaattctactragccaaaattcgcctcctctagctatgctatttattctgggaggaagtgagaactacacaaagacagcagcatttctcaccccttcccacactgcagaggaagcacacttgggggaggcaatttggtccatgcagaatgcagcggaagtgagagtgccctggaggacaggaattgagtgctacccagggaaaggtaagtgccatctgcttaccatagccattgtccaggaagtcagtgatgaagcgggcactgcagggggaccagggctcctcaggatccacatgagccatcacaggggccatgacatggcgagaggtgctcaaaggcccattcaaactgatgcatggcttggagttgtcatggagcatgttgaagacatgrcctgtgggagcaaaggccctgataggatctgagggtcccttccccatgccctgagggactccataataaatctggctgcagctgtggatgatcagatccattacccacctcaccctgcccccagtcctttcctttatggtactctcagggctcccagtatgtagccccgtctctttctctgtctcctcttccccaaaatatactcagggtccctccctacccacttttccttatagccaacattcccaactgtgaccccacccattgtctctgactccccctccaaatacacacacacagacacacacacacacacacacacacacacagaggagttcacagtagtttcgaccaactaatttatttaatagaaaaatgtaaatgtatgtctacacctggagcagagaggagtaatagccctatacctaggcctgggggaagaataccttgggacccccattaacactgtggtgaacttgctaccccctcccccaccttctcctccctaatacctttctcatccacccctactttacccagttcatgagcagcagtgaaggctgactggagcccatcatcctccacaatggcacagctccgagccgggtcacagacggtgcccacatcagccatacccagcgtgtcgcaagtggagactccacacaggtcctgtggagagggatcatagaaggtgcatagacagccaagacacctgggtccattgggttgagatccagattcccggggacctgggcactgaggacccagcactgtcagggcctaggtagccacacatggcagtgtggctggggcaaggcaccatgtcacacaactccaggaacatcatttgcatcatagtctatgtagtggcgcttcttagaattgtgcagtgcatggcctgcggtgctgactgsggcctcacctgacgggtaaacagaatggctgtgtcaaagtggtcagggtccgagtcctcaggggtgttgaggccccgctgccaggcacagaagctgcgcagggtctgggcagcactgggccccacttggggcccctcctcgcctgaccccaggatcactagccgagtcaccaccaagctgacaggattgcggatgcttgggtgcttgaaggccttggctgctgctgccatcactgttagcaggtagcgctttagccccgcaccgtggaatgcggccatcttgtcatctgccaccaccagtgtctccacaaatctactcagtgaagcaaagcgctgtagagaaaaagggagaggaagatcctgaaatagcctctcagacccatgggtcggtcgattctccaatccctcacttcctgggtctggaactcagcatagtcagctgggccccacacaccccacgggattcctgactcctggcgggtcttggttgggcccttcccccaacgccaaatctcagggcttttgtggtaactctgaggagtcagcagctggttctaagaaggggaggagaaggggacgccacatcccagggctgcgggagccccagaggtgaaagcagcctggactgccgtcaggagggactttggggttctccaggcctgagtgtggctggggcctatgggaccagggctagagggctgggctgcaacgtgtctgccctgtgtggttggaggaacgattcagtcagcagctagggccagggccagagctcagcgtggcggttgtggagggagcgtctggtctggattaaagctagagagggaggagggaggagggaagggaagaagggggagaccaggagtgggagggaggaaaggatggagcctcaggcagcctcgcagtccggccacagtgtgtgaaggggattgaccagaaggaggtatgggataccctccctctcttgccactcctgccctagtttgcagtttgccacagtgattttaaaggcagcakcagaagccagacaccaagccctagggcctcaaacctgactcctatagctgggagtgggggatgaaaatcaaatttggagcagagaaaagagccaaggccaaggggctgttaggagacctttactgctggggactgtgtcagtaggagatgccatggccaggaaggggtggggtggggagagggagcagttattcccagcccagagtctgtgacycacctctgagaaccctcggtgggtctggctaggagaagggtgaaggggagaggcctgagccttaccaagaaaggaggctcatggagaaaggaaaggcaggcagaagggagggaagcagaacggccagaagtgkaagtgggtggagagagggtgaataggggtcagtaggacagacatggcgggaggacaccgcaggacacagactccagagatgcctaccttggctcttcggggtctggggctggggcttccaagaggagccttgacgttgcacatgggaccttgaccgctggcaggactcttccggcgtaggatgtgagccccaggtcccccagcagagttaggggtgcctccctccaggggctggaggtggagttcagccccccgatattgtaacacgcctaacagggctcccccatcccagtgcagagatgccacygactccggatctccattgatggtgccagtcaggtaggtgccaggctctgctccacccagcagctcaggcgcctggcccaggtactgcactgtcagcccctcgacctgcacaccggagtcctgctccagctctagtarcagcgtctccccaaaggcctgcaagcggcacaacagcctggcaggggygcccgagccaggcaggacgctgccgttgagcttctctggaaacacgatctcctcctcccgggggagggggctggccagccgggctgagggcaggagagaggccagcagtagcagaagcagccacaccagccaggagagcggcacaatggggagcaggaggcagggttgggctccccacagccagcgccctgccaagcccctcccgggatgcgagcctgtctgggacatggcactggtactgcagctgggagggactgaggccgtctagggcaccaagtcctccacaccctagctttggaaagctcctctctgtagcctgggggcttggactcctgccaaggtcagaggcaaagttttcagaagggctgaggaccgttaaaggaaatggagaaaacttagtccttgggcttgggagaggtgcccaggggtctggcttctccaaactctcctcctgagccctcctttcctggatctttgtctctccctgcctgtgtcttctgcagcttctctggcctctccctctgtaggactctgtctgggccgcttctgtgcctgccctgtctctgccttcttccgctgtgcctttgtctctgtctctttcctcctctgtctctctcgtgcatatgtgtctgtgggtctccctgtgggttctccccagcctctctccgcgccagctcttttaagcatggtgagcctctgcgattgattggctgatctctaagccactcagctgagctctgtcggtgggactcagatgggtgtatcatcgcttcccaaaaaaatgggacttgcccaggggaggggaatctctagcagccgaatggataataggcactgggccagctgatgacatagccttttcccaaaccccacaatcagccctcagctgtctctttccctttttggtgggacagagccccaggagaggcagagagtgagggaaagggcctggccggcatgcacagataggatcackgtcctgggagaattcctgctcttatagtctaacctaccatggcttctcttttctcaaggctccctcatgctgccctttggccctagtggctggtttccagggctgaggggactgagtgagctgcctgagaaaagagggtagggaacaggtaaggaggcatcaagagggaagaacaaataaaagaggtagcttgacatggctcaggatagaactgagcagctgggaagagtaaaaaaggcagaacattgggggaggcaaggagacagtgatcagggagttgactgcccaaaggtaggatgatcctgcttggaatgaacataacagaggcggcagatgacaaggcaggaggggttaacgacttttccttttatagaaggcggatccagggtggcacctcctcttttctaacgtcccttctctccctcaggatcccccttcctgagttaccactacccaccccctccaaagcccagaacagccattccgcctccatttccccccagggttccccctccccacttcctgactccccatttccctggcccagctcccagtagcttcccccaggcttttggccctgctcctacccactcccaactgccctaaaccctcccccagcctcaagtcagccagcccccagcataggcaagacttgctctcaggaacccagattcacccagtatcaatctgggagaatccccacctggctcccaccatccaccccaccttgctctgagaacccagtggttcctggaatatctagtcatcttttctttttaattctccctggggcagggagagggtggagacagcattgtgcatatagggaaattagggtactgggagaaatccattgcctggggtggggaaagtggctggggaggaagaggtggtgttagggaaaggaagcaaattattcctttggctttggataggagggaactcggaaaagaggtcttgggtatgaactctcaaggcaaggaagggttcagaagtaggggcaatttctgctcaccccatcctctggctgcttgtttccccaggaaatccccaggaaggagagtgcagtcagcagtctctttcctttcccagaagtggaccacctcctcttgcctctattyccctattcactctgctttgtcacctcctgtcccccgcatatcatatccgtcagaatacttcctttccccctcccttcctgctcaggtcggtaatacctgccctggtgcctatcacttcctggatcacccacccccttgtgactgccagacccacctcttgacccaccacttgcctgaccctggttctaagcmaacggggctgggactagaggagtcggacaaagggtgggagaccagaaggggcaggggcaagaggagctatcaccagagaactctactgcccctttccactcccctatttgagatgaggacaaagggggtgactaagcaatgaaagacaaagggctttagagtggctgcagcagtgtgtgtgggggtgttggcagcagggagaaggcacaaaagctgcagtgtcctaggcagcccctcaggagccccccaccccagtcccagctcaagctgcctccagggccaagcagcccaaagtctatcctgacttctcycaggctggatcaaggcaaataaatgcagtccttcccatcccccaccaccatggccacatttgctgtgtttcaacaatagaaagaaggcccagggaaagagcaaggaatgaggacaacagagggaccaaacctctgccctggctctgtggcagctgccttgtctagcccaggtcctggtcagttcccayagctaaggatctggccccaccctttggtacagttcccattaggtcaattcccaggccagaagtctggctttcccctctttctctgcagtgaagaattccaccatctctgcttcctggtctgtctgcctcaccctgctgcrctgctggtgggctgtgtccctgggatcctgtctaggggatatctggggaaggcctctttccaggctcagagttggagagttgtacaaactctacgggtgggtggcccagctggagttgggcttagaggcagagggagaaaacaggaactagcctctaaggctggaagaatctttgtccatacagaattgtgatcagactcctggtgctactacatttccgtgctgttggccattacccaggagggctatagcagggtcagaaagacgttagggaaaagaggctgacgcaagacggaagtggggtgtgaggcatctctaagggcgcttcctgggtctgtgattctgtaggttcgggaagcctggaggatgtcagggtcacccacagaggacctccactcccccatctgggatgaggtggctcctacacaccccgacactcccctccgcaccaccaatgccggcggccttggcatcctattcttttttgttttggtttggcgggagctctcagacccgcccagccccacttaggctcctttctccaatctcaatttatgacatctggaaattagctggctttcccaactcctgtcttttggattcagtgatgggaaagtaattggcaaagcctggggctaccctataagggcagggctcagatacaatccgagagcaggactaaagcatgagggcggccaaggcggaagggagtagggaaggaagcgccgcgcgtttccaagatacgcaggcgggctcggcgagagagcacgaagtatctgccccacgcaggaacggcaattttcccttgctcgctcctagaaaagccagccaggagctgtgggaggaaacgccctcagtaaagatgaccgcggtcactgttatctaaacgcaagtgaagccgagtcacaggacccggatgttgtcagttcgacggtaaacgaccctgccagcttccaagagggcggcttcactgtgcgaataggtgagaagccaagaaggaggcgcgctggagttacttccgcccggttctccttcccgcagtctgcagccggagtaagatggcggcgctgagggctttgtgcggcttccggggcgtcgcggcccaggtgctgcggcctggggctggagtccgattgccgattcagcccagcaggtgagatcgagggcagctctcgacacactttctccaaggctagggtttctcaggttggggacgctttactcccccagaaaataataacccaagcctgtgaccccattgtccatccctgatttcttgggctacgggatgcagtggcgcccactctggcgagggaggggagagggtctagagttcgttcgtgccgaggtgaaatcagcggagtgggagactctgctttttagcttcagtaatttgaatgcacctctyctgtcatacctgagtagagctcagccaaagagccagaatgctcgctgtctctctgtcgttgaccttgaacaaacacttttctcacgttcatattcacctggttgataatatcaatatgatgaaaatatgaagaagctaggatcccaaccttgcatgcccaggggtgatgggtggagttattccaggaataatttgttagtaggaatggaacctctagagttccagcttgttttgccgaagctacattaacttcagatcagtgacttggcattaaaaaatccaggacattggctgggcgcggtggctcacacctgtaatcccagcactttgggaggcctaggcgggcagatcatctgaggtcgggagttcgagaccatcctgaccaaaatggagaaacccccgtctttaaaaaaatacaaaattagccgggtttggtggcgcatgcctgtaatctcagctacttgggaggctgaagcaggagaatcacttgaacccgggaggcggaggtttcagtgagtcgaaatcacaccattgccctccagtatgggcaacaagagtgaaacccagtctcaaaaaaaacaaaaaacaaaacaaaacaaaaaaacaggtcatccttcctgggtccccttgagagtgaatgggaacacaggaaccaaacactgttcaggccctttgtctaggatctgtctttgactccccagaggtgttcggcagtggcagccagatgtggaatgggcacagcagtttgggggagctgttatgtacccaagcaaagaaacagcccactggaagcctccaccttggaatggtgagtgaccagagttgctgtcccaacccacacccatccctgcccccagctgatttccttttctttttttgagacagggtttccctctgtctccctggctggagtgcagtggtgcgaaagtggctcactgtagccttgaacttctgggctcaaggcaaccttctgtctcagcctccccagaaagccgcaacaacaggcctgtgccaccacaactggctaattttgaaaattttccttttgtagagacagagtcttgctatgttgaccaggctggtttcaaactcctggcctcaggtaatcctcccaactcagcctccgaaagtgctgagatacaggcttgagccaccatgcctggcctccagctgatttctaagtgctcttgagctctctgtcttaggcaaattttagcccctatcctgtttgcttctttcaccacgaaattcaacagacataatagtgataacaacaggtatttgtgaagtagagaaggaaaggaaggatgttgcagaagaaaataaagaatgggtcccagtaaatacccaaaagtccctaccaatttaaatattaatgccagcttttcccatgttcaatatatttcaggttcactacattatctccctctccagacaaggtggtggttttcccgttggtaaccaaatgaaacctacatgaatacaaaccattttttttcctatcaaaactagctcttccttttgacttttgattttgatcagtggcaccctcattctcctaatccctcaggattgaaactttttagtcatctttggctgttttatcttgccctccatgtctatgtccagtaagttaccaaaccatgtagatactttcgtaatgtctcatatctggtcatctctcccttttaatttttattgccatcattcttattcagatttatcttgtattagaccctgattattttaggagtctattcactgagtttttgccgctgatgttgtcccctttccatctatcctatacagtgtcatcaccttcatcttccccaaacattattttaccatgttattcatactcttgctccaaaaccttcaaagacacttccagttactttccacaaacttacagtaacaatagctgagtgcttaccatttgccaaacattttcgtatgcattattttgtttaatctttacaacagctctatgagagtattaccccagttgtgaggaaattatggtctaaggagattaaaacttgattaaagcccggatgcggtggctcacactttgggaggccgaggtgggcggatcaccttaggtcaggagttcaagaccagcctggccaacatggtgaaaccccgcctctactaaaaatacagaaattagccaggcgtggtggcacgcacctgtaattctagctactcaggaggctgaggcaggagaatcgcttgaacctgggaggtggaggttgcagtgaaccgagatcacgccattgcactccagcctgggtgacagagcaagactgtctcaaaaaaaaaaaaaaggttaaggacacacaggcagatttgtactcgggtctgtcagactccaaagcccatcatgaagaattttggtggaaaagatgggctctggtttcaaatctccactctcaatttaccagtgaataaagtgtctatttatagcattattttaaggattaaatgagataacatgtgcctggcacatgtaagtcccctataagtgttcattgttattaatgatatgtacagataattgaaccactaccccctactttgtcccagtactaatcatccctctcttaggaagtcccaataagagttccatggatgtttacttccttgtttctaagatttggcccatgttgatttcatagcctggaatgcttcttctcccttctagctatctaaatcatttcctatatttgagctcagatcctacctacatgaagtctttgcagtgttctttccttcttttaaaaacttaatggctaaggcactttcttggttacttacaaatttggcctctgttcctagtttttcacatgtacttctttcgcaaattaaaatgtaagcttcagattaggtgggcatggtggtgtgcgcctgtagtcccagctactctggaggctgacacaggagaattgcttgaacctggcaggcagacattgcagtgagccgagatggtgctgctgcactccagcctgggtgcagagtgagactctgtctcaaaaaaaaaaaaaaaaggtaatcttcttgagggtaaaagttcatttagtgcgagtaagcattaggtataccatttcctgactggttggccattcattggatacatttggaggacagtatatcatagtagttaagatgtttggatcctggagctaaacaggctgggttaaaatcctggttctgccacttactagttttatgatcctggaaaagtcatttaagctccatggcctcagtttatccaatgaaatggggataacgatagtacctattactcataacagttgttgtaagaattaaatcaattaaagtgcctaaggtagtgcctggcacataataaagctatataagtgttatgtattattaaaaagatattctatgcacactgactatgaaccatgaaaaaaaaaaaggtattctaggagacatagagtgagattcatgatgtctgtcatcagaaagtttagatcttccttttccccatctaagagtcctcttcctggttatagtggagattaggaaattaacaaagtatggaatggtgagttagaaaatctatagggagaggctaactccttgctrtcttttgggggatcccaagggaataaccatgtggctctgaactatttcttacttctcagatgtggaccctccaaaggacacaattgtgaagaacattaccctgaactttgggccccaacacccagcagcgcatggtgtcctgcgactagtgatggaattgagtggggagatggtgcggaagtgtgatcctcacatcgggctcctgcaccgaggcactgagaagctcattgaatacaagacctatcttcaggtgtggggggtgaacaggagccttttggcgggatctggggttgctttagcctggggctttgccagtttgctgcccttaaaacgtgaggggaggaaggtgttgagaggagtaacccgttgagattactcttggttgggtggatggagggaagtggcaggggatgcttgagtcattaggatttggtttatttagcagcagtgctttgaagctggagctatactcagcttttctctggctgactttttggcaggcccctttgccattacttgagtgcctcagtttccctgctcttacgttagactagtgcgtcaaagccagtgtccctaggggcagggaaagagaaaagacattagctcgctaagtttaacagctgattcttgtatcttccagctgtctacgtttgttttcaaaacattcaatgagtcacagcaactcagagagggtttatgacagtttgccatttttaggagaactgtataacccaaatgatgaaggtcagatttgaaggagttggatctctaataggaatctgaagtttttttcttactgtcatgaagaaaggtcctgataacaggatggtaggattaggatttagatccagcccagtgtcggggtgaacagtgactagaatgtgattccccaagagagcctcggcgatgacagtttctggtcctggagtctatgggttaacccctgtagcattagcccccgtcacagtgacatcagaataagaacaggctgtcccagctagtagcgtcttagctccaccctcttcctggaagctgaagctggttcagcagacagctaggacttggctttttggcattctggaggaaggaccatttctacctgatgctctgtcttccttaaatacctcactctggccgggctcacgcctgtaatcccagcactttgggaggtcgaagcaggtggattacttgaggtcaggagtttgagaccagcctggccaacaaggtgaaaccccatctctactaaaaatacaaaaattagccagacgtggtggtgtgcgcctgtaggagaatcacttgaacctgggaggcagaggttgcagtagccaagatggtgctactggcactccagcgcctgggcaacagagcaagactgtgtctcaaaaaaaaaaaagattaaaaaaaaaaaccctcccagatactcttaagactgattgcctttctccttcagtatctgaagttttttgtttgttttgtttttttccctacggagtctcgctctgtcgcccaggctggagtgcagtggcgtgatcttggctcactgcaacctctgcctcccgagtttaagcaattctgtttcagcccccagagtagccaggattataggcacgcaccaccatgcctggctaatttttttttttttttttttttttttgagacggagtttcactcttgttgcccaggctggagtgcaatagtgtgatcttggctcactgcaaactccacctcccaggttcaagcgagtctcgttcctcagcctcccaaatagctgggattacaggtactcaccaccacgcccagctaatttctatatttttagtagagatggggtttcaccatgttggccaggctggtctcaaactcctgacctcatgagccaccctgacttggcctcccaaagtgctgggattacaggtgtgagccaccgcgcctgaccagtatgtcagttttttaaatttttattattttttgagatggagttttgctcttgttgcctaggctagaatgcagtggcatartcttgtctcactgcaacctctgcttcctgggttcaagtgattttcctgcctcagcctcccaagtagctgggattacaggcatgcaccaccacgccctgctaattttgtatttttagtagagaaggggtttctccatgttggtcaggctggtctcaaactcctgacctcaggtgatctacccgcctcggcctcccaaagtgttgggattacaggcgtgagccacgtgcccggccaaggactcttgacagtggtatcctggagctagctcatacgggcttgcaagagtgcagttgttaaattttcaggagttttgtgagccagttgttgaacatagccattgtcagaaattaatttatataagcttatgatttaatacattatattaaaagcaaaggtaagattaaatattcaaagctcatcacttcattattttaccacattttactatgctctgcctttgaggtatttgctttgaatgtgtctgtatggtggaaatactgtataatggtgtggtattcttcccaatgcygcattcagttacatgatattggtaacttaaaattggccattgtgggagtatttttaccatggaaattggcaaacatgacaaatcagagtcctccctcactttggagagccagtttttaaacatttactagaatactactggtttttgggatatttttacctgccttgttggggctcctgagactagaaaggcttatacagcaccaacttctggtgccgactgagagcaaggcttcaggcagccagactgtgggctcctgagcctgttagatgtgacccacattcctccctcttcccaggcccttccatactttgaccggctagactatgtgtccatgatgtgtaacgaacaggcctattctctagctgtggagaagttgctaaacatccggcctcctcctcgggcacagtggatccgaggtatgtccccccaactttttctgtggcccactgtgagcatagcatagtgccttttccaccacttccccgttgaacccaagcttaktgttcagaccccaggctctgcccagacctctctgtccgcctcagtgcttggctcctatatcctgtcttctccttgtcttcacagtgctgtttggagaaatcacacgtttgttgaaccacatcatggctgtgaccacacatgccctggaccttggggccatgacccctttcttctggctgtttgaagaaagggagaaggtaagagtgggaggaaaggataggaatagggaaggaagtgcaggaagtagagaaggtataaaggagacaggagattaaaagaagagagagaacatgggagaacatttagagggggaaggtatgtttaacttgggttatatttgtagaaactatatcatgaggggttggttgggcacaagaaggcagaaagtgggggagtaggccatcataggacctgggggcctgggactttgacactaattcccagcacgttctatgaagatgtttgagttctacgagcgagtgtctggagcccgaatgcatgctgcttatatccrgcmaggaggagtgcaccaggtgagcaggtccccggcttccccaaatgtccagcccaggcctattttccctgtggccactggagggcagtgctggatgatggaaactccaaacctgtatcgctgggggagggggtgctgagagggctctccttagtgaaggctatgccacattcartagcacttccgtttggcttctaggacctaccccttgggcttatggatgacatttatcagttttctaagaacttctctcttcggcttgatgagttggaggaggtaagctaggagtcaatgggaaaaatctctcccccacaagaagggctagagaaatacagagatatttgaagagtgtgaggaaragtattaacacaccagttttcttgatcaatagttgctgaccaacaataggatctggcgaaatcggacaattgacattggggttgtaacagcagaagaagcacttaactatggttttaggtgaggggaatacaacttctctccgtaggagtgggggtgggagtgggggagttccagcctaatatcttgtctttgaagacttgttggcatcctcctagtcataccctgaatgtgaaggatcaacaagggaggctaaggaagaaggagcctccttacttagtttgtggagagtggcccttattcccattatgctctccacagtggagtgatgcttcggggctcaggcatccagtgggacctgcggaagacccagccctatgatgtttacgaccaggttgagtttgatgttcctgttggttctcraggggactgctatgataggtaaggccccartcctttcttggctgatattccagctagtttcccctgcctcactcttctctttgccacttccttctttaccctacttctcagtgtctgtgggagctcttgtgtgtgttagacgaggttgctctcaaaacactttcacatatatggaatcttacttatttttttcttttttgagacggagttttgctcttgttgcccaggttggaatgcaatggtgcaatctcggctcactgcaacctccgcctcctgggttcaagtgattctcctgcctcagcctcctgagtagctgggattacaggcatgagccaccacgctcagctaatttatgtatttttagtagagacgggatttctccatgttggtcaggctggtctcaagctcctgacctcaggtgatctacccgcctcggcctccaaaattgttgggattataggcgtgagccaccacacccggcctatggcattctttttatctttacattatccttgtcttagatggagctagctttggctgcattttatagctgagaaagctgaggcataaaagttagggattagctgggattattcttcaggagtggtcgagactagaatcctcctgatccagtgttctttctagtagatcctaagcttcagattctcctcctgggccaggcacagtggctcatgtgtgtaatcccagcattttgggagtccaaggtgggtggatcacttgaggtcaggaattcaagaccagcctggccaacatggtgaaaccccatctctactaaaaatacaaaaaattagctgggtgtggtggtacatgcctgtaagtccagctacttgggaggctgaggaaggagagttgcttgaatctaggaggtgaaggatgcagtgagctgagatggagccactgcattccagcctgggcgacagagcgagactctgtctcaaaaaaacaaaaaacgaaaaccaaaaacaaattctcctcctgttttctcaccctgagtcagatttgttactgtgtattgttttttttatttttgtttgttttattttttgaacctggtagctactgctgttatttttgtttgtccatttgactctcacccatcctgtggtccaaaaagtgcttaaggaggtaattaaagaaataaatactacaggccatgttctgagaaaataaggagagggtttggggaagcacccaagagtagaagcaaacgattacagggggctggggttggtggctcatgcctataatcctagcactttgggagaccaaagcaggcagtcgcttgagctcaggagttggagatcagcctgggcagcaaagtgaaacctcgtctctacaaaaaatattcggatgtggtggtgcacgcctgtaatccaagctactttggagaccgagatgggaggatcacttgagccccagagttcgaggctgcagtgagctgtgaaaccctgtttcagaaaaaaaaaaaaagactacagggtttatatgggtggccaagccaagcagagatgctgtacttggagaaaagagtggggagagttgacctaacccttttgaggttggccaaagggcatccttcctagccccatacctgctcctctgactgttcttctcttgctctgtctcatcttcttgaggtacctgtgccgggtggaggagatgcgccagtccctgagaattatcgcacagtgtctaaacaagatgsctcctggggagatcaaggttgatgatgccaaagtgtctccacctaagcgagcagagatgaaggttggctgcagggagggggaaagtgtggggtgttggaaaggggccagtggctggggaggagtatccttggattaaatcctatcttttggttttcttttttttttgagacagagttttactcttattgcccagactggagtgcaatctcggctaactgcaacctccgcctcccaggttcaagcaattcttctgcctcagcctcccaagtagctgggattacaggcgtgtgccactacgcccagctaattttttgtattcagtagagacagggtttcaccatattggtcagggtggtctcgaactcctgacctcaggtgatccttggcctcccaaagtgctgggattacaaagcgtgagccaccacacccaacccagttttcttttaatagagaatttactgtrtagtaagagattcgggttttttttatttttttattttttttgagacggtgtcacgctctttcaccaggctggagtacagtggcatgatcttggctctctgcaaccactgtctcctgggttcaagcgattctcctgccttagtctcccgagtagctgggattacaggcacccaccaccacgcccagctaatttttgtatttttagtagagacggggtttcactctgttggccaggctggtcttgaacacctgacctcttgatctgcccacctcagcctcccaaagtgctggaattacaagcgtgagtcaccgcacccggccatataagagattcttaatctcccatagctctcctgttttattctgtatcctctctgcttactgactgacatgtggctttagtctccctgagggtagagattattttctgtgctgggggaggcctaggagacagagtttggatatggtttattgatgctccctgtttcctctcttcagacttccatggagtcactgattcatcactttaagttgtatactgagggctaccaagttcctccaggagccacatatactgccattgaggctcccaaggtaaggagaggaggggaaggaaaagaccatatgtagagtaggtagctaaagatagatgtttaacaaatagctcattcatcaatgagagagaaaacagaatgaatagaggttttgttggcagagaaaaatactcttcatgttaatacagacacccaaccttcttccttgaacagggagagtttggggtgtacctggtgtctgatggcagcagccgcccttatcgatgcaagatcaaggctcctggttttgcycatctggtaagaatcaatcccagtaactataactccaatgaattaaacctgaccttggttgaggtttttatgaactcttctttctcctcccaccttgcaagtcttaactaacattgttgccatctcaatctccctaggctggtttggacaagatgtctaagggacacatgttggcagatgtcgttgccatcataggtacgaggcctattgtgtagtagaggtatcctagacaaaggagttcgggacgcccactggggacagaaggagaacacttcctgttcaccataggccatggcatggactcgggtcctcaatcttttgagcacagtaatgggttctggatcttgggtaacaccactttttttgtttgttttgcctcacaacaggaagataagtaacatcacttttttcctccatcctctcacctaggtacccaagatattgtatttggagaagtagatcggtgagcaggggagcagcgtttgatcccccctgcctatcagctyyttctgtggagcctgttcctcactggaaattggcctctgtgtgtgtgtgtgtgtgtgtgtgtgtgtgkatgttcatgtacacttggctgtcaggctttctgtgcatgtactaaaaaaggagaaattataataaattagccgtcttgcggcccctaggcctaaacttctggtatcttagtgtctcagtatcttagtgtccttcactcggactgtaaacctaagaatgttcattaaccctccattcctgttagattcagtcaggtcttagcaatttttcctgctcgtctccacccccttctctgactcttgtcctttccacttctctattccccatttcctctttcgcctcagttccctccttgcccaaaccttctcagtgcccacataacttggtaaaccactcaaatcaagacctggggtaaagttgggagggaaagggctatagtggggtctgagggaatgttgacgggcagtttcacacagataaatctctgaaccagccgggcgcagtgcctcacgcctgtaatcccagcactttgggaggccgaggcggatggatcacctgagatcaggagttcaagaccagcctgatcaacatggagaaaccccatctctactaaaaatacaaaattagccgggcgtggtggtgcatgcctgtaatgccagctactcgggaggctgagagaatcgcttgaacctgggaggcggaggttgcggtgagccgagatggcgccattgcactccagcctgggcaacaaagcaagagtccgtctcaaaaaaaaaaaaaaaaaaaaaaatctgaaccaggtggagtggaaaatggcagatgtagacagcctttcctgagcgtgaragtctcctcattctgtgggttaggagttggtcattgaagggctgacgcttaagagcccagatctcccaactcccttagttggcccttccgggagccgcccrgtctcttgtgcaggaaggggaaggggccaaagcatgggggaaggcgtggcaggaagagggggactctgtggtcagggaactkctcgctgagcacagctgcacagtgctgtcagaacggccgatctccagcccaagatgattccagcagtggtcttgctcttactccttttggttgaacaagcaggtaagagggtttggtgagggatagcgtgagctggctccagggtggaagtccagagcttgggtctgagggccaagtcaaacacaggtgaaggaaggctgacagtgggtaggtgggcatagggagaccctgaggctagtcctctccagccccgacccagggcactagactcatagttccctcctttcttgttgccttcttacttcattccagacttttctccgtattattattattattttggagatggagtcttgctctgtcacccaggctggagtgcagtggcgcaatctctactcactgcaacctctgcctcctgggttcaagcgattctcctgcctcaggctcccgagtagctgggactacaggtgcccgccaccacgcccggctaagttaagtatttttggtagaaaccgggtttcgtcatgttgaccagggtagtcttgaactcctgactcaagtgatccacccacctcgacctcccaaagtgctgggattactggtgtgagccactgcacccagctattattattattaaaaaaagacagggtcttactatgttggccacatcggtcttgaactcctggcctcaagcaattctcccacctcggcctcccaaagtgctactgtgcctggctgacttttctcttttcagggttgatagaaagtggcaggggaagggtctggttgtatggcatgaagagctggtctggtgaaaagcctcatttctcatgatgagcatttcccatggggtgcctttggtcttgtctgctgggagctgatctctagctggtttaatatacaaagcacccttggtgcctataattccagctactcagaaggctgaggcaggagaatcacttgaacccaggaggtggaggttgcagtgagccaagatcgcaccactgcactctagcctgggggacagagtgagactccgtctcaaaaaaaaaaaaaagattttacatatatatctctatctatctatctatatacacacacacacacatacacacacacacacacacacacacacacacacacatatatatatatatagagagagagagagagagagagagataaccctttaggaaggtaggactctgttcttgtgcttgggagtaaggcaaggatatagccaagacaaacagacgggattgctgtttctatgggtcattgttaatgctccattctgtcagcagttgataatgagggtgggcagcatgagatccccagttccagagacctgagcgtcagctgagaaatagaggcagaaatgggaaggtctctgaagctctacagctccagccactatctaagaattctcactcctcgttcactctgtgttgtctgtgctggattggtgtgtgtgtgttggtggcagctgggtgttggggaggaggaggtcagtaaacttcagggaaactgtggaaattgaaagagaatgactggggaggaattccagcagcctagctgagaaggtgggagcaagtattaagttagccactggtctgctgccgtgggatgaggagggaggaggcccgctgaggcacaaaggaaagcatgggctttagaggcagaaaacctgcatttgagttccagctctgtcacttaactctgtggctctgagtgagttacttagcttttccgagccttggtttcgtcacccataaaatggcgatgatgatgtttccctcacagggtagttttaagatttgtgcaatatcgtgtgtgtgaaagagtgttgcagaataaaaagtacttgaccgatgtcagcaattgactgacgttagtcacatgttccctactggtcctctgatacggggtgagagcagtctctggagcccagacttgatttgattttttaaattgcacaaaacttcccctctcagagacccagagagtgagtaatagggcagagtaacaggagctggaatccatatagctgtggtcattcccccagccttgtgttcagggccaaaggtatctgtaaggtctgggaaaaacagacacactttttttttttttttttttttttacatatttaagtgtcttgtggtgggacagaaagcaacaaggctgaggctaggagatgaccaatgatagagtaattgccttctctcccttccccagctcacatccttcctgtccagccctcagccacaggtcacaggacttagtagagacacttctgtggtttcttcactgaaatttgccactacctctccctcccactacccatcttggctgaggttttggtttcagtccagtggactcagatgggtcccttgaggtggataaagtgctcaatggtgcctgaagaacccacagtgctaaaaagaaaaggttgggggctgagggggaaggcctcaattattagtccgtgtgagtcccatttcaatagaaccctcaagcttcctatcctagcctgaccctatggtgtgggaggagggaaaggtaagggcagtggaaggccagagagaaacagaatttcttcccttagacggctcccctccaggccctgtcctacctcccagagccccttcccttctctcctctgagtaccagatcctccctgatacccccgaccccatgggcatcctctatcccctcagcggccctgggagagcctcagctctgctatatcctggatgccatcctgtttctgtatggaattgtcctcaccctcctctactgtcgactgaaggtagcgctgggcagggtggggtaagggctggaaggggaagtgggaggagggcagcagcaaggattcgaagagaaggaataaaaggggatcctccacaaagtttggagggaagggggatgggccattaacttaccctttactgataacctttcccccattccagatccaagtgcgaaaggcagctataaccagctatgaggtatggaccctcctacacctggtgtggacaacttttcagaccctcagccctcctggggctctagcctgggtttccgggcctctgggagggcctgcctctcaggtgctgatctgcatacacctcagaggcctccctcccaccttacctagccaagccacaagtaaaatattcagcaggtgacagggaagaatcaagcatagagtgataaagaatatgtgagagacttggatgtagtatgtcgggtgtatatgtgtgcttgtagccatgtgggcaaacaggtatccatgtcccagagtgtccatgtgagtgccctctagcccaaggtggctggctgcccaccccccatgcctccctgggtggggcagatgctgaggggccctggagaaagtgtgggtctttaatgttttgcttcttttgtctctgcagaaatcagatggtgtttacacggtaagtgtgcctacctcccccacccaggaagtcagcagaagagggtgggattttgagcgatctttggaaggccggtggggggaggggggtcctgtggaggtgggaggggcctctgatggactccagctcctgatcgccctttgactcccatctccagggcctgagcaccaggaaccaggagacttacgagactctgaagcatgagaaaccaccacagtagctttagaatagatgcggtcatattcttctttggcttctggttcttccagccctcatggttggcatcacatatgcctgcatgccattaacaccagctggccctacccctataatgatcctgtgtcctaaattaatatayaccagtggttcctcctccctgttaaagactaatgctcagatgctgtttacggatatttatattctagtctcactctcttgtcccacccttcttctcttccccattcccaactccagctaaaatatgggaagggagaacccccaataaaactgccatggactggactctattcattcattcattcatttatcatagatttattcagtctctgctaagcactagatacagcttttcagttccagaactcacagtctaatggacttcagagctattttgctcgactgagggataaatgctgactatggctgggggagggataaaaacctttgacctgtaggtgctctgaggatggagctggagcagggactagtgtgttgggagtctaggcatatttggaaacataagaaatgacttctgtatcagcatggccttctgtgttcgacaattgaaccaaggttgggttgtaggggagcctgggtgtccccagatggccaccaatccagacagcatcaatccagtacatgcatatgggaattagcatagctgaaaagccaaatatgcagaacggatggtgtaactagggctgagtgaagctcctaatggaaggttttatagcaacagtgaattttcagggcatctggggcaagtgggaccttagagggccagatgggtcagtggtaggtaaggcaaagggaaataagttgggtccaaatgggggggtcatctccttcaagtgcatgggtggtggtcaaggccctgtcaatgcctgtcctgttttcagagctacgaggaatatttgcctgaaagaatttaaacctcaggagatgctgccagtcctacttgtgacccagtcttttcagaatgggtctagagactccaagcttacccctggcataacccccaacctccacagtgctgcacaacacttcacactgcatagtgacttacacttttcaaagtattttccagctcattgtaccatttgatctgctaattaaccctgtgaggaaattcaggctctttgaagttaattaacctgtccaaggtcaccttgcaaggaaccgactgagatcactttcgtctctgcacattttgccacatgagaagaagcagatattgggaaagagaaggggtagtgagtaatcatgaatggcgagggtcttgaaggccagatgaagcaggttgatcaatatctggaaggaattggagccatctccggtgtctggcgggggaaaggtgatttcagatgagataagagaaatgagccagggtaggaaagtaacttttttttttttttttttttttgagatggagtctcc

SEQ ID NO: 12222 - DNA, 19175 bp, Homo sapiens
gaccagcctggccaatatgatgaaaccccgtctctactaaaaatacaaaaattagctgggcgtggtggcagtcacctgtaatcccagctactcgggaagctgaggcaggagaatcgcttgaatctgggaggcggaggttgcagtgagccgagatcgcaccactgcactccagcctgggtgacagagtgactctgtctcaaaaaaacaaaaaacaggagagaatggattttcctgtccacatagaataaaaagcagttggtttagccaggcatggtggcatgtgcctgtagtcccagctacttggggagctgagatgggaggattgcttgagtcctagaggttgagtctacagtgagctgtgatcatgcgactgcactccagcctgggcgacagagttgagaccccatttcaaaaaacaaaacaaaacaaaaaaacagattggaaaacagcaatgaaagattgagttctataagttgacaataaagaaaattgacaaaattttccagttttgctgtgatttgtctttgaatttggtagtttctgtttgggtatttcttgtgtatgttattacttgtgttttaaatctgaaaccccatgtatgtggaatcagattatgctgctatagagatccctcatggcaactcaaccattctcttagttggcattatatagaattattttaaatgcaatgatgattaagaatgagaaacaatttctctgtcttttgtactctaagaatgggtgaaaatgacatttttaagctttgtatctttcagagtatctccttctctctgtgcacatggagttttgtgtctcttttgctttacccctagttctctagacctttaagactcttgtttaactgtgacggtatttgtgtttgaataagagagatgcaactgaaatacacaattagcattgtcttcacttatttccattttccctccttttctcccaaggtgtcttttgcagctcacattgcaggtggatttgctggaatgtccattggctacacggtgtttagctgctttgataaagcactgatgaaagatccaaggttttggatagcaattgctgcatatttagcttgtgtcttatttgctgtgtttttcaacattttcctatctccagcaaactgacctgcccctattgtaagtcaattaataaaaagagccatctggaggaaataaaaaaaaaaggaagactctatgaagaaacagagaagtctcagcaaaggctaacaattttatatagaggacaaaacagcattaaactcatcagttgcaaagattgcctataaaaggaccttaggatttaaggaaggggcttcttaatgtagaaagggaagaagaagagagaaaagaagggtagtaaaaactagagattggggccaggcgcagtggctcacgcctgtaatcccagcactttgggaggctgaggcgggtgaaatcacctgaggtcatgagttcaagaccagcctgaccaatatggtgaaaccctgtctctactaaagaaaatacaaaaattagccgggcgtggtggcgtgtgcctgtagtcccagctacttgcgaggctgaggcaggagaattgcttgaacctgggaggcgaaggttgcagtgagccgagattgcgccactgcactccagcctgggtgacagagcgacactcggtctcaaaaaacaaaacaaaacaaaacaaaattagagattgggtctttcccaggcatatggtattctataaaacagacttactctccttggaggatatattttggagaatgcttcataaaatctatgaatactgtacaatgctgataataaaaactttttatacctgtgtcagactcctgataatcactttaaaatagatcactgtttgaggagatagatcactactgtttgaggtgttttacacactttattgataatattatcaacaacccggaaaggtagttattactctgcatcttagagtaatcttaaagaatcccttaaaggaacccttaaagaattaagtacttgtctgaggggagcagaatttaaacatagataatgacttggaaacctgtagtctcccctataggtccaacaatgctgtgttccccaaacactgaagggtatcataggagtacaggaacaaacatctatgcggggtacaccatgaatggtggaaatatctcatagaagaagactgaggattttctggactgctagtttaagattctgataccgtgtctaagatcccaaggaaccgggcactggctttctggtgcacactatatacctagacttcagattctcatctgtgatcagactgtcatccttcatgtgggtcatggctctcctaggagtgggtaggatttatttacagaaggtaaaatgtcatacctgaaagctgagaagcatgtgtcattttcctgtatagaattcagactgtggtttattatgtttttggaaatggtagttttgggtcatctgaatataggaaatataattttttcttttatcatcaatgtatttattaaacacccatctaaacatgtcactgtatctggaaggggcatatacacttagttagatatagtgagaaaagttaatactttagtattttgagaaaaactgatcagaaatttgtttaaaaagttaaatttaagtataaacatgggaatatgagtgtttttttttttgttttgtttttttttgagatggagtctcgctctgtttcccaggctggagtgcagtgggctgatcttggctcactgcaacctctgcctcctgggttcaagcaattctcctacctcagcctccagagtagctgggattacaggcatgcgccaccacatctggctaattattattattttttttttgagaccgagtcttgctctgtcgcccaggctggagtgcagtggccggatcttggttcactgaaacctccgcctcctgggttcaagtgattctcctatctcagcttcctgagtagctgggattacaggtggccgccaccaaacctgactaatttatttatttatttatttatttatttatttatttatttatttttagtagagacggggtttcaccatgctggccaggctggtctcgaactcccgacctcaggccctcaggcgatctgcccgccttggcctcccaaagtgctgggattacaggtgtgagccactgtgcccggtccctaatttttttttttttttgagatggagtttcgctcttgtcatctaggctagagtgcgatggtacgatctcggctcactgccacctccacccactgggttcaagtgattctcctgcctcagcctcctgagtagctgggattacaggcacctgccaccacgcctggctaatttttgtatttttagtagagacggggtttcaccatgttggccaggctggtcttgaactcctgaccttaggtgatccgcccacctcggcctcccaaagtgctgggattacaggtgtgaaccactgcactcggctaatttttgtattttttagtagagacggtgtttcaccatgttggccaggctggtctcaaacccctgacctcaagtgatccacccacctcagcctcccaaagtgctgggattacaggtgtgagccaccatgcctggccttatgagtgtgttcttggttaaacaaagattcaaacaagaagttaaaagataaaatctcagccaggtgcagtggctcatgcctataatctcagcactttgggaggccaatgtgggaggactgcttgagcccaggagtttgagaacagcctgggtaacattcaagaactctacaaaaacataaaaaataaccaggtgtggtggtgcttgcctgtagttctagctactccagaggctgaggtgggaggatcactggaacccaggagttcgaggttacagtgagctatgatcatgccactgccctccagcctgggtgacagagtgagaccctgtcttaaaaaaaaaaaaaatctccttttgccttctcacttcaaacctgctgtttttccctagtgctgaccatcatcagtggtcacaacagtatggtctgtatccttgcagacatttttctatgtaggatgagcagaaaggaaaatggatttaagttaatgtccaactcatccactgtattgaacttcactgaatctgctctacaccctcaaagggacaaatctgaagaacaaattagaggtgtccatggtataactcctcctaagcatcatttgcttctcagattgatctcaactaggaaaagtttttgttaatcgattttagctaaatatatatgtgtgtgtgtgtgtgtgtgtgtgtgtgtgtgtgtgtgtgtatatatatttttttttttttcttgagacagggtcttgctgtgtcgcccaggctggagtgcagtggcgccatctcggctcactgcaacctctgcctcctgggttcaagcaattctcctgcctcagcctcccgggtagctgggattataggcatgtgccaccatgcctggctaatttttggtatttttaatagagactgggtttcaccacattggccaggctggtcttgaactcctgacttcaggtgatccgcctgtctcagcctcctcccaaagtgctaggattatagacatgagcccagcctctaattagatatttttatgaaatgtaggttttaacaggataaatgtgatacatgtattgttctataacttgctttacaacatgacctagggacctttctctattagttcatagaaatctttattctctgaattgctgaatgatatagatgtaccatagataaccattcctctgtcagacatttaaattattgctgcttttgtataattaccaacagtgctatgtgaacatcctagcatgtgcagtgtgtctctgaatgtctatgctgaatgaatatttcaagtatccaaaagcagaaatgctatactaatattgataggtttaaactgccttttaaatagctgtatccatttatattcttacctacaggatatgagagtaacagtgtctccctactttgccaaaagaaggtattataaatctttaaaattttgcattttgatagttaaaaaataatatttcacttaaatatgtattctctgactaccgaggttgaggaagtttcgagtttattaataatttatgagttacacatatgtaattcagataacacataatatagaaacatgaatatattgtgtatgtatgtgtgcctatacaaatatatatatatataatatatatatatatatatatataaatatatatatatatatatatatatatatatatatatatatatatatatattttgtccctggtgaaatgtttgtatttaatctgagaagtagctattgttggcaaaaaagcccagggaagaagtatttatctgttatgctcaacctgccagatcactagctctgaagggacctttaatgacctaaaatacaatgtaattgttaataacagaacatgggagacagaatcaggatctatctatgaaatcggacatgacccatttattaaggcagatgaccaagaagttattatctagtaagaaagacttttttggttctagaaacatggtttattgcacaaaaaacaatgacattttattaggttcccccagtggcaaaagttgcatacaaacagcacacaaatacctcctgtcattttaaatttgacatctctgaattatggaggaatcattcactcagcttaatttggggctcatgactttagtcttctagattgcagtgtgttatcaggactattataagcattctttatctgtgctgtccaaaaaagcagccattaggtagatgcagctctttacatttttattaaaattatttaaaattaaaaattcaattgctctgacacacaaaccataatgcaagtgttcaatagctacatttggctactggctgccttattggctagcacagatagaatatttccattgttgcagaaagttctattggatggtgctgttttaaaagcaaggataagcagaaagggacatggattttagttgatggatgactcactcactacattcaactgaactgaatctgctctataccagcaaagggacaaattcagaaaataaattgaagatggccatgctgtaacttctaaacatggtttgcttctcagatttacctaaactaagaaaggtttgtgttaatctctctgttttagcttattaagaaagagttgtttgaaatgtttttatctttttcttttgaattctatggtactgtatatatgtataccagtttttatgtcatttgctatgaaagctttaatttgtagctaaatactactgctccttctttcaggaaatactatgtgttgtcctttatgaaaaaaatmttttctttctttttatgattataaaagtaaaatgcttatagtaaaaaattaaaatacatgtaattacaatatattaagtatataatttgtaatcccaacatccagagctaatcaccgttaatattttcatgaatatccttctagacttttttgtatacatctgtaaatgtaactaaacttataataatggggccatattattctattttataacatcaatttcactgaaatgaaatatcaaatgccattttatgtatgtttatcatttctactggttgcatagtatcacaccgtggatgtagtcgattatttaaccagtttttcttgtattattattttatgtttttagcttatgactattataaacaacatgaattacatctttgcttacattattattatttatgaaccataaatgagacttaacttgcttactttttttttattttttgagacagagtctcactctattgcccaggctggaatgcagtggccagatctcggctcactgcaaccttcacctcccaggttcaagcgattctcctgcctcagtctcctgagtagctgggattacaggcatgtgccaccatgcccggctaatttttgtatttttagtagagatggggttcaaccatgttgctcaggctggtctcgaactcctgacctcgtaatccgcccgcctgtgcctcccaaagtgctgggattacaggcgtgagccaccgcgcctggccaacttgcttacattttaaagtgctttgggttgttgggtcagagtatgctattattattattattattattattattattattattatttatttttttttgagacagagtcttgctctgtcgcccaggctggagtgcaatggtgtgatctcggctcactgcaacctctgcctctgggttcaagtgattcttctgcctcagcctcccgagtagctgggactacaggcgcccgccaccacgcccgactaatttttgtatttttagtagagcaagggtttcaaccatgttggccaggctggtctcaaactcctgacctcaagtgatccgctggcctcggcctcctaaagtattgggattacaggcgtgagccacgtgcccggccagagtatgctattattaacataataaagtcaatggaaagtttctctatttcaggaatacaactatattttagaaggttgatgcttttgcaaatcgtattaacagagccgggcgcggtggctcacgcttgtaatcccagcactttgggaggccgaggcgggaggatcacgaggtcaggagatcgagatcacggtgaaaccccgtctctactaaaaataacaaaaaaattagccgggcgtggtggcaggcgcctgtagtcccagctacccggagaggctgaggcaggagaatggcgtgaacccgggaggcggagcttgcagtgagccgagatcgcgccactgcaccccagcctgggcgacagggcgagactccgtctcagaaaacaaacgaacaaaaaaaacagaacaaaggctgaagaaaggaactaaagactctagaactagttatttaaaaagccaaagctatcactattttacattcctaaatttaaatgattaaacttaagagaaaacagataatctcttaatgtttctttccggcaaatttgaagtttgcttacagaggaaaaataatagtttagtaaaaaatttaaggagctgactctaaagccacaatgattgggtttgaatgccagctccagctgtgtgacctcaggtaaattaaggtgtgcttccgtttcctcatctgtaagatgggggaaacaacatacttaccgcataggattttagtgatgaacacatcttgtatcttagtagtttgtttgattgtgtaacagtkccctttatataaaggggacaggacatacatttatattttaaatgaaaaataatgaaaatattcacttttaaaatctttcctttggggtatatttcctctgagataacctgggataccaaccttaatatgcaatctgcyggcaaataatccaagcagctaaattataacttgccccactgcttccttcaagagagcagctatatgtcttaaataggtcaaatactgctacagtgaaagtttccataatactrccaccataccagtgaacaatctattgcaagtaatatctataatgagattctggtaccataaggccgggcgcagtggctcacgcctgtaatcccagcactttgggaggccgaggcaggtggatcacctgaggttgggagttcgaaactagcctgaccaatatggaggaaccccatctctactaaaaatacaaaattagctgggcatggtggcgcatgtctgtaataccagctactctggagcctggggcaggagaatcacttgaacctgggaggtggaggttgcggtgagccgagattgtgccattgcactccagcctgggcaacaagagggaaacttcgtctcaaaaaaaaaaaaaaaaaaaagattctggtaccataaaatagttgagaatttttggagttctttttgttttctgagacagagtttctgctcttgtcgccaaggctggagtgcaatggcgcgatcttggctcaccgcaacctctgcctcccaggttcaagtgattctcctgcctcagcctcctgagtagctggggttacagatgcctgccaccacacccagctaattttttgtatttttgtagagacagtgtttcaccatgttggccaggctggtctcgaactcctgacctcaggtgatccgcatcggcctcccaaagtgctgggattacaggtgtgagccactgtgctgggcttgaagttcattttaaygtaagaatttacaaaatttgggctgggcgcggtggcttactatgggaggccgaggcgggtggatcactcaaggttcaggagttcaagaccagcctggccaacatggtgaaaccccgtctctactaacaatacaaaaattagccaagcgtggtggcacttgcctgtagtctcagctacttggcaggctcaggcacgagaatcacttgaacctgggaagtggaggttgcagtgggctgagatcctgccactgcactctagtctgggcaacagagtgagactctgtctccccccaccaaaaaaaaagaaaaaaagtatactttttcatagtaaagtataataagtactttatacatattcataaatattactgagatgaatttctgaaaatgttcaccaattgccaggaagaaaccagaatttatttcaaatttatttcaatttggattaaaaaaactaatctaaattcctatgacagccagatctgtttcctctggtttcactgaatgccatatcttactgaattatcaaatgaagcatattcgttttcctatgtgtataaatgagatttaaaaatcactgactttttgrccgggcacggtggctcatgcctgtaatcctggcactttgggaggctgaggcgggtggatcacgaggtcaggagatcgagatcatcctggccaacatggtgaaaccccgtgtctactaaaatacaaaaaattatcccggggggtgttggcaggcgcctgtaatcccagctactcaggaggatgaggcaggggaatcgcttgaacccaggaggcggaggttgcaatgcgccgagattgcgccactgcactccagcctggcgacagagcaagactctgtcccaaaagaaagaaagaaagaaaaaaaaatcactgacttttcaagccagtaatggcatgttggggaaaaagaaattgactttgttataacttttatatcaaataatcttaataaataaggttaagatcaggttactagttttagaaacctttccaaaagttctgttgaaaaacaacaataggctgggcatggtggctcacgcctgtaatcccagcactttgggaggccgaggtgggcagatcacctgaggtcaggagttcgagaccagcctggccaacatggagaaacatcatctctactaaaaatacaaaattatccgggcatggtggtgcatgcctgtaatcacagctactcaggaggctgaggcaggagaatcgcttgaacccaggaggtggaggttgcggtgagctgagatcatgccattrcactccagcctgggctacagagtgagactccgtctcaaaaaaaaaaaaaaaaagaatataattttaggccatgcgcattggctcatgcctgtaatcccagcactttgggaggccgaggtggccagatcatctgaggtcaagggtttgatctcagctcactgcaacctctgccttccaggttcaagcgattctcttgcctcagcctcccgagtagctgggactacaagcgcctgccaccacgcctggctaatttttgtatttttagtagaggcggggttttaccatgttggccaggctggtctggaactcctgacctcaaatgatccacccaccttggcctcccaaagtgttgggattacaggtgtgagccaccccgcccagcctatattcttaatagagaatatatacactcctcctccaggtatcatgtttttttcattgtaytgtgatgtctaaatataagtgattttaaattcctgacatttaagtatattattggtaacagattcacactttggccaggtgtggtgacccacacctgtaattcccacactttgggaggtgaaggcaagaggatcacttgagtctaggagtttaagactagctgcagcaatagagtgagaccctgtctctacaaaaaaataaaaaaaattatctgggtgtagttgcacacacctgcagtcccagctactcaggaggctgagaggggagatgatcgcttgagtctgggaggttgaggctgcagggagttgtggttgcaacactgtactccagcctgggcaacagagggagactctgtctcaacaaacaaacaaacaaagaaaaaaccccacagctatctagggaaaaagtaaagcaaccagcatatagaagtgacatattgttatattttcaccataggtttgctttaagaaatagtgctcccttcagaatggaagaatttatctgcctcttatttgatgtggatcagagctaagatggctgactaaataaacatgggggactggaatctccttrgagatactctggaggaagttcacatccactccaccatgattggaaagatctggctcaccatcctgttcatatttcgaatgcttgttctgggtgtagcagctgaagatgtctggaatgatgagcagtctggcttcatctgcaatacagaacaaccaggctgcagaaatgtatgctacgaccaggcctttcctatctccctcattagatactgggttctgcaggtgatatttgtgtcttcaccatccctggtctacatgggccatgcattgtaccgactgagagttcttgaggaagagaggcaaaggatgaaagctcagttaagagtagaactggaggaggtagagtttgaaatgcctagggatcggaggagattggagcaagagctttgtcagctggagaaaaggaaactaaataaagctccactcagaggaaccttgctttgcacttatgtgatacacattttcactcgctctgtggttgaagttggattcatgattggacagtaccttttatatggatttcacttagagccgctatttaagtgccatggccacccgtgtccaaatataatcgactgttttgtctcaagaccaacagaaaagacaatattcctattatttatgcaatctatagccactatttcacttttcttaaacattcttgaaattttccacctaggttttaaaaagattaaaagagggctttggggaaaatacaagttgaagaaggaacataatgaattccatgcaaacaaggcaaaacaaaatgtagccaaataccagagcacatctgcaaattcactgaagcgactcccttctgcccctgattataatctgttagtggaaaagcaaacacacactgcagtgtaccctagtttaaattcatcytctgtattccagccaaatcctgacaatcatagtgtaaatgatgagaaatgcattttggatgaacaggaaactgtactttctaatgagatttccacacttagtactagttgtagtcattttcaacacatcagttcaaacaataacaaagacactcataaaatatttggaaaagaacttaatggtaaccagttaatggaaaaaagagaaactgaaggcaaagacagcaaaaggaactactactctagaggtcaccgytctattccaggtgttgctatagatggagagaacaacatgaggcagtcaccccaaacagttttctccttgccagctaactgcgattggaaaccgcggtggyttagagctacatggggttcctctacagaacatgaaaaccgggggtcacctcctaaaggtaacctcaagggccagttcagaaagggcayagtcagaacccttcctccttcacaaggagattctcaaycacttgacattccaaacactgctgattctttgggagggctgtcctttgagccagggttggtcagaacctgtaataatcctgtttgtcctccaaatcacrtagtgtccctaacgaacaatctcattggtaggcgggttcccacagatcttcagatctaaacagcggttggcttttagacattatatatattatcagagaagtagcctagtggtcgtggggcacagaaaaaatagataggggcagctctaaagaccagctgttaagacagacaactgcaaactcatttaagcaagagaaaaacagctctaattcgagattgtgaagcaacacttctaaattcaaagacatagagttgtcaaatcaggattttttttttttttaaatgatatcctttcgaatgtaactgattttgggaaaatcacatgttcagaattgaggctaaatggtttgatcaggttttctctttgaagagaccacagccttaggaaatggttcttgatctatacaattccaccttggacactgggttaattctgtttgcccctggaacacaatcacgtaagtttccttctagactggcatcctgatgtgtcttgagtataatcacatgttgctacctagtaaataaaatcttaagaagatccgtggctttccttcaccagttcatagcatcgtgattcattgcccggattggactcgactctactcactggacatctaaccactccacttaattaacaatacccaccctacaggggtgttgtaaggattaaaatttaaaatacccgtgttttctacagtgcctggctcaaaagctactgcaagctcgttactgctcatcctccagaggcccacatcaagtcagccacgactcaaggagactccaaagataaaagctgaagccaaaatatatgattctaaacaccctcctcggctactgcaaagcactgtgagcactttctcaggacgagagccaagaagcccagcacctatgggtcaccacagtttccgaggtcccagatgaaaaagatgcgctcgctaccaccgtgcggcggtcctttctctcgcaatagtctcaatgctcccgggccctgcctccggacgccaggacagaggtaccaaaatctcacctcctgcaaagaaacctaattgctacgggggccggaagaggaagaggtgcggctccgacagccagaggggcgggcatacgcagcctccctcggctcagcctgctactggggatgcagagcgtcctggtcgccatgaaaacaggccacacctcggcgatcccggccsgtggtttgcaagtgcgcaggcgcgcgcccccttccgcgcatgagcagtgctgctcccaacccgccagtcgcggtctccsgcgccagctacgccgctgccgctgtcactatggcccattacaaagtgaggggggcgcggcgtggctgggggcatgcgggcggtagcaagccgctggtcggctctgggtgggagtggggtcgcgcgcgcaggtttgggcgggagggccccgaggtagtgaggcggaggcggggttgccggactcccagcgccttcttcctgctcggctcccgggctctggccactgacccccggtgtctcttcaggccgccgactcgaagcgtgagcagttccggaggtacttggagaagtcgggggtgctggacacgctgaccaagggtgagcctgggctaggagagggtacctcgtgccctcgtcgtgctccccggcgctgccccgttccccagcgggccgtagcgtggggaaggaggggaaacagatggggcccgtccggggtccagcgaggtgggcctcggggttcagcagggacctggctgctggacgccgcccgggtggggtagcctagctccgctacccttctccgcaccgggagtgaaactcttgcagctgttgcaaagtctcttcaacttccgttgctttgcctccagcagccgcagtggacatgtttgccaaggaccttcagatcccaattcctcccaccttacggtttttatggagtcctcagaatcttgttaagaaagtttccctccaacaaagagcaactggaaaaatgaccgaatttccaagtgggctatgaagtagctgagtgagcctaatccccaaagtaggagattcatagcgaatttggctgtggcttttcagcccccattccttagtctgtctgtgtcaattcttattttgtgtatatttcataaagtagaattacagcttaaagagctcgagggcatatcaaggtggttacattgttttcactttttaaaatgaaagcttactgttaacgctgtatctcttcattcgtggcttcaagatctaagttaagtagatgagtaaagtgttggaaacaggaggatttcaaggggtagggtacagtttactttattggcttagcactaatttgaatgcctgctatgtgtcactcaactcactgggatattcaagggtgtagaatggaattgttcgcagggatgaggacttgggtcatatgaaactaggaagtttgggaagtgggaaataaattggtaactgccctttggacagaagcaaagtttagaggaaaattctaggagcataactcctgggtcttagaagaaagaaggctagtaattttgaattgctacctatttggggttcagataatagtttacctctttgcaaataaacttcagcaagtcttaagggactactctgtgaaagtactgtgctatgttgtctctgaaagtgtcacagatgctttgaatgtcattccgtctaaaaactccttacgttcatttctttcatttaataattttactcaggtgtctgttctgcacactggagataagcaggggaggataaaagtctcggctctcataagcttatatcctagttgagggagagaaatacataaataaatatgtagtgtcagctagtggtaagtggtacagataaaaatacagcaaagttagggataaagagtaacaggtgaggccaggcacgtggctcatgcctgtaatctcagcactttgggaggctgaggtgggtggactgctagaggccaggagctcaagaccagcctgggcaacatggcaaaactcccatctcttaaaaaaaaaaaaaaattgctgggcatggtgtgtgcctgtaatctagctactgtggaggctgaggtgagagaatcacctgagcccaggaggtcaaggctgcagtgagttgtgattgtgccactgggcaacagtgacactctgtctccaaaaaaaaaaaaaaaaaaaagtgacaggtgggatgtgtgtgtcattttatatagggtgatggggggaaggcctttcttaagaagtaacttttgaccagaaacctgaaagaaacagagtttcaggaagtctaaggaggccagagtggttggatggagcaagtgaaagactgaatggtaaaaggcagaaaaatgacagttgtaggcggtaactgactacacagaagatgttgcccaggctggagtgcagcggcatgatctcggctcactgcaacctccacctccgggttcaagcgattgtgttgcctcagccttccaagtagctgggattacaggcatgtgccaccatgcttagctaattttttgtatttttagtagagaggcggtttcaccacatgggccaggctggtcttgaactccttacctcaggtgatccgctcacctcagccccgcagagtgctgggattacaggtgtgagccaccgccctccactagaatttaacctctcaatctccttagatttccaggctcctaaataacatcagccaacacagtattgatgtgatttattaaaaatttgattttcagctccaaacataggtgctttacacaattctatttgtttttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcctctatttgtttttactttttattttttttgagacagagtctcactctgtcacccaggaatgcctggcctcaagtgatccttctgccttagcttccccaagtgttgacgttacaggcgtgacccactgtgcccagcctcacaaatttaatttacatatatatattttttcgagacaaggtctctgtcgcccagactggagtgcagtggtgcagtcatgtctcagtgcagtcttaatctcccaggttcaagcaattctcccacctcaggcacccaagtagctgagactacaggcacgcaccaccatgtccggctgatttttaatttttttttttttttttttttgagacggagtcttgctctgtcacccaggctggagtgcagtggtgcgatctctgctcactgcaagctccgcctcccgggttcacaccattctcctgcctcagcctcccaagtagctgggactacaggtgcctgccaccatgcccggctaattttttttgtatttttagtagagacggggtttcaccatgttagccaggatggtctcaatctcttgacctcatgatctgcctgcctcggcctaccaaagtgctgggattataggcgtgagccatcatgcctggccaattttttttttttttgtagagttggggtgttgcccaggttgatctcaaactcctgggctcaagcaatcctcctgtcttggcctctcaaagtgctggaatttcaggaatgagccactttggcctaaatttttacagcttatttccaagatgatttgaaatagtttataacattaaaacactatgaaaggatggctaaagatgataaatcatttggaagctgaagcattttagctattttgagcgctatatcaacctctaaaaatcctggctgcgaaggcaaaaaggggagcatgattgggtatagagttcttgtctgattacaaggaagtgcatttcatctatagaacagcacaggaaactttgtatttacagtatcttctgcaactatcaacctttcaagtaccagtgacaaatgagaagctgaaagaaatggggtgggggaataagaggaggagagagtagagtattaatattcatgtcttataaaatgaggatttggccaggtgtggtggctcacacctgtaatcccagaactttgggaggctgaggtgggtggatcacctgaggctgggagttcgagactagcctgaccaacacagagaaaccccgtctctactaaaaatacaaaattagccgggcatggtggcacatgcctgttatcccagctactagagaggctgaggcaggagaatcgcttgaacctgggaggcgggggttgtggtgagccaagattatgccattgcactccagcctgggcaacaagagcaaaactctatctcaaaaaaaaaaacaaaaaaaaaaaaccaaatgaatttctcaaaaaatagtgattttttcatactgtatattattttggtaagttattaaaactctaaaagaacaaaagggaagtatgtaagttggtttacaacaggacttaacttggggtctagatatctatcactgtttttttgtttgtttgttttgtttttttgtttttgagacagagtcttgctccatcgcccaggctggagtgcagtggcacgatctcggctcactgcaagctccgcctcctgggttgacgccattctcctgcctcagcctcctgagtagctgggactacagccgcccgccaccacgcctggctcattttttgtattttttagtagagacggggtttcactgtgttagccaggatggtcttgatctcctgacttcgtgatctgcccgccttggcctcccaaagtgctgggattacaggtgtgagccactgcgcccagccacattttttttgtgtgtgtttactttttttgcttttattagatttttcaaagggttccatgcacaaaaaggccaaccactgatttagagttttttatctaagtagtaaattctaggaggaatttgttccatagatgaagagcaaggcagtgctcatatgagtgattagatatga

SEQ ID NO: 12223 - DNA, 13587 bp, Homo sapiens
  misc_feature (1)...(13587): n = A,T,C or G, or insertion/deletion polymorphism (see Tables 1-2)
cctgcacctccgggctctgtccatgccccaccagctacgcacttgtaccagttggtgagcgtcatcatgacgtgcagtgaggccagcaccaggcagaagtggaagaaggagtagctgtaggtgacgccgtcctgctcgttgtcaaaggcccggccctcacaggctgccacctgctgctgctgctgctgtgtggcgtctagcataggtgggcactcctcggtctgcatcaggctgttcacctgccggtggtctgaggagcgcagactgcaggggagggaggaaggtgggcaaatagatagctctggcgttgctcataacactggacacaaatggtcccagagcctcaggggccagcgacccggttactgggcctgggagttaacaaactgctttgcctctcaactctacccctacccccactcccattttctgtgtgaccttgagcaaaacacttaacctctctgagcctctgattccttgtctgtaaaataagggataatcgtacctcctctagagggctgctggggggactagacggaataatgatgtaaggtctctagcatagtgcttggcacagaatataaattcaatcaacagtcactattgttaggattgttcctttgccatttccataaacacgtatcgagtacctaatactacaaagtaccataccaggtactacatccattaagaatgttaataattaatcacgctcatttgccattgattttaagtttccattttattagtgtcaggtggttttaccaatggcctccctttccttcatgcttacactaaaaaaagaacaacagtaatgattgtatgtcatgcttttctgtgatgagccttgatgtttttaacagaatttgatagtttgagacataaaaatttttgaaaaaccaacacacgtttccaaacaaaaggaaaaggagagctggatccagcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagggaggggagggaagaggagaggacacagaggtaattcaagcctttccagcttgaaaaggaatcaaatgtgacaaagaagacagatgtttatgaactgtacagaactgacttggagaaaatgttttgaaaaaggccaaaacagaagaaaatgtgaaagagctttaaaatgttctagcccaggggcctgggggcaggggtgctgttggaactgggatggatggatcggggagatcaggggagcagagccaagattccctctagagttaagggcagatggaaagtggtgcttggagaaatgcagggccacagggaggcaaactcggggtctgcctgatccgtgtaaacaataattaaacctaatcttatgatctagtgacttgtaagaacagccaccacctacagctacctagttgtgcaaatgttcacaatattatgctcatactaatatacaaatgttcacaatattatgcaaatgttcacaataatatgcaacacttaatttggcaaactcccaggctcaagtgatcctcctacctcggcctcctcagtcactgggactagaaggtgcataccaccatgcctgactaattacaaaaccttttttttttttagagacaccatgttgcccaggctggccttgaactcctgggcccaagcaatcctcctgcttcagtctggcaaagtgtttggattacaaataacttactacttgccaagttcctttctaagtgtttttgttttgttttgttaatttttaaaaagagacagcgtcttactatgttgcccaggctggtctcaatctcctgggcccaagagatcctcccacctcggcctcccaaagtgctgggggttacaggtgtgagccaccatgcctggcccctttctaagtgttttacacatactgattcatctatagcccttcaacaatccaatgaggaaggtactatttttatctctattttacagacaaggaaatggaggcctaaagaggttaagtgacttgcccaggatcacatagctagtaagtggcaatgccaggctcaaatgcaggcatttgagtccacatggataagcacctactaagatgcccctttgaaaagaacctctatgtgaacttcagcatgagctgccttctctcgggggagagtgtggggtcacagccacatccactacagtggaggttgtcatcctcttactgaggaggaaacaggagctcagaaaggttaagccacttaccccaagccgcacagcaggggagaaacagaccctggacccactgaccccagtccatgctccttccctgaccccacagccgtctgcacccaactgaactggcccagtatgcaggaaagggctgtgagccaggaggcaaggtcacgcctgcctctgttgcccactcatgccatgccctctgagggactcagtttcccctcccgcacaatgcaagacctggatatattgaatgtgaagagcacgttccagtttggtatcctggctcccacaccctcccctcactctggctcagggccctcaatcaygatccttccccagaatccagacctggccatacctgatgaagagggtgcacaggaggaagatgatgaggcccacaatgctcggggcatcccaccactgggtctcatagccctcggggcctgccacaactgtctcgttgcycagctgggttggcaaatgggggttgcatttctgttctggagatgggagcacaatcaccctcagcccatgcaggccaggcctaggtagccaagtggccctgaggatggctagagagccacccctaatagacagacagatacacagccaaccactcaagtcccagcaacagagcgctcagcagtcacaagggcagagagacaactcaggaacagacggggccctcccatctcatgggaggactgagtctcagaatgggctggagcagggatgtccctgtcacctgtgagggtccccagccccacagtagactgatactgacccaggaacgaggccaggcctccttgagcctgggcccatacttaccagggatactggatagggctgaccaggtgacaaacatggtgtagagggtgatgaccgaggcctgcagcagacccgagttgggctgggcgtcctggcaagaggacccctggtaagacccctgccagaccagagacaccccaccccacccagcccactcacaccagccaagggacctcagaaactcccacccacctaggataccccaccacaccccacttagggaaaacaccaagcaggccacctaccacccacctcactaaccaaaggctgagtcctaattcttctttctcttaacacccctcagattacttgccctcctcccctgctgaaaccccatctcatcacactgaattccttcatctccacctggcccactgtccccctcctccctgctctccgtctggagagtctgcccagcctctcccaccacaaggcctttgccgtcgctgtgccctccctctgacaagttccttcccagcatctccgcacaggcagcgcctcttcagtattcagacaggactcctgcggagccctgggaacctgaactacggcagccctgcacctgccagccacccacctttcagcccacaccctctttcatgttccacattgcaatattacccaaaatcacctcactgggcctagtcccctgttgcctgtccttccccacccctcaccacacatgcacataaaaacatgaacctgaactctgtgattaagagcacaggcagctaggcatggcggctcatgcctgtaatcccagcgctttgggaggctgaggcaggcagatggtttgaagtcagaagttcaagaccagcctggccaacatcgcaagaccctgtctctactaaaaatacaaaaattagctgggtgtggtggcgggtgcctgtaatcccagctactcgggaggctgaggcaggagaattgcttgaacctgggaggcgaaggttggttgcagtaagctgagatcataccactgcactccagcctaagtgacagagcaagattctgtctcaaaaaaacaaaaacaaaaaaaattttaggctgggtgtggtggctcatgcctgtaatcccagcactttgggaggctgaggtgagcagctcactggttacttgggaggctgaagcacaagaatcacttgaacccgggaggcggagcttgcagtgagccgagattacaccactgcactccagcctgggcaacagagccagaccctgtctcaaaaaaaaaaaaaaaaaaaagaaagaaagaaaaaagaaaaccagagcacagactctggagccagcctgcctgggtttgaatcccagctccccatgtgaccttggctaggcctcttctctaagcctttgtttcctcatctgcaaagtgaggatgaggatggtgtgaggatcaaataacatgtccgaggccactaactactggctatcatcattattcttcctccccttcctcacagccatatccccaacatctagaagagggcctggtacacaggaagtgctcaagaggtatttgctggataaatactgattgctgtgtgacctgggacacagacatcgccttctctgggcttcaacttttcttactgggatatgaggctctgaccagaagggaggttcccagcctttctgctaaagacccctgaagactacctaagccccctgaagctgccggtgtgctgagatctcaaaccacaaagcaccactgtactcacaaggggctccagcggtactttctgaagaacacgcagttcctctgggagctcctgcccattattccagatggtcttggattggaaatgtgaaattgcaccttcctacactacttccagaggtgtctaggaatcaccactcagggactgcccctaatgttctactgatttgcataaaaacaaaaatgacaacaataataactacaataatagctaatgtctgagagatatctacaggccaggcatggagtgtttacaaataggatctcaatcctgagaataactccaatagtaggtcttattatctccatttaatatttgagaggcagagagaggttagggcacctcctaaagacacccagcatgaagccgtgagagcctgactataacctggggaggctgacctgggagcccacacactcaggccgtgcctctgtgatgacagccctagccccaggacccaggttcctacaagaagtcccacccactaaggggccgggcttcaggccagggggggacaggcaggctcacctggaccttgggcaggacagcagcgatggacacgcagacacagaaggtgaggttgaggctgatgaagaccttgccctcgtggcagccgctgggctcagtgtagtacatgaacatcagcgccacggccgcgatcgacagcaagtagaagaggagagtgaagaagaagaggcctgggccagaggggtagtgagagggtaggcagtgggtggggcaggaggaacagggatccctactccctcgagggaccctgttggcagctctccccctctccagctctcagtttccccacttgaagaatgacgtcactgcctttcaccaacacctttgtgagtcattgccccaccctgagctaacatgattcacttgctaccttgtaataagggaattgtaacaataaatacaatgaactcaaaacagtcttgcaaaaactgaacgaggtacaggctgttgacctgccctccctgtctgagagatactggcaagtctagggaggtgtggaaaccaaacagcacccaggtgagcctttctcctcgttgtgttcagaactgaaaggaccagggactcaccctgctactggggtttcagggaccaggtgtcacttgaagttcagcctgggcaccaccaaaagggcgtcccacactactggctgtgtgtggcccaccctgcaggaacccccaaacaagacccctccaaggcctctccaggtcagctctcctcggattccctgaagtcatcccaggatcagctggtgccccccatctccctgggacaattggaatcttgacctaaggcagtggctgctagggatgccccccagttttatctagcttcaaggaccctcgatttctcaggcagccccagccctgcccaggctcgagtccccacacggaggcagggtggcagcactgacctgcgtaccaggcacgggaatcgcactcctcggccttgcccagccaccgctggttccaggagtgcgcaaagtcgatgagcagcaccagctggatgaggatgaagaggaaggagcccacgacgccgaagtagaaccagactgggtggggagaggggagtgaggcgaggagggtccctctctcacatctactcgttcaacaagcgttttctgctacaccctgcaccggggacactgagaagaacagagtccctgccctcagggagcccctagctacgcacagagggcaggatatgggtcggggcaagacagctccccctacccctgggttgcacaaaggccgtgtggccaagcaccacagtgctgtctcacgggtggggagcgaggacctagccagcagccaggggtctgtgtgccccagcaaagagcagccccaccacgttcctccaacctgccgccccacttccctccccacagccccccatgcctcctgccaagtccgcctactgttggtgaaggagccgtcaggaatgtagaaggcacccacggtgaggcccaccaggatcaggaacttaaagaaccaaaacctacagaaggggtcggggaatggacaaggaagctgagtgcaggcagggaaactggaagccagactgggcctggccccagagcccccacccacaaacagcaggtgctgagaggggtgagggtgggctttctggtggtctgataggcacagaaagtctctcctggccctggaaaaaaccctaaggggcaggaggaaggaccaagcagtggtgagggtggtcacccaggtccagccccagctgtgtcactgaagtgctgcggggcctgaggcttgctgccaccctttctgagccttactcttcatctgagaaatggatataactcagagctgttctccatgctgtgccctcccgtggctcctgagtggtgggtagggtctgcagatccctggacaggcagaggagcgggcaaggcactgggggaaggtcccagggtgcaggcagggacccctctctcacccattctggatggcagcccgggggtcccggctgctgctcacgcagagcatgagcagggtgaaaaagaagaagaaggccgccgtggcgaagcacatgcggtagacagcgcggtagccaagcagggagccacagtcgatgtggccctgcaggacggtggggatcccggccccctcctcacacacccagggcagctgtggagacagacagagcagcgtcaaagccccacccctcacagaaccctggcagctccctttataaaccagagccctggtctcccaaggccggccaggaaagaggctctcccagcaggggctggaccagacagggaggggagcccctcacctctatctccactgcctccgcctccattcctagccctctctgggcctgaagccctgggagggagctccccagttacatcttgttattgtttatttcccacagcctcagaaactattgcgctgtctaaagcagtggttcccaaagtgttctccacccaccacctacatcagaaccatctgagatgcttgggaaaacagagattctgtggcccctctcccatggaatagagcctcaaggtggagtctgagaatctgcatttctacaaactccccagggaatctcatctttatacacactaaaatgtgtataaggcacctacggtgatgcccacgtccccctgggtctgtgctaggctgtaaaacactgagatgaagggaagagttaggagccccaacctgggcttaagcactaagagggagaagagcatcccctaggccagtgtccagggggcgataatgattaataagattttccaaggagactgtggcctaagagaaagaagaatccccccaagaggctcaagccctcctcccctcatttccaacctcagatcatcagtgcacccaaacaccctgcctcctcttctggataagctgtgaccccaagcctgggccctctatcctggagccactgacgcccctcgctggaggccgccctgcctcccctggggcactcaccttgtagagctgactctccacgcccgggctcagcataatgatggacaccagcacccccaggaagaggaagaacgtgaagatgaggcggctcacggtggagttgcggctggcggggcagcagctgcacaggatgcagggggcagagccgcagaggcaggacgcctgcgggagggcactgtcactcttccctctccccttcaccgcccaagcgcgcacctctcaccacctgcccagaggtcggcgcatctgtgctgcgctaggcaggagcacactgttccccagacaccagcccattgaactttcaggtccgagagggaggctgggtcatatagggctacacagccagtaaccacagaacccagattcaaacctgggtctatctccagtgatactgtggcttgaaagcgagagctagccgaggtcacgctgtttctttcttacagggagggagagtagtttaaaaaaaaaaatcacaaggccagctgtcaccgattaccttcgtgaccttatacaactcactcaacctctctgtgcctcagtgtcctcttctgtaacatagtggtatgtactcctcacaaagcagttgtgagagtgaaacagaaattccacattgtagcccccttgggctccctttccccttccccacttaatttttccccgcgggacttctgccatcagcgaggctttatgttttgtcggcctccgctttccagcggggcaggaatttttgcgttttgttcattgtggtattcctagaaattcgaacagtgcctgtcacacagcaggagcttacaggctatctgttgaaggaatatgaagtgtttggcatagtaccagtcacatgttaagacctcagaaaacagcaagtgcagaataaacaccagttggataaacggaatgattttcggctctgaggctataccagcactagacagcaggtggcggt

SEQ ID NO: 12224 - DNA, 12870 bp, Homo sapiens
  misc_feature (1)...(12870): n = A,T,C or G, or insertion/deletion polymorphism (see Tables 1-2)
cagttggaatatctcccacttcatttcttattgaggttatttggattttctctcttcttttcttggttaatcttgttaatggtctatcaattttatttatcttttcaaggaaccagcttcttgtttcatttaccttttgtatttttttcatttcaatttcatttagttcttctctgatcttggttatttcctttcttctgctggatttgcgtttggtttgttcttgtttctctagttccttgaagtgtgactttagaatgtcagtttgtgctctttcagtctttttgatgtaggcatttagggctatgaacttttctcttagcactgcctttgctgtatcccagaggttttaataggttgtgtcattattgttgttatgttaaaagaatttttaaatttcaatcttgcttttgtttttgacccagtgatcattcaggagtagtttatttaatttcaatgtatttgcatggttttgaaggtttctttaggagatgatttccagttttattccactgtggtctgagagagtgcttaatataatttcaattttcttaaatttattgaggctccttttgtggcctatcatacggtctatcttggagaaagttccatgcaccgttgaataggatgtgtattctcgggttgttggatggaatattctgtatatatctgttaagtccatttgttccaaggtatagtttaaattcattgtttctttattgactttctgtcatgatgacctatatagtgctgtcagtggagtattgaagtcctctactattattgtgttggtgtctatctcatctcttaagtctattagtaattgttttataaatttgggagccccagtgttagctgcatatatgtttagaattgtgatattttcctgttggataaggctttttaccattatataatgtctctgtctttttaaactgctgttgttttaaagtttgttttgtctgatataagaatagctacccccactcacttttggtgtccatttgcatgaaatgcccttttccacccttttactttaagtttatatgaatccttatgtgttaggtgagtctcttgaaggcagcagataattagtcggtgaattcttatccattctgcagttctgtatcttttaagtggagcatttaggtcttttacattcaatgttagtattgagatgtgaggtacaattccattcatcatgctatttgttgcctgtgtaccttgatgttttttgttgttgttgttgttttataggtcctatgagatttatgctttaaagaggttttgttttcatgtgtttccagcatttgtttcaagatttaaagcccctttgagcagttcttgtagtggtggcttggtagtgatgaactctctcagcatttgtttgtctgaaaaagactgtatctttccttctatatggagcttagttttgctggatacaaaattcttggctgataattgttttgtttgaggaggctgaagatagggcctcaatcccttctagcttatagggcttctgctgagaaatctgctgctaatctgataggttttcctttataggttacctggtgcttttgtctcacagctgttaggattttttcctttgtcttaattttagataacctgatgacaatgtgcctaggtgattatctttttgcaatgaacttcccaggtgttctttgcacttcttgtatttggatgtctaggtctctagcaaggctggggaagttttccttgattattcccccaaatatgttttccaaatttttagatttctcttcttcttcaggaacaccgactattcttaggtttggtcatttaacataatcccagacttcttgaaggctttgttcatgttttcttgttcttttttctttgtctttgttggactgggttaatttgaagaccttgtctttgagctctgaatttctttcttctacttgttcaattatattgctgagactttccagagcattttgcatttctctaagtgtgtccaatgtttcctgaagtttttattgttttttctttatgctatctattttcttgaatatttctctcttctcttctttatcgttttttggatttccttgcatggggcttcacctttctctggtgcctccctgattagcttaataaacctgctgaatactttttcaggtaaatcagggatttcttcttggttaggattcattgctggtgagctagtgtgacttttggtgggtgtttaagagccttgttttatcatattaccagggttgcttttctggctccttctcatttgggtaggctctgtcaaagtgaaggtctagggctagaggcagttgttcagattcttttgtccgatggggtgttcctttgatgtagtactctccccgcttccctatggatgtggcttcctgagagccgagctgtagtgattgtcatctctcttctgggtctagccacccagcaagtctaccaggctctgtggtaatactgggggttgtcttcacagagtcctgtgatgtgaaccatctatggttctctcagctgtggataccagctcctgttccagtggaggtggcagggtggtgaaatggactctatgagggttcttagcttttgtggtttagtgctctatttttttgctggctggccttctgctgggaggtggtgctttccagagagcatctgctgtggcagtatgaagaggaactggtggtggatggggccctagaactctcaaaagtatatgtcctttgtcttcagctatcaaggtgggtagggaaggaccaccaggtgcgggcagggctagggatgtctgagctcagactcccttgggtgggtcttgctgcggcttctgtgggggatgggagtgaggttcccaggtcaatggagttatgttcctaggaggattatggctgcctccgctgagtcacacaggttgtcagggaagcgggggaaagctggcagtcacaagcctcacccagctcccacacaatccaaagggccagtctcactcccactatgcccccgctaatagcaccgagtctgtttccaggcagtgggtaagcagggctgagaacttgccccaggctacctgcctcccagctgcaaaagaaaagggctttagttcttcccacacctgtggagtctgcacacaggattcacatcctcccccaagttctaatcaggaggcttctcaactagttcaaattgttacaaagttcatctggagactttcttctctctgtggcattttccctgcacctctggccaccctctcaaacgagccctgtgatgccaggcaggaatggcctgcttagggactcagcaagctcccagggcctttcccactgcttcctctacccctgtatttcacttggctttctaaattgactcagctccaggtaaggtcgaaatcttctcccaaaaactagaccttcagtttccctggtggcggtgtgtgttcaggggcggaggatctccctttcccacttccgcagtttgggtactcacagtatttggggtgtctcccaggtcttgcaggagcagttcacttccttcagagggcctgtgggtcctcacaggattcctgacttattcctgcagtcgttctggagctaaaactcaccatgcaagcctccacatgctgctctgtccatcagagtcagagctgcaatctagtcctgcctcctcagggatggaacttgattgattaggcatatgacaggtacagaatgaaaaagaatataaacatttacaaattcagttaaaattctaatataattacattgtataagcttataagtgagactgtttaagagtttagatagttctacctgagttacttgaacaattataaaagatccccttaaactgaattattttatataagttcagtttataagtatactattctatctgtaaatccatataatagatatatataatagacttacagatagaatagtatacttatgaactgaattttaagacataaataaacctaggtattgagttttaaattaataaattaaatattaacttaaaacctaagctcttgtaagtagtcttttattttgtgctcacagaatctgccctcagacatgaaaaaaaaatgacatgacactattgttatctgcatttaacagacgaataaactaacacttagaaaggttaagaagccagaatcagctccatgaatgtctggctctaaaacctgtgtccccactgaacatatggcttccttgactgaccaaccccctaaagagccaggtgacttgggaacaattaaatttttcgaagtaactttactaaggtctgattatatgtattatagattgattttatagataagcagtcaatttcagcttaaggaaagataattttttggctcacgtagctgaaaagtccggcctcagacgtggtagctacagactgtgttggctccattcagagacaggctttctttccctttgtggtacaagaccactggagctatccctctgggctaaagtatagctaaaacatggactgcctctcttctaattgttctcacaaaagaatcattgcatctcactgaagagtaggtcatgggtccattctggaactaatcactgtgaccaggggaaggtgatgctttaatggtcatgcctggggtcagaagttgacccttggagttcggggtggaattaactataccataaacatatggactgagagtagggaaggaacaatcttccttgaaaagggtgattggatggcaggcagccaaaatagatgtccagtatagtaggcaaccttacctctctcacttcaaagttctttgtattacctcactctatcattcatatttactgctgacatttactctttcttttggccaagaatcatgatactacactataacttaattgtgtgtcctttatttctcctgtgactgcatgttgaaggcaagggatatctgtcttgcttttcttcagcgacctacgtaaatgcttgtctaaatgaataaaacctagattacaggatactgggtttgttacttaagagaagaaatgttggaaaagtgttttcagggttttgtaggtggtagctctgtagtgtaaggaggaaaagtcaaattcactaaacgcttattgataacttctttgtgttgggctgatctctcttgcggacagtgttccagtggccctcaaagagcaaccagtctaagccaggtgtggtgacttgcacctgtagtcccagttactcgggaggctgaggtgggaggactgattgagcctgggaggctgacgctgcagtgagccatgattgtgccatgcactccggcctgggtgacagagcaagaccctgtcttaaaaacaaacaaaaaacaacgagcaactagtctagaggaagagactggatgaagggtattggttactgtgatttggttttggcctagatctaggttattatggattgcctagagccttggtaatagattgagtactggagaaggtttgggttaccatatatgacgttggttgggttaaagattcttatttttcatttattgagcatccatgtcaaattcttgacacttagagcctggggcatgggaataagcaggtcagaagactcccaggataggcccaggtcttgactcagggttatacccattactctgctaacagtgtgaggaacctacctaaaaatagagattgagatactcaccaaagcacagacataggggcagactgggataaagcacagacccatgctgccaggcacccagtgaaacagtgcattttcccaaagacagcatgactcctgaggtggaagcattactgcccagtttcagagggaagctgtgaggggtgtctgggcttgagactcagtttagtagaattgctcatactttttacttgggctgtgcagaggaaagacatctataaaaaattgcactcatttggagaacctgactgtggtcattttgaagccaaggcttgcttagaaagtgtggaaattaataaagtaaaggaaattgataaagatctgcacaggggtttcctctgcccaatcctcccaccttccccttcaaacttaaactcgagcctgctgctctccggcctagcattgctcttgccatggctgtcagtgatgctgacatgcgaaagcagataaagcatatgatggctttcattgaataagaagccaatgagaaagcagaagaaatagatgcaaaggcaraagaagagttcaacatagagaaaggtcagcttgtggaaacccaaagactaaagattatggaatatcatgagaagaaagagaaacagattgagtagcagaagaaaattcagatatccaatttgatgaatcaagcaaggctcaaagtcctcagagcgagagatgaccttatcacagacctactaaatgaagcaaaacagagactcagcaaggtggtaaaagatacaaccaggtaccaagtgctgctagatggactggttctccagggtttgtaccagttgctggagcaccgaatgattgttygttgcaggaaacaagaccttcctctggtaaaggctgcggtgcaaaaggcaatccctatgtacaaaattgccaccaaaaacaatgttgatgtccaaatcgaccaggagtcctacctgcctgaggacatagctggtggagttgagatctataatggtaatcataaaataaaggtttcyaaaaccccagaaagccagctggatctcatagcccagcagatgatgctagaagtccagggagccttctttggtgcaaaagccaacaggaaatttttggactaagccttcaggaggtagagcacgttctcagctctcctgctatgatgtggaagattctgatatttgaagaaacgcgaatgtttctgtagcttcctctttactgccccaatattgctttgcatttatcagtgatgcccctctgacactaacgccttgcctaattattcacaatggtgggaagcttcatgtaatatgatcaggacccacctccagttcatctgaaagtaacacagcatccagttggttctgcagcactaggggagggggcagaggtggttgcatgggcttcctgggtctcggctttccatctggcctagaggtgatgtgtttggtgttcctagccctgcagtccccactcttgaggcttaaggcgcatgtggcacaccactccttccagcagtagtcgcttcactgttacctgtttaggcctagaagttttctctcatctgtaaatgtgatttaaaatctaagccatgaatatgctttatttattaaaagagctatgtggatttttaaacaatgtggaaattatgttcatgttgtactgtcatcaaagataaaaatgttttaaaaaaagaaaacaagtataatttaaaaaaatttttaaaaatgaaaggagcagagccagaagaggagccatgcagactccaggaaagaacagctcatgttgcctttccctcctacctccctggagggaggagctagcaagggaagatagccactgtgacactcctttctcagcatatgtgggtctgaagtaaaggtggaggtggacttctgggagtgaagagggaatagcctaccctcctggccaaacacaaaccctgatgctattacatctgggctcaggacagctgtccatttctcaccacttcgattagggttttcaagagaaacataatgaacctctattagggtttggcaacagaaacagaacaaatagataatatatttgttnnnnnnnnnnnnnnnnnnnnttaatatacacaaatcagtagctcttctatacaccaacagcaaccaagcagagaaccaaatcaagacctcaaccccttttacaatagctccccctaatagaggttcattatggaaattggctcacatgattgcagaggccaagaagtcccacattatgctctctgcaagctaaagaactagaaaagcaagtggtgcaattcagtccaaattcaacggcctgagaatgagggtagctgatggtattactaccagtccaagggtgaaggcctgagaactggaagaaggtggggagtggtgcagggaactgctggtgtaagtcctggagtgtgaaggcctgagaatcaggaactctgatgttcaagggcaaaagaagatggatgtcatacctcaagaagggaaagagaaaactttcttcctcttttttttttttttttttgagacagagtctcactctgttgcccaggctggagtgcggtgatgcagtttcggctcactgcaacctccacctcccaggctgaagcgattctcctgcctcagcctcctgagtagttgggattactggcgcctgccaccatgcttagattttttttgtattttcagtagagacagggtttcaccagttggccaggcttatctcaaactcctgacctcatgatctgcccacctcggcctcccaaagcactaggattacaggcgtgagccactgcgcccggccaccttttggttttactcaggtggacccttaatggattacatgataactgctcacactagtgtcagtggatcttttttactcagtctgctgattcaaatgcgaatctcctctgggaacaccagcatagactcacacagaaataatgtttgactagctatctgggcatcccttaacccaatcaagttgacatataaaattaaccatcacaagtctgccccttgtgaacttggcatccatatgtatctccttaaaccatagttaatctccaaataatgacaataacaaggtcataattccacttaacatgatacaactatcctgcatacaacaaaaaatgcagtaatcccttttccagaagaggaggtaaagtctgtgagtgacgtgtagtcttctgatatcccatacttaaaatactaagatgtctttaaagtattaacaatactagtacttagaatactagtataaagtcaatacatcttatgttacacgataagggataagaaaggaaaggaaacaaagatatttgtttaatatatgtgtacatacacacattatttaaaaaaaatagggatgaaatattcatgacaattacagtcttcttttctgtaactgatgacatggctgcagctcatacttacaactaccatcttcaactacccatcctgtattccctttgccttcagcaagaacctcagctggttatgcttcttaacctagaaggccaaggttggtttgagggtggaggggaggtaaaccaaaccttcattcctaaaggtctgggccattcatagtcttgcctggtttgggttgtagttttccattgactttaaccacagggcatggtaatactgagacaccctaagagatctcctgtgttccagacatattcttttttacctcttttatgtcagatttccccatggtagtctggatcaattaccccagccaacaccataactcccctattggcctgttgactcagaggcataaggagcccaaagtggttggatggcagtcttaacttctagttcaatggaatttagttcaactgtgtcttctggtggaagcagtcctccctctggatccagcagagcatacctttgtagaaacaggaagcaaaatttttgttagtaggtcactagggaatcagtgtgtggtgcccttcccatttctaccccttcattcctagacctataaatcctgactatgggagaaacagtactgtatgttggacattgattcagaacacatacagccttctggagaacctttgcttctgccttgcaaagtattgtcacttagctggttctgtaagtgagtcttcaaaaggccattccactattctatcaagccagctgcttcaggttgtggggaacacgacaagaccaatgaattccatgaacatgggcccactgttgcacttctttggctgtgaggtgagtttcctggacagaaacaatgctgcatagaatgccacaatggtggataaggcaagatgtaagtccctgaatggtagctgacagaagcattgcatgcagggaaggcaaatctgtatccagagtaaatgtctattccagtaaggacaaaatgttgctcctttcataatggaaatggtccattataatcaacctgccaccaggtagctggctgatcatcctggggaatggtcctatatcgggggctcagtgttggtctctgctcttgacagattgagcactcagaagtggctatcggcaggctgaccttggtgagtggaggtccatgctgctaagcctacacataacctccctccctgtcactatagccactttgttcatgagcccattgggtattgacatgggtggctggggaaagaggctgactgatatccacaaaatggatcaccttcttcactcagttattaagatccttctctgctgaggtcatcctttggtgatcattcatatggaacacaaatatcttcatgtcttttgcccaatcagagcagtctttccatatacttcttccccaaatttctttgtcaccaatattccaaccatgttccttcccagtccctggccatccagccaaaccattggctatagcccacgaatcaatatattatcgcacatctggccatttctgcttccaagcaaagtgtagaaccaagtacactgcctgtcgttctaacactgggaagattccctttcagcactgtccttcaaggatgtcccagagaggggctgtagtgctgtacctgtccactttcaagtggtgcctgcatattgtacagaacattctttaaaccaggcccaaaccttctctttctctgtcaactgatcatagggaactccccatgagcccataggtacagtttgagagagagtaagaaagcagtgtagtaagagtgaccatgggcatttgggccacttattcatgtaacttactagtgcctttagggattgctctggacttactgcatatataacacttctatttgatgacggggagctgctatgcacacccaactttatggcttggtgagtcggataacacctcatccatgatgggcagctcaggtaacatggtaacttggtggcctatggtcaggtgtttagtttctactaaggcacagtagcaggctaagagctgtctctcaaaagaatagcactgtgtaatgtttcagtcaatgatggaccgcatatactgctgtggctccataaaaccataaaactgtattttgtactgtacttttctatgtttagatacatgaatacttaccattgtgttgcagttgcctacagtatttagtacagtaacatgcggtacaggtttatagcctaggtgcaatagtctaattgtagagtaggctataatatctaggtttgtgtaagtaaactctatgatatttgcacaatggcaaaatcgcctaacaacatgtttctcagaacatatccctgtcattaagcaactcatgactgtagttatctgccaataatggagggccttgctccaaaatcccaaaggcctgcactgtgattcgtctatgcacgcctgctaaataggctcccaatggcatccctatctgccatagactcaccaagcaccataggatctgctggatcatatgggccaagtggcagagcagttcgcacagcaggctgaacctattgtagagtcttcttttgttctgggcctcatttaaaactagcaactttttgggtggctttgtaaatggaccattttggaggcaaaatccaaaattcaaagaggcccacgaggtattgtgcctctttcttggttgtaggaggggccaaatgctataacttattttttaccttagaaggaatatgtcccacaccaccagccctctagaaattccactgcgtagaaggctcctgaattttagtggcatttatttcccaccctctgacatgcaaatgtcttaccactaagtctcaagtatacttgttgctcactaggtccaattagcataatgtcatctatgtaatggaagagtgcgatatcttgtagaatgaaaaaatgatcaagatccctgaaaactaaattatggcaggactgcgagttgatgtacccctgaggtaggatggtgaaggtatatttctgatcttccagccagaagaaaatagtttctggtaggctttatagacaggggtggcaaaaggcatttcccagatcaatagatgcataccaggtaccagaggatgtgttcatttgttcaagcaatgaaaccacatcaagtatagcaggtgcagttggagtcaccagttgggtaagcttatgataatccactctaattctgtaagatcatttgtcttctgcacaggccaattaggagagttgaatgagatgtagtgagaatcaccacccctgtatctggtgtcactaatctctgcaatgaaaggaatgcagttattgcttctgttttactgttttcctaggtggtggcagttctagtggcttctagtggccttttccatggtaatatccctcatttcattgtcagggaaccaatgtggaggttctactaactgctaagtatatctgttccttatgcatcctgaaactggggaaataactacaggatgggtttggggacccactgggccccctgagagatggaactgaactaaaattccattaatcacctggcccccataatcccctactctgattggagtgccacagtgacattttgagtctcctggaatcaaggtcagttcagagtcagtgtccagtagtctctgaaaggtctgatgattttattttccccaatgcagagttactgtgattaaagactataggtccctttgaggaaggttgagggaaagatgaacagcataaatttttggtagtgcaccaagatccttcctccagggg

SEQ ID NO: 12225 - DNA, 12581 bp, Homo sapiens
gggagatgagcttgctgagtttcaaggaacagaaggaagcctgagtggctggagtagagtgggcaaggcagagtccccaggggcggtgctggaggggccccggggtcatttgtcatcaccctgtctgactctaggctctgccaaggcccccttcctggcatgccagccgattgcccccagaaacagggcctccatttccttttgcctcccccagtacttcatccgaggctttgcaccagggcccctggaagccccaggcccatgggtgggcaggagccttctggccttctccagacgtcccagccctgactttgccttgaccacaatgtgcagtgggcccagggccaggccagggctgggggaggccggtttccctcttgctttcatctgcaggcaagatctctttcatcgtatctgttgtttttaggccatgtgttgggctgtggacagtgaatgagagctcaggaacacacgcctataaatctgcatggaatgaaagaaaggtccaagcatcagggcgcctgacgccccacgggccctcccccttcccccgtccatctgaggactccttggggtctgatgtcaggggacaagctaagaaaactaaggaacaggggtgggtggcagacagatgagacctggaagggagcccagaaatatcaaacccagcacaagacgggtgggggactcgctcagcacattcggccagagccagaacagaaccagggtctctgacgccgtcccatgaaggacctgagcacctactggatgctgggccctggaaggaaatgaacaatcactgtgagaaatgccccgatgtgggatggccacctgactgagcagagccaggaactctgggccagttgggtgaccttgggcaagtcgaaacctccctgagcttttcgtctttcttctctgcaaaatgtttctgccagtgatgttgggaggttctaaaatcacatgaagccacctatgttgaggggctcttggagctgctgtatctgtgcaagcctctgaatcctgtttttaaatcatttgttatttttttaaccagttaggcatggggcttcatccttgtaagtacatcccatttctgtccagcctgagttaaaggtggaggactgggaaacagactaactcacatgaaacatagagcaaacagttcagcattaatcctgcatctgatatctcctcctatgcctccacagatgggcagcttactaccaaacaaggctgccgttttccatggtgaaatagcactaatgggttataaagcgccttctacaccaaggtgcagtcagctcttgctcctgacgccactagacctacaataagcctggttactcacccattttcatggtgatccttctagaatcctctggccttgagtatgcttccctgccagctcccagaacccaggctgactctagtttctgaagcctttctcatctctcttgagttttctacaatgagcatgtgctgctttttctatttttcaaatagattatattatttgtgataaccaatcaatacagaatgcaagaagaggaagtgaaagtctccctatttttctctctccaaacctggctccatgcaaggcccagcggcaccttcctcccggcttctctctccctttggttatgtattgtttggaagcacagattagcactgagaatgcagcaggcagcacaggggagaggttgagagcacaggtgctggagcctgcctgtggccagggcttgaatccctcccctgaacctcagtctgctcatctgtaaaatggggtcattagggtacctgccgcacagggtcattaggaggatcgagtgagtccatgcacgcaaagtgctcagaccagtgctgggcgcacatgagccattataggcgttttgctttgtttgtttaattaaaaacgaatggcaccacacgtacatttcattctgtagattacatgttcatcatggacagctctccgtgggagctcaggtaggcctatctcatcttgccaacagctgtagagctgttctgtgaccacactcatgctttatccacgttaagatcaggaaaagtcacttttaagaaaggacccaaggtggggcccttaagcagccttctgccactcttggtatcatttagtcccaaggaaatcctttggttctctcctcggtggcccatggcggccctgagccggccaagccagctccaggaagtgggaaccaggccctgaacaagaagacagctgggcccaaagagggtttgtccccagggagaggttgggtacagatgagaagcgaccaggctcctcccggtgtggccagaacccctcagagaggatcatgtgggcagggctagtcacagaaggcttcctggaggaggcagggtctgagtggggtcttgaagagtaagagagagctgaacagacagaagtgggttgggggagaggcactcgtggcaaagacaaggctgtttgggctggtgaggagttaggatgtctagagccaaagggccacataagggaaaagggagagtaccttgaacaccaggatgcatgtgggtttgccctgccagcagtggggagccacagaaagttctggatgataacaaataataacactctgtgtgaccctgagaaggctcgaagcctccccaggcctcagctgcctgtgggtgctggaatagacccgagggaggcagaggggactacttaggggcaggaatttgggatcaggccctgcttcctctaatcaaggggacccagaagtgtgagggcagtcccagaggtcagtccctgccttcagatccccactccacagaattcaacgtttcctttccttttaacctgccggctttccagggaaatctgattttgcgagcatgttttcttagccaggggaaatgagcaccatgcaaacaacgaagacggctgcgtgtgataaggggctgggctgctccagtgtggcctggaggggaaagagggactggtcactgctggctgccttaggtggagagaagacatcaggcctcagaatgtctgagctggagggggccttgggaagtgtctagccacagatgtgaaagtagaggcccagacagggaaggggcttgcccagccagcatggagggcctgagtctgctgtggctcatgccccacactccagctggaggggctgcggtgggactccctttctctctgtagcaggctgggccagttgaacccatgctgggattcagagtctggctgatggtggccctgctgggtcctctctggtgaagattcacagagggagggaggagctgggcacttgaggtcaagaatgagggagatgagcgtgacagggggaaaagggggaaaaggtatgtcctccaccttggttttgagtcttgttgagaaaaggacagggaaagatgcggcccaagtcattgtcatggagaccatgcaagacccagggccctggaagggctgccttagggcccaggtgacagtttgcaaactggagttggcctaagcccactgcttgaccacctccatggtgatgtggcaaacatggcacctccatggccatgacaaacgtggcacctggaagctcagggtgaccagggtggagggtggccacacctggtgcagcgtttttgcaggcgcgcctgtggccaatgcagtcaccaggcatctcaccaagaagtggagaaaactcccggctggggtttggacaccacttggggaggcgccgggagtaactggccttctggctggggctggggaggggtgtttggaggggatgaggtctaagaaacttcttcatctggatattaacataagtgtgacctgggtacctacaggctggtgaggcctgggcacagcagaattccagtgagttgccatcctcctgcattcagcagcagggccagaagctccaggtctgctggggggcccctccactcaggaagaacacacctcctttgccccctggaactgtgttgggagttttcacaacctgagggggttggtgttggttccatttttgagataaggaaactgaatctcctaggctactgtgcaagtgacctcacgtgtgactttcctttcttctcaacaaggttgtgctttctctagaagctgttcatggtggaatttctaatgttgcaacagactaacagcagaggacgttgctgggctatttgggctcctgggggcacccacagcttcagctgagcaccagtaaagagtaccagcttcctttgcagccccccattctacccccatcagtgactgtgggaaccacggatgtggggtgttttcctacatgatttcatcttcctgaggaccattctacacagaatgggctgcccccagggaggcccagtcacttcccatccccgctattcttgggcagtaagatgccaaagtcagttcagtcaacatctcgcacacaagactggtacaaccgtgacattctgacctgacttaaccccggacagtgaaccaggcactttcctcttccaggccattattctttctaatcccctttgggcaacctctctgagcctcagttttccctgctgtaaaatggggattcatagagacaacacctcataggcctgttatctttctccaaggcctgactttgtcactgaacaaactcagagacagaggttcagctgggtgcggtggctcacacttataatcccagcactttgggaggctgaggcaagtggatcatttgaggtcaggagttcaagaccagcctggccaacatggcaagaccccatctctactaaaaatacaaaaaattagctgggtgtggtggtgggcacctgtagtcgcagctactcaggaggctgaagcaggagaatggcatgaacccgggaggcggaggttgcagtgagccaagatcgtgtcactgcactccagcctgggtaacagagcaagactcggtctcaaagaaaaaaaaaaaaaagatatggagattcacttgcttcttatcctgcgagctcccacccaagtaccctgtgggcttcccatccaagccagggccaccagcaacccacaagagaccatgcagctctccggacccggatcctgatacctttacttacccaattacttaccatgacctcagaaaagtcccgtagcctctaagtgcctcagtttccacatgtgtagaatggggacagtaacagtacccacctcataggatgaaatgaaactcagcccagggcctagttctcaattgctacataatacatggcaaacttgagtgcaactgggaagcacagtgagtatggggaatggaaagtgtttcatccccggggaggccacatcaatctcactttattagatcataagtgcttttaacaaggcaaacagcagaaggccagcagcccgccagccagagccaagaactgaaatccagttctccaagaccccggacatcaaaacaacaatgcaaaaggctgaacatcaaagaatgaacagcaagtccaaacatttcactgtgctcttatcttaattaaagcaagtcatactcagagttttggatgacacaagttgaaaagcggggtctggttttattagcttttgctgacacccacagagaagtctgtgacttacccaaggtcacccagcaccctggggccagagttggggtccaaaaccaggcctcagctgctggagccggcgcgcctttcataacctccctgcccccaccctaacctgagctacagggacccagggttgtcatttcaggggagaggtctccgttcattcatccagctatatattgaatcatgtttattgaaggtcttctgctttctaggcactgttctaggctctggggatacagcaatgaacaagacaatctaaacggttggggaaagcagacatcagtaaataattacgtagataatcatagtcacacgttacataatgacgttttggtcaacactgcaccgcatatatgaccatggtcccataagatgataatggtgcattcgctttgcagacactgccaccgccgggagccccgtactatcagccatggtcaaccccactgtgttcattgatggtgagtccttgggccacgtctccttcaagctgtctgcagacaagtttccaaagacagcagaaaactttcgtgctatgagcactggagagaaaggatttggttataagggttcctgctttcacagaattattccagggtttatgtgtcggggtggtgacttcacgcaccataatggcactggtggcaagtccgtccaccaggagaaatttgatgatgagaacttcatcctaaaacatacaggtcctggcatcttgtccacggcaaatgctggacccaacacaaattgttcctggtttttcatctccattgmgaagactgagagtttggatggccagcacgtggtctttggcaatatgaaagaaggcatgaatgttgtggaggccatggagccctttgggttcaggaatggcaagaccagcaagaagatcaccattgctgactgtggacaactccaacaaatttgacttgtgttttatcttaaacaccagaccattccttctgtagctcaggagagcaccccaccaccccttttgctctccatattctagaatctttgtgctctggctcagttccctttgagttccatgttttccttcttcccttctatacttagctggattgcagagttaagtttatggttatgaaattaaaactaaataacaaaaaaagattataatggtgctaaaaaattcctatcacctagtgacgccctagcaatgcaactcatgaccttttccatatttagatacacaaatacttgccattgtgttacaattgcctacagtattctatacaataacatgcaataaaggtttgtagcctgggagcactaggctaagccatagagaccaggagtgtggtatggtgtaccatctaggtttgtgtaaatgcactctatggtgtttgcacaatgacaaaattgcctggggatatgcatttcttagaacgtatccccatcattacacgaggcacggctgtattttgttgcaattataaatgctatttcttatgtcccttctctctgaatctgggcttgactgacagatttcaatggaagtgtttgctgtaatgctttccaggcccaaagctactttcccttctcctgggatgctcacttctgaaacccagcagccatggtataaggaagcccaagccgccccgtggagagaaccaggtggggagaaagcagtcaagccagtcaccactgcagaggggaacccccaggccctgtcagccacccccagctgccgccacctacactatggggaggggagcgagatcagctggctctgcccagccctgcccaaattgcaaattcatgagcaaaacaaaggattgttgttttgaagccattcagttgcagagtggtttattatgtagcaatggacaactagagtgccaccttttaccctcgtggggtagcatagacccaattatgagccccattttatagacgaagaaactaaggttcagagaggtaaaatgacgggctcaaggtcagacgggtaacgagtggcaaggcaagattaaatgacgtcaacttctgtgttttttccacactacccctttactgtcagcgcaacagcatggcgacccggaggtttccattaatgccattctcactcaaaagcaggaaactccaaagggggattcttgggcatggcgaggtggcttggggagacagtggctgagcaggggagcttacagcagtcttagagtcctcccgagtgtaccaggtagatgggagtctgctcgttgttttgtaaggagaggccacggagaccttttgagatgagcaaacacaggctcgtttgtgtgttgaaggcctctgtttccccttttgtgaaagggggatgggaaaaccacccttgtcctgatctagccggtgctggagatgagcgggccccttgtcagctgctagcattccattttgaaagaagtgagtaatagcggagactcccacaatgagaatttttaatgcaagaaagtccgtggtaggcaagagggagagggcaaagcccgttcctgaaagctttgtaagcaaagcccctgccaaactgtgttgcttctgaggccagaagcagcatgaaagatccaaccggggagggaggcaggggctctgattctggtcccagctctgatcttgacctactgtgtgaccttgggcaagtcaccgtccctctttggtccttatatgtacaatgagaggatgggctggctgatctggaagatcctgacagtgtccaacaggcaggatggacaaacccgaagaaactgagaagcttctctaccctgcagccccaagagcttgcagaatttagcagtcagtgaggaatcaatcagtcccttaggctgttctagaggcagtgatgtaggtgagctcctccaggcaaattcttctccccctcctctccctcattccccattgtcatcattattatttatttgcctttcaaatgggccacccggagctctttataaagataaaaatagcataattcaaagcctccaccagcaacccaatcccatctggtgatggagggttgcaaacaatcgctttgttcctcccaactctgactccttcagggtcttataaaatgagagcacgcactttcaacatctaattgaagataatgaggatgatgcccatgctgagggtggtggctgtcatgtgccagcacgggctttgtgtcaacagggtgtatagcatggtctcatgtgatcttctcaataaccctacaatgtagtcaactatcattacttttttcttttctttttttctttggagacagggtcttgctctgtcactcaggctggagtgcagtggcatgatcatggctcactgcagcctcatcctcccaggctcaagtgatcctcccgaggagctgaaactgcaggcatgcaccatcacagctgggtaactctttagttttttgtggagagggggtctctgtttcttgtccaggctggtcccaaactcctgaactcagaggatccacccacttcagctcccaaagtgctgagattacaggcatgagctgccacatccgcatcccgttactacttttacacagatgaagaaattgaggcctacagagggaaagtaacttgtccaggattgcagaattagcgactgggattcagacccaagcatcctgactccagagcctcgattctgaattattaggctattttgcttcccagcagcatcagcaacaacaactactactattactattacccactactacttcactgagcacttattgtgtgctaggcatggagctcagggttttaattctgttctagcaaatccatgctgcagaacaaatcaatccaaagttgattagaacaataagttatacttttgtgttcatgcatcggtaatttggacagggctcagtggagactactcatctctgcctcagctgggatgattccaaatgcctggaagagctggggcctggctgggtacctccctctctctcttcctgcaggtcagggcctccacgtggcctcgccagcatggagttcccagggtcatcagtttcttttgttttttcttttttttttgagacagagtttcactcttgttgcccaggctggagtgcaatggcatgatcttggctcaccgcaacctctgcctcccaggctcaagtgcctcagcctcccgagtagctgggattacaggtgtgcaccaccatgcctagctaattttgcatttttagtagagatggggtttctccatgttggtcaggctggtttcaaactcccgacctcaggtgatccgcccgcctcagcccccaaagtgctgggattacaggtgtgagggtttatccgtttcttacatggtggctggcgtctcctagagactaacacagaagcagcaaggtccttctgccctggccttggagggcagcagcgtcactcctgctgcattctgttggctacagacgaacataacgtgggtccagatcccaggggcacgggaagtgaatccccccatctcagtaagaagcttgtcaaagcactgatggccaccttcaactcgccatgcttatgttctcatttaagaacttttacaatgatctatgggattcatttatccactcacatccattgagcacctaccgtgtgcccgacactgctgcaggtcctgggagagagcaatgaatgtgaatgtcattacactcactttacagatgaggcaatggagacttgcaggggtctcagggaccagccctttccctgtagaccctcacgagttctttacagtgagcccatgaggctggtactgcgacggccagccttgaagtggagaagcgggatccgcatgctggccaggcacttgctcagcaccccttccttgccttagtgagttccaagtctgcacttcactgtgacagggatgcatgggtcccactggacttggggggcatcctgcaggaggggccaggcttatggagaagaagcccgcggtgctgttcaaatgccagccctgatgcgagcgagggagggagggttgcctgagggcgggaagcggtgagggagccgggataatggcccagcctgaacctgtcgccacggcaaccgcaggggccgtctggagccagcagcctgccaggccttggccccacaaagcccgagagggaggcagagggggcggacctggcggggcataaatcagggagttctatgcccctgactccgggcagacgatttatgggactactccaagcccacgagatgcacaggggagagctgagagggtctccctgttcccaccgcccctggggcccctgcttggactcggatgcgtgtgcagggtgggcaggaagaggcccctccaggccaccctcagagctgctggaggcccctgcccccacccatcccataagacacctctgtgcccactgtaccagcatgcggcccccacgccaacagcaaaagtctcaagaaagagatacctctaaattcttgaaatgcatgctgatattttctatcttattctgttctattcctttttaaaaatgctggtcacaactcactaaattaatgtcatgactcattcatagtttgtgacctgcagttaggtcaacactgatccaaaggaagccagagggggaaactgaggctcaccgactccctcctctcacacacaactggagcagacttatatgcatcaatcagctcctccagtctccccacacacctggctctgcctcagggcccaagcttgttccccaccacccattgtagtcattcaagatggaaccagcttccttggaaggtaatgagctacccatctctgaagtcatccaaacaaaagttgaatgaccacctgccgggtgctccagggaatcccggcatcccttagagagaggccagactaatgcctctgagcctatacggggtgggaagcaggcaacgctgactactttgcccacatagcggctgagccatggacaggatgggagagaggctgcaggccagccaggcccactggagggggctcagagcttcaggctggctcagatagacaaggggcaaagatagcatcaagaaggtgagtgtccaaggatggtggctcacacctgcagtctacctcagtactttgggaggccgaggccagaggatcgtttgagcccaggagttcaaggctgcagtgagctatgattgcaccactgcactccagcctgggtgacagatgagaccctgtctcaaaaaaagaaggtgagtatgcctggtgggagcctggcagagacaacaggggccacttaagaggtcccagcacccagcccccttcctcctggcccctttgcattacccgcccagacctgcagggggctgtgccttccctggctgggcccctagtcctggaacaatgttcccagccccacaatcactgtttctgccctatctcctgcctctctcagctgtctacctccagaaacaagttcctcttaccaggaggtgccgagatgctaagaacggctgatgactgtgtttccgcacagcacagaggcctgctgctccagattcagacagacccggatcccaggcccagctctgccactcacctgtgtgtgatcttgagcaaaagccttgacctctcccagccattttagtcaataacatgaggccatcatatctaccttgtgatcattgataagggaagacatccagggtatattaagttaaaagggcaaatctgttcccatgtttgttaaaaacaaaaacaaaagcaaacccctttatttatatgttcgctatgcatgcaaaagcttggaaggaaatgccccaaacaggtggtagaagggtcatggagagggagaggtggatgattttcatttcctactctatacactctttgaatttttttttttttttttttgagacggagtcttgctccgtcatycaggctggtgtgcagtggcgtgatctcggcatcttggctcacgcaacctctgcctcccgagttcaagcaattcttctgcctcagcctcccgagtagctggg

SEQ ID NO: 12226 - DNA, 49324 bp, Homo sapiens
aagggagtgcttgaaaagttcagaagagagaagtgacaactgagggaagggacccaatgagactggtggaggttggggagattaacctggggcaaaaggaggaacatttcgcttcctgagccaggagaagaaagaaaacagtgtgtgtggagccctgtacctgtcaaggttaaccaggtcatactgtggcaacaatcccacaatctctgtrgcttacaacagaaaagatttatttctctttcatacccgtgtccggaaccagttggctctgacttgattccatgttgtccacatttcaggatttaagtgagaggattggctcatatctggaatactgcagtcttggtggcagaaggaaaagagagaatgccaaaccatgcacaagctcttaaagctgctgctgggaagggaaacacaccatctcggtacacatttcatggccgaagcaactcccacgatcatgtctgagttcacaagaacagggacatagagaggggctgtgaatatggagaacaacccagtagacaggggctttgactttgggcaaaaaatataatctactactgggccatcctgcttttgccggtgaaaaagttgctccttcattcactcaataaatattgagtaagcccctactttgcacctggtgctacacttttctcatagacctctaaataagacagacctttggtcttgtagatattacaatttagagaatttccacctgatggccttggtttttcttactggcataggggactacatcatctgccaagagaaagttgtttgaaggtaaggagtttgaggagagaggtaaatatttcaaatcaccactaaacaaaaagagaaggaaagctgaatgggggaaataaatggattgcctgtcagcattacatgtgtcactatggttggcaacctcatggctatgttccctgtcagtgctcagtctcctggatactctaagagcaaaaaaggtaaggatctgggggaccggagggctaggagacacaggagccagagatgatgttgacaatacgaagtaatacggtcgggctaggtaataagaaaggaaggaaagtcatgtgggcaaatgctgagcaagagacaaaggtcttgggagctaagattaggtgtattgggaggggagtgagtgacctagaaaggcaggacgaactgatcaagaaatgcattgctgcagttcaaggtttcacaggtggggcagttcttgatctagaagagtccagggtgtggaagctgggtggggactggtttatgattattcaggtcttaattgttcctgagacactgtccctgtagtcaagggttatgtccatgtgcagctttatattaattgactcgaatgctgagtttcctgggaataatgaattaactacctatcctgttgtgtctccccctccccaatccagaccccagtcatttcacacttgcttggaaaaaagagctgagaaaaagataacatttctttttaaagtcctccagtgcttctttgtatggtactgtctgtatactaggtgttcatacattcctcctgaattgagtcacattgagattgttcccttttctgcttcctactcaatagcaggatttttcagactccttttggcatctgaaaacattcagcaacttcaagaactgtccttccttggaggagggcaaaaatggtgctcatcccctatcaygtaaagcaacatggtaacaacacaaggtaagaatggaaacagaggaaacaaaatgggagaagaggggaaaatatttaaaatgattacaagaaaatcagtcttttttagttcagttttattaagatctaatttatatgctattcaccaactttaagcttagaattcagtgaattttgacaaatgtatacagtcgtataaccacatatatcattctcatcaccccaagaagtttcctcagacctgcttgcagtcattctgcttctcataatcccagtctctgacaaccactgatctgctctctttcattataactttgccctttccagaatttcaaataaatggaatcagacatatagcctttcatgttcagcttcctcaagaaaaccagtcttatatggaggatgtgaaaacagcatataggttagggaaaggtaagaaaaagaaatagtaaagttcaccagtctgagtgcccacctccttcagcttcatcctaagtaataatacccctcccacaaaaaatcaggttttatgtgctagttacatttttaaatactcattagaggccaaaggcagtggcttatgcctgtaatcctagcattttgggaggccaaggtgggcagatcacttgaggtcaagagttcaagaccagcctggccagcatggtgaaaccccttctctactaaaaatataaaagttagccaagcatagtggtacatgcctgtagtcccagctactcaagagactgaggcacgagaatcacttgaacctgagaagtagaggttgcagtgagctgagatcggaccacagcactccagcctgggtgatagagygagactccatctcaaaaaacaaacaaaacaaaactcatttaagataagtacataattattaaagacaaatttcatgtacatcaatgataagcagacctcacttaggaaaacactgatttcaaagctcttgacattcctatatacttcaaacggtcttattctctcagtcattgatatgggctagcaactcttaaatttgggccattagcaaaatttgtaagtaatgatgacattggaatccccacatgtggcatcataatgtgcatgtttaccttacttttaaaggtgaatttaaaccttttatttttgtttatctttatttcccattgaatttggttggaattagaaaaatgtatgcttgaatataatggaaaacaaaaacacaactaatagagacgggaaaatcgagacttgccatgcagcaaacatagattgcgatagacgtcctgtgtgaaatttgaagacagtttcaagtcagatagatgatcgactcagcattgccggttaggagagtgcagcacagtcagaccacaaagacaccatagaaagggcataattacattttgcaatggaatgtctgtggatagtctatatatgtgcactcattcttactgtgtgtggatgacagttgctctatcatttttgtacatttagacgaggactccatagtttcctgtgcctctctttgtgtgattgtacaggcttagccgactgagtcattacagagtgtaacactgataaatcattgaatctgtgaagaccgtgtctttctgtggatgaggcctttccctaggaaattaaaactctgggaggttcccaaagggccttggaagtttgaataagaaaaaaagtccaagtttaatttttaaaagctctctttttcacatttgtctttgtgacaactgttgctaattggcgagtctagaggagattataaagggagatggataagaccatcgtcaggggttgcaggtaggtgagttccatacctacttcaccagtgttttttactgaggtcaaatcaggtcagattggagtatctgaggcaactttgaaatataaaggtgcacccgaggctgtctgcaagggtgtgtggcaacaggagtggcacagatacactcactttgcctgaacaaatatatgagccctaggtctttcatagcactctgagggagggagacaaggagctgcatgcccaattggcagtgcctgattgctatttggtaggatggtataataatccagggctttgaatcaagtgagggggcccatttgagtctatgtgttattatttgtcatgttgttgtgacctatgaaaaacagtttctcaggtcctctacatgctacaacctccccgggctcaggcaatcctcccacgtcagtctcctttcagagaagctgggactacaggcacatgccaccacgtccagctaatttttgtattttttgtagagatgggttttcaccatgttgcccaggctggtctcaaaatcctgggctcaagtgatcagcccgcctcagcctcccaaagtgctgggattayaggtgtgagccaccacgtccaaccttaatgctagctgttaaactgtctttcaggggaggccattttaaaatgaaatcttggctctgttttcagtgataatttcatagttctaaaccccaattaattctgaattgctccagcttaagcatgtagttacatagagaatgtgcctatttctatctcaggcaaatggtgattgtcctattggtaacatgacttcattgtcattttttttctctggagactactgtgaggattcacattactaatacttgtgcaggcctcactccttaatttaacaagcaatgtcaatacaatattttttctttgcacagatataagacctttttattttaaaactgcaaattcaactcaaagattgcaagatcaaattttgcatcttaaaaaaatactaccataaacaaagcccacattataatcagaatcctactttcttttctgcataaagcagcatagaacaacggtcatttatagatacatgaattccaggaagctaaacaaataagaatttgtactataagtaaagtaggttatataaattttaaatgaaggaaaaaacaccaaattaaggacaaaaattatctttttccttctttgaattgcactccttgaaataatataaaaaaactcccaaaatcaaatattaaaaaataatttgtttaggccgggcgcggtggctcacgtctgtaatcccagcactttgggaggccgaggcgggaggatcacgaggtcaggagatcgagaccatcctggctaagacggtgaaaccccatctctactaaaaatacaaaaaattagccgggcgtggtggcgggcgcctgtagtcccagctgcttgggagactgaggcaggaggatggcgtgaaccagggaggcggagcttgcagtgagccgagatccagccactgcactccagcctgggcgacagagcgagactccgtctcaaaatagaaataataatttgtttaaatgcgtttacaaataattttccccggtaaaacacagggaagatcaaccaataaatacataagccctcttgtttcaaacctcgttgctgaaaataattgtaagtgtactagtatttactacattggtgagtgcctggtgataccttccacttccatgatctttgccctgtattgtatctacgtgtagatgaggtgattgtcaaaaatatatactgacttcaagacatagtgttgactgaggttgtctttattagaagtctcagccatgcctccagtttcgagatgaatctcaattcacaagttccactatgaatctcaattcacaagttccactaccaccaccaccatcactgcccccagatagaatgagacttctaataacttgaaagacaagtctataaatatcctgtaatcgttttcactgtatcactttttcctggctacttttatccgataaaaacctcaatttatttttaagctattaaacatgcggacaaagggaatcttagttttatgcaaaaacgcaaccacgcatgagaactgcgcaagtctttcttggaatggtctgtatttgggtgaagtcatcagacgtcattacacttctttattttggggttgccaactcgtttcccaggatttaaagactataacgatgataaaagtcagtgtcgcaccctgtcaaaggcttggcccgttgccttttccttcccggcaatactcggttcaattaggtcttgtcccctcattatctgtgaggactgaattccacccccgcttttcaacgcaggctctttgctcgggaaaagtcaaaccatctctcaaaggatcaaagagctcagccatagacagagccgccggaggaaagcggagtcgctgcatcagatgaaaggggcccctcagcctcactcctcaccgcagctcctgggatcttaaagacagggtcaggaggatcaggagggacaagagggatggaggcgaaaggctggatccttaatccaggccggagacaaaggtgagtaactgcgcgtggtggacgggaagatgggcagtaggaggctcctcgccccctagccgggtggcgtgacttcaggaggacccagaaaaccggccaggactgggtaggacggaaggtcccaggcggggcgggcgaaccggctcctcgtggcactggcaaagctgggaacgccccctccaggccccgccctcccgcgcccgtgccgggaactcgaacttaggtaagcgcccrggtcacgcgccggggctgccccgctgcctccagcttcccagagctggcgtctgggaggaagagcgcgtgcatcacgtcctcctccccgccccgcctccggcgcactgcgcacgcgctgccgcgccccgccctttctcggcccccggagggtgacggggtgaaggcgggggaaccgaggtggggagtccgccagagctcccagactgcgagcacgcgagccgccgcagccgtcacccgcgccgcgtcacggctcccgggcccgccctcctctgacccctcccctctctccgtttccccctctccccctcctccgccgaccgagcagtgacttaagcaacggagcgcggtgaagctcatttttctccttcctcgcagccgcgccagggagctcgcggcgcgcggcccctgwcctccggcccgagatgaatcctgcggcagaagccgagttcaacatcctcctggccaccgactcctacaaggtaaagctcggggcccgggcagatgaggaggagcggggcgcgctggggacgagcgcgcggcaggggggcgggggcggctggggctggggttggggctggggctggggctagggtcgcggcgcggggaggcccgggggaggcgcgggcggcggcggctggggcaggtgaggaggcgccgcagtgggcaggaggtggcttgaggaggatggagggctgggcggtggaggcggggcctgggggcgcgcggcggcggcggcgcggcggggggctgaggcgggccccagcggactcccgggcgccggtgctcggggctcggggctcggggcttgggcgtcgccggcgagcgcatgcccttccctgaagcgcggcctcttggcctggagctgggaccagttaggtaacggccccggggacccgcagtggagagtgagcggggctttccccgccgggccagcccggcgcgctcgcccctgsctgggcaggtaagtctcccggggcgcgaggtgggagaagtcctggcgcgggcgccggagcagccgcggtcctctgcggctccggcgcggaggacactcgcctggccccggtagccgtagtggattcccctgtcccactccgccgggctccgtttcaaactccttggcacctagtgattgctcgtgctccttatccctgggtgtagaggccgctctgctcttatctgctttagggtcattacaggatttctgtgaaaaggaaaatgaaacacgaggatttaaaggaactgtagttttaaccctagagaacatgtggagagggaaatggcacagcgttgcgttcacatgcccattgaacacttgtgtgggtagctgccacattcagttgatatgaagcacgcagtagtgaagggaagaggtaaagtaaattttacttgagcagcatagtggtttggaatacagtggtaaaacatagtactctcatgtttttgttttgattctttttttttcctttgtttttagccctcctccgatattccgagaaagtattttrgagaattccattttacttaagttttgtctgtttttttccaatcagcttaaaatgctgtttatgatatttagataggttcttgaaatcgagccaagatccatcaacargttgtcttttagatgcaagtttaaagtattgcaaaatccgaacactatcaagtatgattcttgaatattgtcaagtatacgtgataatacctcaagtatggtcctttacttggtcctaaaacctcctcttgtgttctcttggttcaatcatagtgttttcaaaattttaaatagtgattttagaatagcctcattcatagttttgtagaatttttttcttaactaaatctaaaataactgtcagattttttttttacatgttagccaaatgtaaagggaggttgaatagtctaaattttaaaaacagaagaatgcaacttcctttagtttgcagttcctctaaccattatacataaggaatgtaaaattactttaacatcagttttctggggtgcttttagttagaatagtgaattatcttaaaggtttctaatctagtgagccatacttaattgcactattagaatttgcacctatttaataaattttacttctgtcaactttcaagtcagactggtgtgttttatatcctttataatatgaaacttcagaatattttcatcttagatttttcattttttccccaaaagtcacctctagagggttcaatcaagtcgatatgttttataccagtggcttaccgcagtatgctaaaatagattgtgtgttccacagtcacatttaagtcttaggtttcatttcccttatgtttttaggggtccttataacctattttacatttttgtctttttatcttaggaaaaaggacaaaaatgataatcttgagkttagaagtaatgaaacttatttagaaattacacgagaatgttacatatccttatcagtgcttacaaactattggccaaagttgggaactctagtagtttcagatgtgttgatgaagagagcaaaatattgttgatttcttctttctaaaactgaagaaagaataattgattgcctaagcactacgaaagttattttgcaagtagatggtatggtagcaagcacatgacaatgggagttttgttttgtcttgtatcctgtcaagagagtccagaactatttggaccaaaggagcatttgaagtatatacattcacttctgtaaactcatactttattgtatatagtaaggaattaaggacactgacgactgtggttcctctattttcatcgtggttcttgttagaagtaaggacaccgtttaaaccgcattatccattagttatgaaatgtgctgtccggtgtaggttgcttctcaaagggtcatctgtaagctggttatctagaattcagcatatttttaaccattcatttaataaatgttggtgacctattgggtattataaaagaagacaaagataagtagtattttgaaatccaggagggacagaagttgattttatagaagtttcaaagagctgtgaaatttatatatggtgattaggaattcaaggcagctttttttcaaaaaaaaagaaaattttgcttcctctaatggccaagtaacaaatttttgttgcttgtctttcactgcttctgagcggatgcttcggtattgtcacggtggctcctgagtcaacctgagcctcatgagtggggtactgttgcagcttgyaccccagagactgcctatgcattcataaagatatatgtgacattgtacatatatttcaatttttccattatgttttgttatataggaaaaacttgagcmccataaataaaatatataaatcatgaatatacttcatagggagattaatttaggtcattaataattgagctggtgttctcgttgtgagttaatgaaatctggtttaaaggtgtggcaaaagagatacaagtcattagaaactccatgcaagaggttttaagggaagaggcaatatgattataggtgattttgcaatttctctccttccccaaataacccaaaatccttaagtcatgtttatgagtgagtattgcttcaaagccaaatagcagtgaattatttttgggggcaacagacagatttccagggtttaagaaatcttaaataatactgaaaagaagaatcggttatggtttttgctgtttctagcacattagctttgaagcagcagaaagtcttagccagtgttgggcagagtgtatcctcttctgattgcccttagatattatatagctaacataacttgccctgtgaccttgggtatgttatcccatgtgatcttacatatacagcttattttttaaatgttgacttgtgattttttagcagttaaaaagtataactgaaaaagtaagatagtagtacttgcatttggtcatgtgatcccattgtgggaggaaagatcttcaaatcaaccctaagacatcaaatcagccctatgggacatctagagaagcatctagagaaaactaggctttcttttcccaaaaggattctgttcaactgaaatatatgtgtcatatctcatacttttttaaaaaaactgtcatacttggaacaaggatatttagccttgggaatctaattttttgttacagttggttggccagcactccttaatggaaamagctrtccatcatttgacttagggctagaccgtttttgttctaggcattaaaataataccagttactgttatctagtatgtaataatttttagaagtttatcctttcatgaagtaaattaatcacacaactgaagagttatgttaaaagaactacatttttctgtttgtgcttatgtttgttttttttttgagacggagtgttgctctgttgcccaggctggagtgcagtggcacgatctcagctcacggcaacctccacctcccaggttcaagcgattctcttgcctcagtctcctgagtagctgggactacaggcgcgtgccaccacgcccggctagttttttgtatttttagtagagacggggtttcaccatgttagccaggatggtctccatctcccgacctcgtgatccacccgtcttggcctcccaaagtgctgggattacaggcatgagccaccgtgcccggccagttctttaccacatatgtattgatgttcagatggtgttcttttaacagcaggagggccatgccagtttaggaagcattttcactgggaaggtttgctgggatcttattaggtattttgtttggtttacatctacggaataattttgtatttattgtagaaccattttctttagtaatagaagtcaagtcagtgctaaaaaagttaacatgatttaagagctttctgtgttaactttagaatactatgaaactttttgttagcgttacttaacatttaaaattgagcacttcatttccctaccatttgatagccttccccatctctataaatggcactcttattaatgcagttgctcaaccaaaaatgtgggaggtattaattcttctccctcattatcatcttccacatccaatttatcggcgtagttcccctttacctccaaaaacactgggcaaattctcccatctaacctaatagcccctaactcctgcactctttggtcaccctataatccattcttatccaccactaggctaatccttttaaaaggtgaatcatgtcatattcaccccagcttaaaacataatggcttcccattgcacttggtataaaatccaggctccttggggtagtctgtaagccttacatgatctcatttctgcctacctctgaccttatcgtgttcttactgtccccaccccgcccccatacttttaagtacctaccacattggcctgccttctgttctgtcccttatgccaaagcatttcctgtctccttgtcatttaggtcttgctcacatgtcaccttctcaaagaagtcttcctggccccctctagcccatcattctcttacattttcatagcatctatcttgatctgaaattaatatattttttttcttccttcttcagcccttattagtcctttgaaaatagagaccatgtcattctatttactttctcatcctcagtgtctgaagtaggtacagagtatgtatttgtgaatgaagtatttataaaataacagttgatttgaatttatgmtatatcatccaattttctggtgaaggttcaaaatggcctgtttagtagaaagtaaaatgaagaggacagtaagctagcaaaactagaatcattataaatccttttgactacattgttagaaatactttcttaaaaagctctgctttaaaaacattttcccattaaacaacatgtacatataccacccctataagtagacctaaacatgctctgtattcttctgtaaacttgttgggtgttagtagatagttaataaatggtgtttcttggctaattacctgcgagtttgcctagataacttagatgcgttagctatattctaaaacgatactcttaaggttctccaaagatttttagagttcatacttcgtttctaattaagcagttcagacatttttgtattttaaatggtatttgttttcagagaaggcattctaagtaaaggtaggtttttaaagtactataattagagaacatagctgaagctttaaaattataaatatttaattattgtccagaactggagctgtatttgtacaaagaacattttcagtatacttttagaccaagatacagagttaaatagcttagagacatttccattttgcttttgactcttcgtcttctcagaaaaagraaataacttgccttctagtaattttaaatctgataaagaatgcatcattaagtacctgaacagtaagggtcaaactgtggagaaataaaactatgaatcagacttacaaacttgtgctataagatccacaccatttttcaagttttacttcatcgtgtgtgcttttcttctatctcactacttagtcccactaaagaagttggagttatttacattgtaaactggacattttcatttttacatacatcttgggtgtgtttttaggtagaggtgtctttttcttcagtttcataagtagttgaggtagtggtcatatttattactacagactcattcataaatatatttgtttttgcattttagtgaattgacataaatttcattgctgcagattctgtattagctatcttgcttagctacttcttaaattttattaaagtgggatcagtccctggattctaaccttaataagccctgacatatacttctagcttttgatgagwcttccctgtaccttttagtatatcactatctgttgtacttaaggaaaacagctccaagtctcctrcttgacttaaactctcagatcacttgttactataaagatttacctccaaggttgtctgtgtgctgcattaggggctatttttatagagttgcaagtatgctaccattggcaaggaaacagcacattcattcagaatcatcaatggaaatatattcatcttaggattcttgtactaagctatgaagattcttgaggatagagccaagttttactgagattgagactgtgtacccaaagacagcattggctttcctgaacttgagatcaaagctaaacaggaaaaatgatttatgttcacagtgatcactcatgaaaaatggtctgcaaagatttattccgccattgccatgattcaccctgtatcttaaacctcaaggcactgttattcctactcttgaaattgggcagatacacattattcttccactttattttttattggtaaaatgtttgaatttatttccatgttttaaccatattaaaagtataatgaacactcactttttactttttctttcttaaaagcagataaattttttacatggtggctcttacccaagttcatggaaaagaaatttgtgctaaggaagacctcttcgtattttaaactcataaggatttgatgtttaagaatttattttccagttaggtgggtgatttgacaaagggagattacaaaacaggatttttttttactttgctgctttactttgctgccaccgccgttgctgtcatccaggttttcatagtgtcactgtgaaggctaaaagtgatcatcctcagtacctcattgtacaagtaaagtagtcatgttaagtcattgacttttggaacataccacattgagatattagcagtaccaaattctgctgtctttcagttcattcctttctgttgtgtgtgcccattaggcagctgcttctctctctcttcgcctggatgaaggactgttccccaaaaccaaatgaaatacttttccaacctagaggccttgtagtagatttagtgtgcttgtatgtaaaatttaacgctctcctgtggttttaagatactgaactctgaaaatatcttagatacttattttttatttggtatagccaggaaaagaaactggttaatagcaaacaagaaatatagtttctctggttttgaaataacttcaagccttttctgttgtgatttatagtctactcatcggtgttttctaacagaagtgtatttctttacataggttactcactataaacaatatccacccaacacaagcaaagtttattcctactttgaatgccgtgaaaagaagacagaaaactccaaattaaggaaggtgaaatatgaggaaacagtattttatgggttgcagtacattcttaataagtacttaaaaggtattacttttcctagtatattttaaacactgcttattactcttaactcctttaggagttcttttagaatttttaacaaatctgttaatttggatgcattaaatcatataatttggtgtgtgtttgatgttctaagtatgagaaaagttttctgaaataaaaggtttktttttttttttggaaaccgagtttcgctcttgttggccaggctggagtgcaatggcatgatctcaactcagcgcaacctccgcctcctggtttcaggcaattctcctgcctctgcctcccgagtagatgggattacaggcatgcaccaccacacccaactaattttgtgtttttagtgaagacgggctttctccatgttggtcaggctggtcttgaactctcgacctcaggtgatccacctgtctcggcccaccaaagtgctgtgattacaggcgtgagccaccactcctggccgaactaaaagttttgaaataagtttagaaaagtcattaatttttggaggctaatcttgtttgttatactttagtcattaattcaaagtaaaggagttgttaatgaactggaaactccttttgaattatggtagcaatcagaatatttttatattagccagttttaccttgaagacctatttttaaaaactacctgtgtctctggacttagttgcaaatgcatattaaaacaaaaatcccccaatttctgtgctttcttatttgaaaggccatttctagggggaaaacagttcccaaacgcattatacatgttggaaaagtttatctctaaccttttgaattaaacaatttcagaattgaaaacagtaagttgaattttaggccaataactcttttctataatcttgactcttttaagattaggcagttcagatagtcttatactactgaaaacctagctagatatcagaagtaattattagtggcaagaataccaaagttaataccaaagtttttttgttttgttttgtttttagacagggtctcactcagtcacccaggctggagtgcagtggtgcaatcttggctcactgcaacctctgcctcccaggctccagagatccttcctgctcagcctctcaagtaactgggaccacaggctcgcaccaccatgcctggctacttttttatagtgacagggtctcaccatgttgaccaggctggtctcaaacttttgagctctcaagcgacccgcccgccttggcctcccaaaatgctgggattacagacatgagccaccacgcctggccccaagatactttaaacgagtttactagttatcttgtattaagttaccagcaactgatagcacactttaatttagtcatacaacttaagaactttgtaaaatattactcatttttaattataactaaaatgtattgattacctattctaggccagcattattgtaagtggttcgtatgtcttaactcattttgtcctcacaaacatcatataagtgggtactcgacttttatcctcatttacggataagaaaagttaattaaaagtgtgttgtttggggggcagacatttagtaattgtggaaattactgacttaccaaccctaaagatgccacattctttacgaacgaagtgagacgtttcatttggatgtaagaagcttttgagtcatctcaaagttgaaaagtaccaaaattaatcgagagaaaaaaattaagttaatatcatttttaaaagctgtgcaagtaataattttttctattacacatctgcttttacaataaataaacatttatactttgagttattaaaagtacaaattccttttctgactctgctgttgactctgggtgagcatttaacctcttagttatatttttaatccatagaatgggtgaaatagccaaagatattaagtctgtgacagttcagcaactcacagaatgcacctttagaaatgtaaacaggacatgtatattcttctaggtaaagtagtaaccaaagagaaaatccaggaagccaaagatgtctacaaagaacatttccaagatgatgtctttaatgaaaagggatggaactacattcttgaggtaaaagatggtttcatcttttgatctgttttggtttttctttcagttcaaaacttcttgcaaaggaatttgtttttgttttgtgttttttgagagaaagtgtcactctgtcacccaggctggagtgcagtggcacaatctcggctcactgcaacctctgcttcctaggttcaagctattctcctgccttagcctccttagtagctgggactacaggcacgcaccaccacacctggctaatttttgtatttttagtagagatggggttttactgtgttggccaggctggtctcaaactcctgacttcaagtgatctgcccaccttggcctcccaaagtgctgggattacaggtgtgagccaccatccccggccagaatttgaataagagattagagtatcattacagttcttttttgtttgtgatctgaatataatggctatttcatagccattatatatccttttgaaaagttatattatagccaatatatccttttgaaaagttaaggttgacattttatccctctccccgcatcccccatgttaaatcattagcatatagaatctacagcaagtctaagtaattaataaaaatgaattataacttaaataacatttttgagaaagataattcattcttgaaaatacactataggtaggaaagggcatggttatttggcaatttcaaaatgtaggtctgttttcttgactgaaaatagatgctgtgagtctatcactacacataattctgggaagtttctcactgtatagtgagaatggcttggtgctgatccacaaagttgatttttagtcttgattgtattatatttatatctagtatgtttgaattcattgcctaaatattaaggcactcaaagacatggtaatagaattataagagttaaatatcccgtggtggtttccttttattacaatgatcagttgggaatggaatctgttggcgtatcttgatgttgagtgttacttttaagtctcacaaacgaaagtttcttacattgaaaagactgtcaaacacagaataattagaaatactttaactttcatgcctatatgacaatactgagctatactatttggtacttatgggtcttgaaaaagtcaggtaagtactctgtgctgcacttttcctgtatcttaaataaggtcaatagaatctgtgagctatcacctgtacttgctccatttctcttctgtgaggtttgttgtaaggataaatacagtaataagttaggtactatgcttattactatactgtccagtggccagggcaataagtcgtttgattatatgatcagaaaatcttggggaactaaaggttctctagagataatctggtctaaccccattttacaaacagaatctgagaccgagagatggcaagtgactagtccagggtctccccgctgcttttgagtccaaactaggacctgtagggcaatgttctttttgctatacactgtgcctccagtgcttgtattaaacagatttttcttgtatttaattaccttgtcccaaatcacataaataaattatcaggatttctgaaacagcttgccttcctagtgaaaagttaggcacagctcttagctttaaaagggaggtacagtgtcacataacaaataaccttcagcctaattttggaggcaattattacattaagaggaagtcagttaagtcatactcgagtgttaattgccaagattctgtgtttggcctgtctcatagtttcaggtccacgaccagaatagagggaacctatttcggttcttctgcagggatttccctagctctccttctctctcgttttgttttcttttgttctttaatagcaatcctttatctttcaatctgcagcctttattttgtgaaaataacraatttagaataaaggtagtgttcttggaatacttttagaatatgttggaataaagtcatcctttctcattttctgaaaaagcagggaagaagcaacagtttggttttgatgagtttggaattttctgccacttgtagtgataaatgttcttagcagaagcacgtggcagcattaaacttaaaaattaatatcagtacgtatgttaataattttaactagttttattttagaaggataaggatattctgactagattacagtaacatctacaattgcaatttctatgacagtaaatttagcttctataaaacgtaaagaacctttagtaaaacagcagggaattgagtatcatctgttgaataaataaatttatcattttatcctgccagaagtatgatgggcatcttccaatagaaataaaagctgttcctgagggctttgtcattcccagaggaaatgttctcttcacggtggaaaacacagatccagagtgttactggcttacaaattggattgaggtaaattgtttttttaattcttatttaacattaattgaataaagaccattgaactgagattacagtttagaatttgttactaataaagctatataatctcctataatttasttaacctttcyaggcttcaatttcctcatctataaaatgacagactaaataatctttaaggtttcttctagtagaatagaatgttctgagattttgtttaaatcaaattattgagagtgattgtttttaaaacctagttggctttcatctaattcattgccattttaagtgtgtattattttagagcaaacttagaaaaacagcacatttctagtaacttacgacattcgatgaatgataaatgttcaagttagactaaaggaactttattccaacttctagtaactactttcttcatttttctctcatcagtttaggtcttaggatctaccatctgttacttttcagtttctcatctaaataaaacaagatctgctgttcatattgtttaatttctcaggaagggtacattttgggctttgggtttatactgcgagccttttttttgtttttcttgtatgtatacctaagtagtcatatgttttcacatggtcagagttttgataataatactctacctagcttctgaacagtttaataatagatttaatccgtgagaggaaataccctcgaaagttactatagaaataacaccttactatctggtggcatttacttagttcttagaactgactaattagtttatcrgttaaagtaatttgctattatattgtaaaatagtacatttgaggctcacttataaaaattggaaaacatcgaaatataagaggtccaagagggtgtttgaaacacattttgctaagttgacaggaaattaatagactttttatgggccattaactaataatacactsaaaaaaaaggtacagttaaataaaggttttaaatagtctataccgtatactaaaactaaattaatatttaggactgaaataacatattgattaagtaccagctatgtacccaaaaaatgctgggcacagaagttagagtaagatgttttacttaaagggcctttgagtgagagttggcaattcattctgaactaaccactaatatcattaagaattagtgctgagttggtagcaggaaataggtaattctgtctaaaggaatcatgaaatggaaaataaataagcttttaataaggagaaggaagagctgaagaaatggcacagtgttcttagaatgacagatagtcctatggggactgcagcataaaagtgaaaaatgtataagataaacctttagatggtaagcaaggcaagattctcaaattctgtatgaatcagctccacctccgccccatggacagtagatgaccgttaatggcttttaaggaaagatgcaacctggaaaaaaaaaaaaaaacttgttttagaatggtaaccactggcaatatgaagaataattagactaaagaagagaggtaggataatcatgggcattggcagtggaattgaaagagtaatttcagaagcagaatggtcagatgttggaggtgattggttatagagtttaagaattgtactgattttctattgtgtaacaaactaccccaaaacttaatggcttaaagcaactattatttctcctgattctgtggttgactggatggtcgtctgctgctcttgcttagacttaggcatctgcatttagctgagggttcagccagggctggacatcctttaatggcctcattcccatgtctggggcctcaggtcagatagctgggactaccgggtctcactccagaagaggyttcttcagagcatggtagtcttggggttctaagagaatgagagtagaagctgcaaaacctcttgaaactggggcttgggagtcacacatgactttctccacattctgttcgtcaaaagcgaatcataaggacagcacagactcaagggataagaaaggagattccatctcttgatgagaagagctgcaaaggccatatttaatcagtcacaggagtctaatgctacaaagtagttttttaaaaagatgactagattggcaagttcaaggttaatctttttatttgttttatttatatatcacttagctggtattcagtaaaagcttgctttgtaaaatttagttaatatctttttggttcagcacagacattgcatcatcttagcagctctttttcaaacagatttgaagctgcttcaaataacaatctggtttataaaatgaaaatagaaaattatgatcttagaatgaagaartgaatttctaagccatgataattattacggttgctgtgattagacagacttttctgtggagcttcctgacaaccaagaaaaaaggggaaatcaaggaactgttcttatcagaaagtaggaacccagcaattctttcattttctcattgggaacttaatagtcactgaattacaaagtagacagtgaccttgattatacaacatatgcggaagtgtttcctgtaacttacgtgagtattttatcaaatacttatatatytgataaaagctaagtacataaagcataactcagtagatagaattctctagtagtaagctaaagtgcttcaagtattagttgtcatattaatccaagagaaaattagatctgagactacctcgaggagtaaacgaacaacttctttaaaccaatactagtcaaaatgcagtccacggaccaatgctggttcatgccctatttgatccaagtccacattaagtacagaaatgaagagtaagcatttagaaacttggggcaatttgacattgcctcaacatccaagtttcagtgtcctttataaactattgatccatgacagatcatgaaactttctaaaaattgatccwtttatcacatagtctttcaaaatattatttgcttctttgaagctttggatagaaacttgataatgtgaagttctctgctatgtggacctggtgtgcttatcttctttgttgctgatttgagagctgagctatgtactatatctggaatgcacacagcaggcatcctgctgygcagttctgtgtctagttaatagtatggaagttcaggacatacctccaaaaaaaaaaaaaagctaggattttcctcagaaagaatgcagtattttatgtcttaatatttgtggttaattttgttactacagactattcttgttcagtcctggtatccaatcacagtggccacaaattctagagagcagaagaaaatattggccaaatatttgttagaaacttctggtaacttagatggtctggaatacaagttacatgattttggctacagaggagtctcttcccaagaggtaagtaactgaaaccaacctcatttaatataatgtggattgttggttagagtaccactgtaaacttttggggacgttattgagattgatcttggttctaaaattccaaagattcaaccaacagatacatattcagtacctactactgtgttcagggtacatgggatatgtccttcaacagatgtccctgtcctttatatattagatggatggacagatggatagccagaaacagacataatatatcagatgtgaaataatgccataaagaagctcaaggcagggtaagggaagagagagtgatgaaaagtgggggtgggacactgttaaataggtctctttgaggagataatagttgattttttaaaatatttaggaaaaactgaatctttgtcattaggaactgttatgtctgacaataaatactttcctaagagaaagacaattcttatgggagctatgctatattccttaaatgtggttggctgcatcctggtattattaatgtgggtttctttctgttttggattttggtttatgattgattttccagactgctggcataggagcatctgctcacttggttaacttcaaaggaacagatacagtagcaggacttgctctaattaaaaaatattatggaacgaaagatcctgttccaggctattctgttccagcagcagaacacaggtaaaaaattctgttcattttttaaaactactaattttttcactcttgtatttgtaactcagtgacattttacctaactgcagagccaggtacctacagtacatcttcatgaacttgagcaacacaaattcagtatttatacaaaagtataaacattagtcttagagaggcagagaaattttatccatgctagaagaaacagtttaagagcttttttccaatacttatattgccatagaagttttcttttaaggaattttttttcaattactgtattgtcatatgtaggtagattttattcattaaatttagaagcactcactgtaagtaccagccactttttgccttttccctgtcctcctacatgaccttatctatatttgccctagaaattgtcatctgtactgtaccttcagttgtagatgagaaagcaggacctgttgaggaaagaaagggtgttcagattctttttacgcttccttgtctgctttcagtaaactatctccagttacccaagaaagaaattacaatctaaactgcagctgctctggtcctagagctaactttattaaaagtaaatcaggttgttttttttttttttttttttttttttttttttttgagacggagtctcgctctgtcgcccaggctggagtgcagtggcgggatctcggctcactgcaagctccgcctcccaggttcacgccattctcctgcctcagcctcccaagtagctgggactacaggcgcccgccactacgcccggctaattttttgtatttttagtagagacggggtttcaccgttttagtcaggatggtctcgatctcctgacctcgtgatccgcctgcctcggcctcccaaagtgctgggattacaggcgtgagccaccgcgcccggcgtaaatcaggttttttaaatgtttgccaaaccttatcactgacttttataacaaaattatttactataatcattagggaatatttaagttctgctaatacttaaaattgcagagtgctaaaaccagcagtgagtttagaatcaagctaagctttattgttgctactatttgaggcatattagttgactggtgttcatatgcaaggcagtctactgggtgcaacaagggttagaaggatatttttaaaaaactgaccctattctcaggatgaaaataatacactagtaatagtctgctctgttggttaactcctcgtaaggaggtacaattaaaatgctgtagtgttgcaagggaaggagaggaagaatcatattccttcactagcaggatcaagaaagcttttatagaaatatacaaaatcttcacttcttgaaggattggtaaaatttaatagccaacattgggcacttattcattctctgagtaaatatttattgcatgcttatcttgtatcaagcattgtgatgaaagcacaagaatgaaagaggagggagaatgtttagagaataagggctgaaacacagattttgtagggagcgtaggggagactgagaagacaggttcaggttagtaagggcgctcatattttgacactgaatgttaactatgtgcacatcatgctagctattctaaatyaggcattttcaaatggaagcaggcactgacatttttgagcaaagacgtgatgttatgagataaatatcttaggggacttttttatatttttatagcaggatatctatcctatggattgaaaaaaggaaaaatcagaaggtagtctttataggaagctattccagcagtcttaaggtaatgaagtccagaccaaggtgctaaataaatggaaagaaataggtaaacatgagcaatggcttgggagataaaattgctcaaagttggtaatttgagttgggactcagtagaaaatagattcagctgacgtttatgagcattgtwttagtaaggccttgttgaacacttttacatacaactttcaagactaggaaactgggaaaataagagtgtctttaacaaagttttaagagttatttttagtttggccttagatgtacatacatcttttaaaaatctaacatagtatgcacatattagactcttcgttgatggttatttcaaagtagtaacatcatgatacggaggacaaggataatatcttctttaggacttgttaaaatgaaaaggatactgtatgtgggcaagggataaaaatccattttatttttatggtctcatattgattgcatttgtaaaatttgactccttatatattcaaatgcctcacrtgttcttaatagaatgtcttttaaacaacagcgtagtatagcaaaaagaggattggactgaaagttgggaaacctgggtgaccttccggctgacatagtgggtggccttgggcaagtcacttatctctctgttcttcatttcttccatccaaccaaacaaaaggaggagctaaagttttacatctccaacatgacaaggtcattgatgataaatgagctactatctaaataactttaaaataagagaactctataaatttagaggtttaccattattgtatgtatcttaatagatgaatctgcacctaaaaatatttaattacagaagctttttttctcaaactttggaaaggtatcaaatttaatttggtgcttgaaattaggatttatggcattggtagaattcattgattatttatgatcttcatatatcacatactgtactagaagaatagaggttatgattggactagacagagagtgccagagcaagtatctgtgggatgctgagatgaagatattcaactttctatctaacaaagtagatccagagcctggaagaaaaacagaggctaagatacagatactggaaaccctcatgcagggactttttttttttttttttttttaagcttttgagtgtttcacacaaggtatgttacagaagacaagtgcctaagtcagaactatgagaaatattgccatctgacaggttagattaaagaaggagagcacagcatctgggaagactgaaaagggaaccatagaaataggggaaaaaaggtgaaacatgggagatgtcattgaagtcaagagaaagaaagcatcaggaaaattcaggtgtcatggagaaagcaagtaagatggggacagtgaagtttgctagacatgatacaagtagatcgttaggtgacttactgatacaacgttataagtagtgaccccttaactgtaggagttaattcatacgttgtaaagttctccagtattggtattcattgatcttaattctctcctttttaaagagaaaagttgcagacctgaatatgaagaggagcttctcttcagtcatatcttaattttccatttagcctacagatgcatgaagtagagaattgacatcatagctactggcagcctctgtagctgttaagaagagtgttcactaatgagttttatataaacaggttctctctcaattttggattcgggtagtagtctttacaatcttgaaatgtgcatgctgcactaccccaggtataccattgacagtatggggaaaggttctaagtctagtcctttaaaaaaaaaaacacacacacacattgtataaagtgattatttcagacataaagtctgactcttcaaacagttatgagttaaacttatacctacttgggctttataataaatgaatgtgctatctttttattatttactgaggagaacagattagaggcggactagaaaattagggagaatgaccaattgcttggcataattaaatggtaattttcaaaattaagttgtttgagatcttttaaaattatttacattatatattaacaaatatttacacaggttgagcatcccaaatccaaaatgctccaaaatctgaaactttttgstcaaaggaaatgctcattggagcatttcagatttcagaactggatttcagatttcagaactggggatgcttaactgataagtataatgcacatattccaaaatctgaaaaaatttgaaattcagaatacttctggtcccaagcatttcaaataagcgatacccaatctataattacatattgaatacaaatctatcccgtaagaactgatattaaggacattgcaaaaatcactataaccattcttatccaatagaaactctcatactttattttccatcttaattatgttttgcttaaactaagtatttgaattcttattccctgggcatatattaattcgtagtagataatctgcaaacaaaatacatgacttcctattactagccacttgaaaatataacaggtagttgactatatgtatgtatggtatagtataaataattgcctctaagtataagattttgaaaggtaaaaaaacaaaatgtatgtctgtactattattggtatatagtttcaaaaattcacagaagggagccaggtgctctcattgcctaacaaaataatggaaatatgtattcattctaacatcttgacatacagtataaagggcactcagcaagtgctttttagttagactgattttaaatgagtagattcaggaataccagaaaacacacacacacacagataattggttgaaaatacgaggttagaaacttaaccattgaagaggagtaaggctacttaaagcgttaaaaactaattgggtaaggtatggttgacccagctacttcatttgccttacgatgtatattcattaaactaagtcactcaccttctctgtgatgttgatggtttggtayagtaaacatgagatatgattaaaggtgattcagggatagatcaagtgtctgcctaagtaaatctgtgttttcatttttttttctagtaccataacagcttgggggaaagaccatgaaaaagatgcttttgaacatattgtaacacagttttcatcagtgcctgtatctgtggtcagcgatagctatgacatttataatgcgtgtgagaaaatatggggtgaagatctaagacatttaatagtatcragaagtacacaggcaccactaataatcagacctgattctggaaaccctcttgacactgtgttaaaggtaaattttcatatgtaactttattattagaatccctctgtaggccagstgcatcaatactacttttcatttatatacacacaatttcagagctgtgtggaccagtcccctttattttagagttgcagcccagagagagtaatagatttgcctgaggtcacacagtaatagcacagaaggataccaagacttatggattgttttactgtcaattagacatttgaatagatattttgttttctgcttacctgcaaaattaattaacagcattgccattttaattaatcctatgatttgggcaccaaacttatttgcagtttgtttctttttcagcataagtcactgctagacctttgaagttgttagcacagaagaaataggaacagggtgatgtggaataaaaataattcaaaaatactcttcaagtggaggttctttagaaatactgttgattcataatgtagcagtgttactttttgttgttaatgttcaaggacttggtttatcttcttcaaaaagtagtaatagcaggcttatttgatgcctactactagaaaaatattttaggtgatttacataagatacgccatttaatctctacaaaaaaaaacagtgataaatattactgtctctgttatagaagaaaaaaacagaggcttaaaaaggttaaagtaacttgctcaaggtcacacaacatgaaagataaggagtcagatatccagtgtaggtcttttggctgcagccttgctacttgaccacaccatttgtcagttaatgagcagatgatacttaccccttaagaaagggaaacagaattaaggaggtcttttcttattctattaaatgataggccaatctgaaagtcttgtcttagcctgcaatatttggttttagcaaacttgataggtttcatgtttttactgttacgtaataaamaatgtacacagctagttatgagaaactgatttcatcaatggggaattttctctttgttagaatctttaatcagtttatttaggaaaaagaaatgattgttgtgggaagagaatgtatttcttttgtttatatgaccaagctttctgagaaattttaatttggtgtacaaaacttttagtagttagtgaatgagtaagatgatttgtgtattgtgcagtttggctttaagagcaaaggagaacttagagactatgggttctagatgctgtgtctgcctttcacagtttctctgaactttgtgattgaactggattcatattggagttatatatcagacaaaaaccaaagtcattgggcacaagcagaataagtccaaattaaaagtataatcatgagtttgttaaataatgctttatatacttctttaaaatatacttatttaatattaaggatttttttttccttgaatccatataatttgaaaggtctaaggggaaaaacttgttttgagccactttatgatgtgaattcacttcataggaaataacatgcttgtttttaatgtactttaaccctttaaagtacactggaccaaattttagagagcatatacatagtgttataaaatttttaaagtagttaatttttatattctcgattatcaaagcaaaatcatttaactttgaaaagctcttatacttgttttcagctttagttatttgtgttgcatgtgtatttttccatataggttttggagattttaggtaagaagtttcctgttactgagaactcaaagggttacaagttgctgccaccttatcttagagttattcaaggggatggagtagatattaataccttacaagaggtatgtgttttatattaaaagtttcaataaggcatttcttataattaagttygtttatgtttgataaagaacacaatataaatacaattttaagtctttgtaagtgtttatgttggtataaatctctgtgcattgcttaaagtttagaaataatagtagtttaaaatacagaggtgccagccaagccatacttactcttccagttgtcattggccaccctgaatgatgaatctaaagaagtatcattgtgaaacaaggaaatgtcagtcaagaaatattccttggaatataaaacaaagccttgactctgctggcataggtctgagttttcataractggagcttcacaaatctgtaaaactcataatattaatgggtgctttttcagaaattatagaatagctgccacctcttctaaattaagcattgactgtcatcagtattagatttagccagatagtataagtgttatgcaggcgtacctcattttattgtgctttgcaaacattgcatttttttacaaattgaaggttgtggccaccctgtgttgagcaagtctgttggtgctatttttccaacatgtattcacttcatgtctgtgtgacacatactggtaaattctcacaatatttcagactttgtcattatatctgttatggtgatctgtgattagtgatcttcgatgttactactgtgattgttttagggcaccacagggcacacccagataaggcagtgaacytaattgataaatactgtgtgtgttgtgactccttcaccagttacccattccctttctctgctcacttcaagtttccctatgccctgagacacaacagtatttaaattaggtcaattaataaccccacagtggcctctgagtattcaagtgaatggaaaagtcacatccctctcattttaaatcaaaacctagacatgattaagtttagtgaggaaggcatgctgaaagctaaaataggcctcttaaggcaaacagtaggccaagttgtgaatgcaaaggaaaagttcttgaagaaaaatcaaagtgctactccactaagcatatgaataagaaagtgaaacagctttattgctgctagggagaaagtttgaatggtctgaatagaagatcaaagcaaccacaacatttccttaggctaaagcctaatccagagcaaggccctcgtttcaattctgtgaagmctaagagaggtgatgaagctgcagaagaaaaattggaagctagcagaggttggttcctgtggtttagggaaagaagccatctccatgagtgcagaatgaagcagcaagtgctgatgtagaagctgctgcaagttacccagaagatctagctaagatcattgatgcagrtgactaaacagattgtcagtgtagaggaaacagccttccattggaagaaggtgccgtctaggactttcataactagagagaagacaacatctgctttgaaaggacatgctaactctcattagtggataatgcagctggtcacttttaagtggaagctagtgctcatttatcattctgataatcctaggacccttagaatttgctgaatctactctgcctgtgctttataaatggaacaacaaagcctggatgacagcatgtctgtttacatcatagtgtactgagtattttaagcccactgttgggaccgactgctcaggaaaaaaaaaaaaaaaaaagattgtttcgaaatatcattgcagatggcatctgagatctgatggagatgtacaaagaggttaatgttgtttttcatgcctgctaacacaacgtccgttcgacagcctatccatcaaagagtaatttcagatgctattatttaggaaatatattcttggccgggtgtggtggctcacgcctgtaatcccacactttgggagaccgagacaggcagatcacgcaatcaggagatcaagatcatcctggccaacgtggtgaaaccccgtctctactaaaaatacaaaaattagctgggtggggcaatgcatgcctgtagtcccagctactcaggaggctgaggcaggagaattgcttgaagggaggcagaggctgtagtgtgccaagatcacgccactgcactccagcctgggcaacagagtgaaactccgtctcaaaaaaaagaagaaatatattcttaagtctgtagctgaaagggttcaccattctagatgccatttaagaacatcatgcttcatgggaggacgttaaaatgtcagcattaacaggagtttggaagaaattgattccaaccttcacagataactgagtcttgatttgacttcaagacttcagtggaggaagtaactacaaatgtggtagaaatagctagataactagaagtggtggagcctgaagatctgactgaattgctgcagtctcatgattaaacttgaacagatgaggatttgcttcatatgggtggatacagaaagtggtttcttgagatgaaatctactgctggcaaagatgctgtgaacatcgttgaaatgacaacaaaggacttcgaatatcagtaaaatcagttgataaaaccaaagcagggtttgagaggatgcactcccaattttgaaagaagttcttgtgtgggtgaacgctatcrtaccaaacagcatcgcaagctacagataaatctttcgtgatagagtcaattgacgtgacaaacttcattgttgtcattttaaggcattgccacagtcaccccaaaaccttcagcaaccctgatcagtcagcagccatcaacaacagggcaagaccctccaccaacaaaaagatgactcactgaaggctcaagtgaccattagcattatttagcaatgaagtatttttaattaaggtatgtatttttaagacataatgctattgcacacttaatagactacaatgtagtataaacataacttttatatgcaatgggaaatcaaaaaattcccrtgacttgctttattgcagtggtctggaagcaagcccacagtattttcaaagtatgcctgtattgtcttaaaatttttgcctcgtttactaaataaggttcttaagggccataatttcatcataacacctaaaatactctgtagaatatcactaacataatgtaggccatttgcattcagaaaccactgacattttgatgtatacgaatctcagatggtatctacagctatgaaacacaagtttttttctgttcgaaagagtttggtggagatagagtaaggtcagtacccaaattatagtagttttccaaagattgttgtacataatacttctcacttccaaatcaaacagtatttctgcggtgatggtgtatttagagttccaatatgaggcgtccggaatagatctcttgtaataacagagatgaggtttcttccactacstcttccaaactgccttgcttaagagaagtgggaattccttcagctaagacatttggtgttgggacataggggctttcatgtggaaaggaaaaaagaaatagaagaaaagtctgcagggagaagggggaggaccttacacatagcaatctcagctgrcacacctaattgccgttttccccttagctcagctgaactgacagtctcttaccttggtgtcagttaagtactgttcccaggtgcctttcaggcactttagcacttacgtgtatacacagacacacacacacacccctcccccttgcaggtgaaagaacatggcagggtactgtatctgtttcagaaatcccattagcctgcctgttgctgtgcctacctttccttgttccagcagtcagctgttggattgttcaggcaagttgaacggagttcaagttgggtgttcagtcaggtactcaaaactttcctttcaaaaatcaaagctcttcggctttcttttccttcttttctttccttgtttatataaactttaggaatgtatgtgcgattttttttttttgacagggwctcagtctgtcacccaggcttagtgcagtggtgcagtcacagctcactgcagcctcaacctcccagggtcaggtggtcctcccacctcagcctcctgaggagctgggactgcaagtgtgtgccaccacacctgactcttttttttttttttttttaatgttttgtagagatgggggtctcactgtttcccagtctgggaaacagtctcaactgtttggcctcgaactccttgactcaggcctcctaaagtgctgagattacaggtgtgagccaccattcccagcctgtatgtgcatctgtatagttgagaatcagcccaaaactgtacatgaataaactacataaacaagaatattgagataaatactctttggcattagtgaaacttaaacagaacaattagaggattgaatcgttttgtgttaatgcagatgtactcaggaaggaaaaatatctttttctcttttttttttttgagatggagttttgctcttgttgcccaagctggagtgcagtggcacaatctcagctcactgcaacctctgcttctcgggtagctgggattacgggcgtgtgccaccacgcccggctactttttggatttttagtagaaatagggtttcaccatgttagccaggctggtctcgaactgctgacctcaggtgatctgcctgcctcggcctcccaaagtgctgggattacaggcgtgagccattgcgcctggccagaaaaatacctttaaaaagctgggcctgttggtgtacctaaaggataatacagatgttcctctcaacttagcatggggttgtgtctcaataaacccatttttaagttgaaaacgttaagtggaaaatgcatttattatacctaacctactagacctcgtagtttagcctcccttaccctacaggtgctcagaacacttagtagcctacagttgagcagtcatctaacacaaaacctattttatagtaaagtgttgaatatctcaagtaatttattgatgttccactgaatgcgaatcacttttgcaccgttgttaagttgaaccattgtatgtttgtgaccatctgtacttgtaatttctttacattcattggtatgaaaaatatgttcttagaagcaggaaaaagaattcagttttgctttgtatactaaattagatgctgtaattttgataaaatgaaaaatctgctttatttgcaacaattgttttcttccttgacgtcagcctcactcttggactttgctaytcagcctgtcacccctgtgaattcccatgaggttgacagtgtaaacctgctctaagttttcactttgcacygtgtaccaaaatgaaactgcttatttaggaaaataaaaatatcttttgtgttggacaaaatacagagcgcctrtcttctttttctgttgtgtttcagttatggattcagtcttcttgggtatcattgaaacttctattggagtgatttattaaaatattaacatagtattgcattatcagagttggcaagaggaagctttctttgaagtctcacrtgtattaaatgtttttcttcccagactcaaaattcactttaactccaaattgtctaaattttaaaacttttggtaaagaaacttggcctgaaatacagtgatatgatattagatgatactgttctttgttatttcctcattttgtttttgcctctgaagcatatctaaaatgaggtgacaggtcagaaactattttctctatattttaccttaccctccatctacctgtttcccttttcttccccttttctgttctactctttgcatttcttctgtattgaaattcactttgttcacaattatttaaaggaaaacctgaactcaggggccttgggtacctttaggttcaggtacaataaagacatgagactggatttgcgtgcatcctaaaagaatcacttttaaataagttttatatgttttcatcttgattcttctagattcatcttgattcaaattagatggttggcatttaaaaagaaagttgcatttctaaatgtagatttgtttaaaaatgaagttgcttgggatttgttgggttttttcctttgcagtgttgaaaacaaagaaagtcaattcgagactattaaaaaagtcaatttgagactatttggtgagaatgtggtaactttgatacacataaggctgttacacttaygattttctaataacttctgaaagttctgtttaaaacagagtcagcctttccagttgctttctgtttgactattctcatgaaataaatggttaccaaacttcacttgccacattctatcatcaaagtgattgaatatattaaggcagatgctaggtaaataaacttgactttggtgaaagaaatacaaatgacattggtaataaacacatctttaaagttgtatgtcccttgaaagaactcttttagaactgttcatacaggtctctctagctggtttataactaatcattctcccaaaaatgatacagtaatcttaacacccacagcacctgtgcataattttgtttctggcactggtatatcagccagaataaaatgactctaccagtataccaactgttatataggagaagtattttatactcttttgccaccaatatctttgattcttacatgttccattacatatgacatgtaattatacagtgtattgtgacttattggtgatgattacagtcattcctagagtctagtaaattggctcccattgcttgtgttgctgagatctggacaataacttaacgaggtgaatgagagaagttgactcaagtaatcttagatatttatagctagttttttctcactttctctcatttccttcactccccgaatcctaccagaaccacagtgacagcaatgcagattcaggaactatgcatgaaatcctctccttccacacatatccatcttttgggggtgggtgggtctttaaaaacaaaatgcgggctataattatttattgaccgtgttataaaacagtcttggatgcttcattcatcaatattgtcccttgaaaataatctccattctcttccaaattaaggtttggtttggtttkgttttgttttaatcttctagattgtagaaggcatgaaacaaaaaatgtggagtattgaaaatattgccttcggttctggtggaggtttgctacagaagttgacaagagatctcttgaattgttccttcaagtgtagctatgttgtaactaatggccttggggtatgtcaccttttaattacttctgtgttactaccttccttatgtatctaggtagaatgtggttattgagtgcatttgtcaaagattgatgtggccrtggactgttaatatgttgttgggtactactgaccttaactcagaaacaaggaaagaagggagatattaggtaataacagacctaaggagacagagatttggaaaaaggaagaacaataaggaaaaagattatttaagagagataatacaggtcagtcatttcccactgccgtttttacctttagatcaaaaagtaatatttgagtaggaatgtcagcttacctagccatcatatattaaagacaagcaagtatataatcactgaccaaactgttacaggaaggtagaatatgaggtttggattgttataccacagtcatgttctagtagccatagaacagctaggcaagtgaacaacaaccccccttgcttctttgtaacgtcttgagagctggagattctatagagcaagggacagaggcaggaggatgctaagaattaagaacacctgagttgattccctgcttcactctttgatctttctttggaaagttctgggattgactcatttgttgctgcttgttccactgccacttgtttctgtttctttgctgcctacctttctgatgtagaaacactctgctgtcttcaggttctctaagacttttgcttctgacaataacaaggcaaaagtaaaaagtaccaaaagagggatacgttatgaaataggaaagcctttaccttagtaatactcttgttccctctccaaagattgtgtgtgtggttttggcgtagttggtatagttgggcttttcttcaacagcatgtacatgctgtgcttactgtcagtttaaaggcagtttgtaatataaagagataccttaagggtcacatgttagaatgctcacagacttcctacaaatggagtattaggtgttcttcagtggcaaaaaggatatccaagatgtcatactttttctttattacaaacgactatccttcaaaacaggctaaagtgttatgtttctgaaagccagatgtggattggttcagttatacctattaagtgcttaaaacttaaatgtaaattatgtatgtgcttttttgtaagggagtgtttagacatttctgatgattagtcttctacttgtctaactttcttaatttggatttcagattaacgtcttcaaggacccagttgctgatcccaacaaaaggtccaaaaagggccgattatctttacataggacgccagcagggaattttgttacactggaggaaggaaaaggagaccttgaggaatatggtcaggtatgtatctatgctgattggtttttttaagcaatagtaggttggctcaccaaattaataagaaaggaggtttttatgttattgtttttgtggaagacaaagtattatattttattataaaatgtccaattgctgacctggcctaccaaaataagatacaaaacaagtgtctacgtcataaacacggggcctgtgtatacatagggagaaatattacgtaagtatagtgattgacagcaagtttgtatacactttatccaaaagcaaactatgttactttaatataaaatgtgaaaacaaggtgacttgatttggattacataataaatggtgaaaccttgatttaaccaagttttctgattcaaatcaaccaaactagaaaaatttacagtacactaaagtagttcatatgatctaatggtctttagcatacaaaagtacatttatatttgtgaactcaagttaaaaaatttttggtttttaagccacttgatcaaaaaaaactttagacagaactattcatgaatattcatattattagaaaaaagtacactaaacatgagtgcactattacttcctattttgattctttatactacatcacaattactgcttataacatgttacttttacatttattaaggttttgagccagaattgaaataactttgttaccgttaatgaaaaaatatgtttgtaaatcaaacttttagaattagatccctttatatagcctgttaggcaattatttgagtaagctttgtgtaactcttgtacctactaagattttggcagatttagtttatcctagatgagctaaagtcacttcaaactaaaagtaaaaatctaagtgtgatttttaaaagacactgatttaagagtatgtgaatgatagtagaataaactagaaaataattcataatcatctaggcaatttgatttaagagtaggaactagtattcccttaaatttaaatttgtgaaagaaaatgctacagctaaagcactgtggtttgaagcaacacaatgacaaaaatattagataatgtcatatgcacctcaatcttcagactaggtggaaaattgagattacttctgtggatttttcagagagaaaccagaagcaggtaactccttagtgagacaggagtggctctaccagacccaaagggaatttaatttcttcaatctgtctttgctactcttgtatggatgaagtggattacctttgtcattgacttttggagtataaacagaatctttaacccagtcactgtgtgttagtcaagaatgcaatacttgtttttctttgtttctgttttgggattggcttttggctttttgtgggttttctagacccaaatttagcactagcaaatttcttaaacttccatttgataagtttaatcactgttgagtttgttggccaggaacaaggcagggtttaccaggcttttttgctgcacactcacaatgattacagttctccctaggcacccaggcatcttccttcagcctgaggaaaaaaaagattggtcagctaggtttcttggttttcctttaagaaaactggtttaagaatgtagtattaaggtcattccttttcatagaagttaaatatttctacataccaggcaactcagtgattggccattttagatagtaccttgttccactagcattttttatgcatcaaatcatctcacaatttgaacaccattggcatstctgtatttgactggttggttagtctaattcatcaaaccaggattcaggtattttgcttaataakgtaatataatcatgaaatttccatttatgcaggatcttctccatactgtcttcaagaatggcaaggtgacaaaaagctattcatttgatgaaataagaaaaaatgcacagctgaatattgaactggaagcagcacatcattaggctttatgactgggtgtgtgttgtgtgtatgtaatacataatgtttattgtacagatgtgtggggtttgtgttttatgatacattacagccaaattatttgttggtttatggacatactgccctttcattttttttcttttccagtgtttaggtgatctcaaattaggaaatgcatttaaccatgtaaaagatgagtgctaaagtaagctttttagggccctttgccaataggtagtcattcaatctggtattgatcttttcacaaataacagaactgagaaacttttatatataactgatgatcacataaaacagatttgcataaaattaccatgattgctttatgtttatatttaacttgtatttttgtacaaacaagattgtgtaagatatatttgaagtttcagtgatttaacagtctttccaacttttcatgatttttatgagcacagactttcaagaaaatacttgaaaataaattacattgccttttgtccattaatcagcaaataaaacatggccttaacaaagttgtttgtgttattgtacaatttgaaaattatgtcgggacataccctatagaattactaaccttactgccccttgtagaatatgtattaatcattctacattaaagaaaataatggttcttactggaatgtctaggcactgtacagttattatatatcttggttgttgtattgtaccagtgaaatgccaaatttgaaaggcctgtactgcaattttatatgtcagagattgcctgtggctctaatatgcacctcaagattttaaggagataatgtttttagagagaatttctgcttccactatagaatatatacataaatgtaaaatacttacaaaagtggaagtagtgtattttaaagtaattacacttctgaatttatttttcatattctatagttggtatgacttaaatgaattactggagtgggtagtgagtgtacttaaatgtttcaattctgttatattttttattaagtttttaaaaaattaaattggatattaaattgtatggacatcatttattaattttaaactgaatgccctcaataagtaatactgaagcacattcttaaatgaagataaattatctccaatgaaaagcatgacatgtgtttcaatagaagaatcttaagttggctaaattcaaagtgcttgacatcaaaatgttctagagtgattagctactagattctgaatcakacatcacatctgactagagaccagtttctttcgaatgattcttttatgtatgtagatctgttcttctgaggcagcggttggccaactatagcccaaaggccaaatttggacttctttttataaatgcagattgtctatggctgctttcccactactccagcctaaggtaaacagctgcaatagaagccaaatgagaatcgcaaagcccaaaatgtttattaacctgccctttacacaaaatyacacaaaaagtttcctgatctctgttctaagaaaaggagtgtgccttgcatttaaaaggaaatgttggtttctagggaagggaggaggctaaataattgatacggaattttcctcttttgtcttcttttttctcacttaagaatccgatactggaagactgatttagaaaagtttttaacatgacattaaatgtgaaattttaaaaattgaaaagccataaatcatctgttttaaatagttacatgagaaaatgatcactagaataacctaattagaagtgttatcttcattaaatgttttttgtaagtggtattagaaagaatatgtttttcagatggttctttaaacatgtagtgagaacaataagcattattcacttttagtaagtcttctgtaatccatgatataaaataattttaaaatgattttttaatgtatttgagtaaagatgagtagtattaagaaaaacacacatttcttcacaaaatgtgctaaggggcgtgtaaagaatcaaaagaaactattaccaataatagttttgataatcacccataattttgtgtttaaacattgaaattatagtacagacagtattctctgtgttctgtgaatttcagcagcttcagaatagagtttaatttagaaatttgcagtgaaaaaagctatctctttgttcacaaccataaatcaggagatggagattaattctattggctcttagtcacttggaactgattaattctgactttctgtcactaagcacttggtatttggccatctccattctgagcaccaaacggttaacacgaatgtccactagaactctgctgtgtgtcacccttaaatcagtctaaatcttccagacaaaagcaaatggcatttatggatttaagtcattagattttcaactgacattaattaatccctcttgattgattatatcatcaagtatttatatcttaaataggaggtaggatttctgtgttaagactcttatttgtaccctataattaaagtaaaatgttttttatgagtatcccttgttttcccttcttaaattgttatcaaacaatttttataatgaaatctatcttggaaaattagaaagaaaaatggcaaggtatttattgttctgtttgccataatttagaactcacacttaagtattttgtagttttacattcctttttaacccattcagtggagaatgtcagcttttctcccaagttgtatgttaagtctattctaatatgtactcaacatcaagttataaacatgtaataaacatggaaataaagtttagctctattagtgaagtgttaaatttgtgtgcttcaagtaatgccattttcaggcctacctgttttaagtattcctccagttcaaagaattagaagatgagagaagggcaagtgtcagagttgactccttttctgctttgtgcaactgtatagatgacagtgccttttactaaggaagaacactggagggacatcagatttgagaggaaagagcacgattcccgtgttaaggcttgagacgcctttgacatatctaaatgtaggtattaagtaggcagttgatgatacaggtttgtggacagaagggcctcaaggtatgactgatgtataccttggaaggtatacatctttggaagcacacagtaaaggatactcttctagggatagtatagagcaggagttggcaaaccccacgccatgagccaaatccagcccaccatctgtttttgtaaataactgtattggaacatagccacacccatttatttagttactgcctttggctgttttcttgccacagtggcaacactgattagttgcaacagagaaattatggctgtaaaaactaaaatagtttactgtgaggcccttcacaggaaaagtgtgctgatctctgctagagtataaagagaatctagggctaaaccatgagtaactcttgaaggttaagtggcagaacatgagcagaccaaatgacaagcatagctaaagagatgaaagttccaaccagaaggagtgaagtcacaaaagccagaggaaacatttttcagcccagctgttgaatgctgctgagagatcaaataggatgaagaatttaaaacagctactggatttagccacctggaaataattggtgccttagacacattcctttccaggtagtagaagaggcttatttctgaaagaagctcccttatatacctctttgaatgtgggttgcgaaaagggaggagagaatgaggcaatagtatctttgtccttctagctgtagccttacatctgaaaaaggtccaggaaagagggaggagttgaaaataaaagcaaaaagacatcagtgatgatttggggttccagagaaggtggagaaaggtaagatccaaagcacttggtagggtattggctttgaatgataggggtccttctagaagaaaggagaagatggaagcaggtgtgtactttggttttctacaaagttggaggccagatcccacttgtacgtggtttattactcattcatttatgttcaccccagagaagcgccatttttcatggttagcagcagaattcagttagaaacacagttatcctgacctgctttatatattttttaaattccgtaattggctactgagctgttatttctttgacataaactaggcaatgcattataacaaactatctctcagaccacagtgcaatcaaactagaactcaggattaagaatctcactcaaagccgctcaactacatggaaactgaacaacctgctcctgaacgactactgggtacataacgaaatgaaggcagaaataaagatgttctttgaaaccaacgagaacaaagacacaacataccagaatctctgggacgcattcaaagcagtgtgtagagggaaaattatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacgaaaaacccttcaaaaaatcaatgaatccaggagctggttttttgaaaggatcaacaaaattgatagaccgctagcaagactaataaagaaaaaaagagaggagaatcaaatagacacaataaaaaatgataaaggggatatcaccaccgatcccacaggaaatacaaactaccatcagagaatactacaaacacctctacgcaaataaactggaaaatctagaagaaatggatacattcctcgacacatacactctcccaagactaaaccaggaagaagttgaatctctgaatagaccaataacaggagctgaaattgtggcaataatcaatagtttaccaaccaaaaagagtccaggaccagatggattcacaaccgaattctaccagaggtacaaggaggaactggtaccattccttctgaaactattccaatcaatagaaaaagagggaatcctccctaactcattttatgaggccagcatcattctgatagcaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcctcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaatcaggcaggagaaggaaataaagggtattcaattaggaaaagaggaagtcaaattgtccctgtttgcagacgacatgattgtttatctagaaaaccccattgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaactgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcctgcatcgccaagtcaatcctaagccaaaagaacaaagctggaggcatcacactacctgacttcaaactatactacaaggctacagtaaccaaaacagcatggtactggtcccaaaacagagatacagatcaatggaacagaacagagccctcagaaataacgccgcatacctacaactatctgatctttgacaaacctgagaaaagcaatggggaaaggattccctatttaataaacggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcgtgggcattttgtaatttttatagagatggattaacgatctcgcttacaaactctcttgaattggctacacgtttaattctgattaggtcttcctgactcgccagagttgttctgccagatctctgagcctctcgctttccagcccttcctcttcagctaacaaacatgttcctttttctcacaccttttttaaagaactcccttgataacaccagctctagcctcccttctcccatttacatcagacttctctccatttactgcctcacctcccattcagttatcttccatctggttctcacctcttattggacaaagcagtgaccttctaattgccaaatgaataaattttgttattacattatctgagggctctcctgcatttgccactactaagaattcatttctttactactttgttctatgatcttttggggtcttctaatccctgtggactgtcccttctctctcggtctgtttttcacacatttttaaatgttgacacatcccatttatctccatgttcatcttggctgatgtcagccattcacgtggtgtcagctatgagctatctactacagcctccacacatttatgtctccagcccagacttctaaatcattctacctgtcactgatacatttccactcagatgcaacaaatccaagcttaccatattcccccagaacttactatatttattttgattctctcatttggcagctcaggcagcccccaacatgaaacttccctctccattaccctatacatttaatcggccacataatcctattgatttacctactaaataacattataatctgtgtcttctctccaactcttatttcagaatctcaaatttcttcctgaagtacaggctgagcatcccagatccaaaatctgaaatgctccagaacatggaataaagtcttgtatgcctacatgacactcaaagtaaatgtccttagaagcattttggatttcagattttcaaattagggatgctcagccagtaagtaaatgcaaatattccaaaatctgaaatctaaaacacttctggtcccaagcatttcagaaagtaatttctgtattactcaacttgtaatcagaaattatctaattagttttcctaactccaatccagcctccctccactctgctaccagagtattctaacaaaatcagagtgtcagtcccctgctgaaagcacctcagtgttcctttagsctgcaggatgctgctcggaatccagcctgaccctccctgatctggcctgtgctgcgtttatagcctcatgtccactcctcatttcctgtccagcatcactgatttgctctaccttagacgcacacatgcacacatgctgtacaccattttctccatttatctgcctttgtgtattctaagtccttggccaggaatgccttccctgtaggtggtacttattttaggtgacagtgccttaaggtggactcaatttagtgataacacctccaagaggccttcaacaactcacctgccatccccacctcacatgcccttcctctggcctctgtaggtgttgaatgtatctcagaattagcatttacagtccaaaggtctgtgtcctatatgagacattcatctatatttcatcagcacatagtagacattgaaatgtctgctgagtaaatgaatgtcattaaaataaacacttttaaggtgttttgataacttctctgtaatactagtaccctgaacatgttagtgtttttaaaaagtgaaacgacattttttaagtacttttgtaaaaaggtggataatttttttaaagtatattcacatattactgtcttttttaattcttaaattcatgaagtataggtgtttcatcaaaacagattagaaagctatggtataaagaaattaaattatttgcctaacgttaccttgtatgtagttcagtagttcataacttttcttgggtcttagacttctgagaatttgatgagagctatggactctcctctcagaaaaattctcacttgtgaataaacaacaagtttgcctaaaatttgaggaggttcgtttcacaggcgccacactgagaactctaagttaattacagagcagagattagatttcagggctgtttctagcaaatgttcctctgtttgaacttctagtagtattcttagtaatgttaaggttttaattaccttaaattgtttttgcaacaagtcaacataaagataattttaattccactcaaagattctacagacttcactaatgcagatttcaaaattagtggctattttaaatgcccttttttataggtggagaaacaa

SEQ ID NO: 12227 - DNA, 93112 bp, Homo sapiens
  misc_feature (1)...(93112): n = A,T,C or G, or insertion/deletion polymorphism (see Tables 1-2)
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattagtgatcgagagccatttttgctggtggcaatcatatggtacttttaatgggaatattagaaaggcaccggtaatgaccttgttgcagcacaaaggagagagtgtggggtgcccctgcatgttgtcccacctcttgtgacgtgtatcgttttggaatttccagtggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaaggtaaggagtctgtggccagacatctacacgcttcsatgctgggatgaaaagccatggaaattcccactgatgcagccgccttcaatggtaaacggatgctcgagtgttgcctgagttctaccatgttgggggaagcctccgtgtactctctgggggagccagcggagtgatttctggtgcaacgtggttgggctttgtctttagaatgggcacaaaccctccagggtgatcgacttcacaattcaccttgttctaaaatgggctacctcagtgtcccagccaaaatttttattgtaacgtgctgtcaggtgtgtgactctttcagtccagtaagcttttccggggatttcttcaagtagccagcaktcagwgcaatcttcagcattgcagattcagagaaatgtggctctggagcctgtcatcctcgagaaacctaacagggctgcattaattccatatggtcctgggtctatggagcagtayatgagctcccaatgctctaaggctcttcagtcctaggctttgaagggagtgatttctcagtgttcttaaacctctttctgatggcacttgtacctgtgaggggtctagagagaaaggttagtagacttctcctttactgcaattcaggatgcagggcatgagaggattccctccctcstccaagggaagaaggttttggcgtgcacacatccttgagaagcaaagtgtctttgccttcagtcagatatataggatcgttttctgccccatggcctggaagccagaggcyttggctttcatgatcaacgatctagggaaacatgcaaaatttccrtgtctttcccctcctctgcccycgacagccaattaccacctgcatcctgcattgccaaatgcagtgccctttgtatgaacattcagtakagtttcatagaaaggtgctacttcgtgagcgcactttgcagtgagaagatctgttctgttctgtttttctaaggatttcaggtgaaatatttcctagaacttactacagttctagattggtaggaatctgtrggtttgctgtatgttttttggttggttttctcccatccatctgcctacaggtaagggaaagataamgttcrtaattctcatagactcctttctggttktgtcataratgkcttcacatatttcgttattctcagagatactcagtttatttcttgtgttttcatttcagcaccgactgagcagaggcctggggtgcaggagtgctaccacggtaatggacagagttatcgaggcacatactccaccactgtcacyggaagaacctgccaagcttggtcatctatgacaccacactcgcatagtcggaccccagaatactacccaaatgcgtatgtctttgttctttaccataagagaataaagggccaactgaagtttctgtgacaagagacatgcttcaagctgagttctccgaactcaacttgtgtcagattcagatggygtagcaaaatgtctcaggatgatttccttggagctaagggtctgagagaagagaaatgttaagctgcctcaccttcctcctagttttgtggagcagaagggaaatgaggaggcgaggagatcaccttatgaagaaagtcagaatgacgaacsaccaaacacttagattacccttgcccaacacccactaagcgtcaatgaagactttccagttggaattccgttattctgacttccaattcctgaagggaagattgtgtttgccttttctgtctgggctcatgaggaaagtttatgtgcttacttatggacaggtgaattgatctgtttctatttctacctgtattccaatagggagaaaatctcttggtcctaagtaccagtggcctgaarggatagaggttcccagcaagagaagatccaaggaaggaaggcagatgagagtcagcacagagagkgatgctgaaaagtaaaagggatgggtagatggatagaagccctggyctgaccaccccatggccaatcatttggccataatcaacaaccaaagacatggaaaaatggtttctacatgtgggacaacagatsgtagaggacctagagaattgagagagggccaatgatgagctcaactccatagatgccttggctttcttcctggatacccttcctgcactgartagcaaggagatggagctcaagcagcctgtagccatctagctgagcagaggagagggattggagtttgggatgactctggtatwttctaggtccgctacaaataagaactggtttgtggaggaaaggagctctacaaatacgcatagaagtctcctccagtagytggcctcacatgacactgcatgtgcacagaaaatggttctacagaaagtgtggcaaagaacatttactgagaaacagcaactacaagagaacagcaagctcaattaagaagatagagatcacatagcactctgtgttattggagttcttaccagctagatgagagagtgctcacggaacacattgccaattcagtggagaccccagaacagccataatttcaaagtacaattagtatattactagaataaaggcagctgcagacaaccccttgcacagctgaaaagcaagtgtccaagcatcaaatgggtttccaatcaatgaagtgcctgtgagaggaaatctcaactctcttcagaagtaaacaacaaagtcaattgcctcarctatgcggtatccccagagtgagtcctaaattaaaaatttgactacgtgtagaaaagaatttcgtgtgatccatgaccagraaataaatcaggcaatacaaacaggctcagaaatgacatcgataattagaattgcatgaaaatttgacatatcagtatgataactgatttcagatatttaaaaaaagtgcaacaaagcaggtatcatatcaagacaaattaatagtatagaatagccaaatcaaattaaagaactattatacaaaaagtatgtcttaaatgaagaaattactgtatgtccgcctgaaaaatttagatgtttcagaagaaaaaattaaccaaaaacaattctgcagaacctacagaatgagccacacacacacacattcaaaacacacccatacacacacacatgcaaaaactcacaagttctaacacacacacaaacacacacacacatgcacatccctaaagaaatagggaaatataaaattaaccgaccctcagagacatgcaggaaaatataagaagatttcctgcatgtgggaagcaagtcacagtaaagagcaagggagtttggagtagatacaaataccggaatcacggatggctgataacttttcaattatgaagaacgttagaaaaatcacagattcatgaaactaaagggatcaaataggaaatttcgagaaaaaaaactacatgatgcacttctctacatcacagttcaaaggtaacaaggcaaggatataagaagaagaaacatctcacgagaaactggagaaaaaagagctgtgtcttcctagagtacagtgatacaaattgctaatgcgttcacctcagaaacactggaagccagataccagggaatattattaaaatgataatgaggaacaagaagagatcaaccgagaatgctgaatccagcaataaaatgccttgaagatcatccatgttggataaatgcatattgtgcactgcccaaaacaaagaaactggaaagtgtaagactttggaatcagcaggcttatgtagcaacagaggtgacccgaaagaattaggtataagaagaatagaagaattgcatgaaaatttgacatatgactaagataactatttcaaatatttaaaaaaagatgaatatgtaataaaacagataaaatatcaaaagaaagtaacagtattgactagccaaatcaaattaaagacttagtgtaaaaagctatgtcttaaaagaaaaaattactggatggctgcctgatcaatttagacatttctgaataggaaactaaccaaaaatcaattctacagaaccaactacacacatatatacacatacaacacacccatacacacccacgcaaaaactcacaagttcacacacacacacacacacacacacacaaccctcaagaaatagtgaaatagaaaaccaaccgaacctcacagacatgttgcaaaataggaaaagatttcctgcatatgggaagcaagtcacagaaaagagaacgggagattggaaacagaarcaaataccggaatcaaggatggccgaaaacttttcattgatcaagaatattaacaaaatcgcaaaaacacgaaattcaatgcatcaaataggcgtttcgaaaaaaagaaaaaatctggtatgatgcacttttgtacttcacattttcacggtaagaagacaaagatataataacaagaaacttcttatgagaaactggggaaaaacaagctgtttcttgctagaagaacagtgatacaaattgctaatgcattctcgtcaaaaacactggaagccagataccgggaatgttattaatgtggtaaacaggaacaagaagagatcaaccaagaatgctaaatccagcaataaaatgccttgaagatcatccatgctgcataaatgtatgttgtgcactgccccaaacaaagaaaccggaaactgtaagaatttggaatcagcaggctgatgtaacaagagaggtgacccaaaggaattaggtagaagaagaatagtacaagaagggaactttctgcagcccatgtaatgaagaacccagcaattggcaaatgtagatgtaaatgcaaaagtattttcttgaccaaatttctatatatttttaaatgagcgttgactactggaaacaaaatgagagcaagagatttaattttagcctcggtagaggtaagaatttgaacaagtagcgtaaatcatgtagggaataattagaagtgtaccattgtaagtttcttacctcatgcacaatggtatgtaatattaataaaatgttactgtgtgggttcaaggagatattgcaaatcctagagcaatcacaaagttttgaactctgaggtatattgtataataagaatattccatgtattcaaaagagagaagccaaggaagaaagaaatttgtcacgagtttgggctcttagtacatcctgtagctcattgaaccagcttcctggaatggagggtctgggattgacactaggccacatgtatagagtctctagagagacagtgtttcatccccatggcccgtaatacatttcccattttctcaggcagccacaggtcatgaatgtgaggatagagagaggttggagcaacgttcttgggaggcataaggaagagcaaatgcttcaagatccccgcagcccaaactcctacctgctttgccccctaatgcagtgttcctccgtagctgtccgacctcttcagatctcttagtctaccctgccatcttcctttatgccatgggtcccactgttctttcaactcatcccccttwccctcagtgcagagtagctgcggccagcagagggtagactgagagcaggagagaaggtcctgcccaggaacccattctagagatgctgcattctgcctgggagcaagttttccagggcagctttgagaagtcttgcagaaacaaacctatttgacccacatgatatgggaatgacagaaagtaatacaatttgcacagtgcttttccatgggaaaagtagagccttttcgcgaggttttgagtacatagagagtgaaggttgacctggaaaggttatcctcctggatcccatgttttttctgaagaactacctgttagttgcaacttgcacattagaatatgaagtcctaccgagagagatacggagaactagataaatacagatacttttgtatgtgaataaacgattccacaatacacacatcaaaatccataccagttattccagagagatggattgggcagaaggcagaaggagaatactctgatcgttttttgcccacgtgtatgtattatctcagtgtttctaagaagcgtttgctactttagatttttttttataataataatcttttaagtatgagaaatgtgcagacaggattagtgattgagagccatttgtgcttstggcaatcatatggtacttttatgggaatattagaaaggcactggtaatgaccttgttgcagcacaaaggagagggtgtggggtgcccctgcatattgtcccacctcttgtgacgtgtatcgttttggaatttccagtggcttgatcatgaactactgcaggaatccagatcctgtggcagccccttattgttatacgagggatcccagtgtcaggtgggagtactgcaacctgacacaatgctcagacgcagaagggactgccgtcgcgcctccaactattaccccgattccaagcctagaggctccttctgaacaaggtaaggagcctgtggccagaaacctacacgtttcgatgctgggatgaaaagccatggaaattcccactgatgcagcagcctccaatggtaaacggatgctcgagtgttgactgagttctgtcatgtaggaggaagcctccgtgcactctctgggggagccagcggattgatttctggtgcaacgttgggtgggctgtgtctttagaattggcacaaaccctccagggtgatcgacttcacaactcacctcgttgaaaaatgggctatctcagtgtcttagccaaaatttttattgtaacatgctgtcagatgtgtgactctttccaagccagtaagcttttcctgggacttcttcaattagccagcattcagtgcaatcttcagcattgcagattcagagaaatgtggctctggagcctgtcacccttgagaaacagggctaacagggttgcattaattccaaatcaccctggttctatggagcagtacatgaactcccaatgatctatgtttcaggacttcctcagtcataggtgggctctgcagccctaggtttttaagtgagtgactgccccgtgttctggtggcagttgtacctgtgagcggtctggatagaaagagtcggagacttctgtattattgcaactcaggatgtgggtcatgagaggatttcatctctcctgcaggggagtaagctgttcgcctccacccatccctgataactgaagtgtctttgtctgcagtyctagacgaaggactgttgtctctcccatggcccagaagctgaagaccttgccttttgttatgaaacgttcattgttttcatgtctgtccgtttctctgcccctaacacccaatcaccatgtatggcctgtacccccaaatgcatcgtgctttgctgtttgctgccccatagtcctcatgaacattcagtagaaattcccataaatgtgcttgcacgtgagcacagtttccattgagaagccctctcatytgtcctttttttctaagcttttatgtgaaatatttctaagaacttactacagttctaaartgttaggaatttgtttctttggtgtttttgtttgttggttggttgttgcttttctcaagtccatctgcctacaaataaagaaacaagaatgttacttgtcatattctcctgaggtcataattctcagagacttttttctggtttgtgccataagtggcttcacatgtttgtctcttcttggaaacactcagtttgatttcttttcttttcatttcagcaccaactgagcaaaggcctggggtgcaggagtgctaccacggaaatggacagagttatcaaggcacatacttcattactgtcacaggaagaacctgccaagcttggtcatctatgacaccacactcgcatagtcggaccccagcatactacccaaatgcgtatgtctattttctttaccataagtgaaggaagggtcagtggaaatttctgttagtagagtcatgcttcaagctgagtgttcaggactcaagttgtctcagatgaacagtgcatagcaaaatgtctcaggaacattgtctttgagcaaagagtctaagagaagacaaatgttaatctggctctccttcctcctagtttaatggagcagaaaggtatctggaggcaaggatatcacattaagaaacaagtcaagatgacaaatgatgaaactcttagagtacccttccacaacacccactaaggttcaatgcagccttttctccttggaattctattaaactaaactccaattcctgaagtgaaggttctgttggggttttctgttttggcttacaaggaaagtatatatgtatatctatggagaggcaaatctatctctttctatatctacgtctattccaatatgtagaaacacagtcggttctgaccaccagtggtctgaagggatactggttgttagagaataaaartggcaggaaggcagatgagagtcagcaaagagagagatcctgtaaagtaaaagggtggatagatggacagaagcccaggtctgaccagcccatggccaggctttmggccataagtgacaccaaagacatggaaaaatggtttctacatgttggacaacagacagtagtggaccaaaagaatagtgacagggggaacaatgagatcaactccatagataccttggctttcttcctggaggcccttcttgcactgaagagyaaggtgatggagcccagatggactgtagccatcttcctgaatgcaggagagagattggaatttgggactactgtggtagctaggattttataggcctgctgagaatgagaatggatttgtggatgaaaggagctccaggggcacgcatagtagtctcctcgaatctttggctaaacatgacgttgcatgtgcccagaaaaaggttccacaagaaagtagagaaaagaatatatcctgaggaatagcaactgcgattgaacagtgagctcaataaagaggacagagccctcatagcattctgggatactggagttctgaccagctggaggagagacctcactgaacctcttgggaatacagtagagactccagaaaagtcatactttaggagtagaattagtaaatttctagaaaaaaaggcagctctagacaaaccctggcaaaactgaaaagcaagtctccaagcattaaaatcatttccaagtcaattaactgcctgggagaggaaaaccctctttagaggtaaacaacaaagtcaagtggctcagctatgtggtgttcacagtgtgagttctaaatttaaaacttgactacacatagagaagcttttagtatgaaccatgaccaggtgaaaaatcagtcaatacaaatagacctagaaatgacagaaatgattagaatggcaaaaaatttgacatatcaatatgtcaactgagttttaggttttaagaaaacatgaatacggaatgaagcagataccatatcaagagacagtaacagtatagaagagccaaattaaattaaagaactagtataagaaggtatgtcttaaatgaaaaaattactggatgtattcccaatggagtgagatgtttcagaagtaaaaactaactgaaaaacaattttataccacctacagaaccagctacacatacacaaatgacacacacatatacacacatactcacacatgcacaggcttagaaacatgcacgcacacacacacacacacacacacacacctccacaaatactaaaaaatgaaatccactgatcctcacagacaggcgggaaaatataaaaagatttcctgcatgtgggtaggaagtcacagaasgagaggaaggagagattgctacaggaacaaatactggaagcaaggatagctaaaaacttttcaaataagaagaatattaaaaaccacagattcaagaagctgaatgaatcagacagggaatttccaaaaaaaaaaaaaaaaaactgtatgattcacttttgtacatcaccgttcaacagtcagaaggcaaagatataataacaagaaacatctcatgagaaactggaggaaaaagagctgtgtcttgctagaagaacagtgatacaaattgctaatgcattctcatcagaaacactggaacccagttaacaggggatatcattaaaatgataaactagaaaaaaaagagatcaaatgagaatgctacatccagcaataaaatgccttgaagatcatccatgttggataaatgcatattgtgcactgccccaaataaataaaccaaaaactaataatttggaatcagcaggcttgtgtaacaagagatgttgcccaaagaaaattagctagaagaagaatagttcaagaggagaactttctgcagcccacrtaatgaagaacccagcaaatggcaaatgtagatgtaaatgcaaaatattttcttgatcaaatttctatatctttttaaatgagagttgactacttgaagcaaaatgatagcaatatatttaactttagmatatgtagaggtaaaaatttgaacatatarmctaaatcatgtggggaataattggaagtgtaccattgtaagtttcttaccttatccaygatggtatgtaatattaatgaaaggttgaatttgtgggtccaaagggatattgtaaatcctaaagcaatcataaaattttgaattctgagggatattatataataagaattttccatgtatccaaaagagggaagccaaggaagaaaaagaagtctttcaagtactcaagctctgagcacatccagttgctcwttgaaccagcttcctggaatggagggtctgggcttgagactaggtcacatgtgtagagtctctagagagacagtgttggatccccatggcccataatacatttcccgttttcccaggcagccacaggtcacgaatgggaggattctgagaggttggagcaatgttcttaggaggcataaggaggagtgaatgctctgagatttccccagcctgaggtcctccatagctgcccgacctcttcagacctcatagtctgcccagctgtctccctttatgccatgagtgccactgttctttcaactcatcccccattccctcagtcccggaattgctgtggccagcagaggatggactgagagcaggagaggaagtcctgaccaggaacccatcctagagatactgcatcctgcctgaaagctaggtttccagggcagctttgagaagtcttgcagaaagaaacccacttgacccacctgatacggtatcgacagacaggaatactttttgtgcaatggttttacatgctgaacatagagccttttggctacattttgagtacattgaatgagactgctggcctgggaaggatatcatgctggatgccatttttttctctggagaactatgtgttagttccaactcgcacattactatatgaagtcctacacagagagatacggagagctagacagatagagatacttttgtatgtgcataaccaattccacaatacacacgtcaaaatccataccagttattccagagagatggattgggcagaaggcrgaaggaggatattctgatccctttttggccacatgtatgtataatctcagtgtttctaggaagtgtgtgctgcattagattttttttctttaaaaaaagtgataatatattaagtatgagaaatgtgcagagaggattagagattgagagccatttgtcattgtggcaattgtatggtatctcttttgggaatatttcaaaggcaccagtaatgaccttgttgtagcaaaatatacagtgttcctgcatatgtacccattttttgtgatgtgtattcttttggaatttccagtggcttgatcaagaactactgccgaaatccagatcctgtggcagccccttggtgttatacaacagatcccagtgtcaggtgggagtactgcaacctgacacgatgctcagatgcagaatggactgccttcgtccctccgaatgttattctggctccaagcctagaggctttttttgaacaaggtaagaagttgtgccagacatttacctgcttggatgctgggatgaaaagccatggatacccccactgacgcacaasccttcagtgctacactggttctcgtgtgttggttctgggtctgccatgtgggaggaagccttagcgcactctctgggggagccagaggtgtgatttttggtgcaacctgtgcgagctgtgtctttaggatgggcggaaaccattctgggtgctcgacttcaccactcccctcattgtaaaaggggctatctcattgtcctagacaaaattcttattgtaatatgctgtcagatgtgtgtgtctttccaagccagtaaacttttccagggatttcttcaagtagacagcattcagtgcaatcttcagcattgcagattccgagaaatgtggctctagatcctgttatccttgagaaacctaactgggttgcattaattccatatctccctgggtctgtggagtagtacatgagctcccgaagctctatctctcaggtctttttcagtccgaggcaggttgtgcagttcttagctttgaagggagtgattttttcgtgtgcttttgcctctttctgatggaacttgtacctgcggggggtctggagaaaaagagtagtagacttttgctttattgcaatgcattatgctgggcacgagaggattccctatcttattgtaggtgataagcttttggcctccactcatccctgagaagtgaagtgttgttgcctacagttttagctgcaggactgttgtctgccccatcaccaggagtttaatgctttcttttttgagcaatcatctagggacacatgcaaggtttttatatgtccttgcctcctccccaaaaaaccattttaatgcttggagacttgcttttcagctttgccaaatgcatcaccctttcttctatgctgttccatgtcgtcatgaacactctgtagagattcctagaaatgagcttccatgttagtggagtttccgatgagaagcaatctgatatttcttttccactaagttktacrtgaaatatttctaagaacttactacagttctagaatggtaggcatctcttactttcgtgtttgtttgtgtgttttctcatgtccatttgcctattaataaagaatagagaatggttgtaaatctcagtgactcttttttggtttatgtcataaatggcttcctgtatttttctgttctaggaaataataagcttgatgtcttctgttttaatttcagcactgactgaggaaacccccggggtacaggactgctactaccattatggacagagttaccgaggcacatactccaccactgtcacaggaagaacttgccaagcttggtcatctatgacaccacaccagcatagtcggaccccagaaaactacccaaatgcgtacgtctttgttctttaccataagcraaggaagggccaatggaagtttctgttagaagagtcatgcttcaaggtgactgctcaggactcaacttggctcagatgcagaggaacatttcctgtgagcmaaagttcttagagaakactttgtttttttgagacagagtcttgctttgttgcccaggctggagtgcagtggcatgatctcggctcactgcaagctccgcctcccgggttcacaccattctcctgcttcagcctctctagcagctgggactacaggcacccaccaccacacccggctaattttttgtatttttagtagagacagggtttcactgttctagccaggatggtcttggtctcctgacctcgtgatccgcctgcctcagcctcccaaagtgctgggattacaggcgtgagccaccgtgcctggctgagaagacattttttaagctggctctccttcctcctagttttatgkaagcagaaggatatatggagttgagaagatcttattaataaaacagccgggatgacaaatgaccaaagagttagagtatccttctacaacatcggctgagggttaatacaaccttttcaccttggaattctatcattctaagctctagtccctgaagtgaatgttgtgttggccttttgcaycttgggtcacagggaattgatacttgcacatctatggagaggcaaatctttttctatctacttctttttcaatgggtacaaacacacttggtcctgagcaccagtggtctgaagagatacggtctgcccagaggagaagaacaaaggcaggaaagcagatgagagtcagcaaaggggcgatgctgaaaagtaaaaggggcgggtagatggacagaagccatgatctggccattctatggccagtctttcggccataagtgactaccaaagacacggcaaaacggtttccacatgttgaacaacagatgctagaggaccaagagtattgcaagagggagaaaatgagatcaacccatcaatgccttggctttcttcaaggagacccttcctgcactgaagagcaaggagatggagcccaagctgactgtagccatgttgctgaacagaggagagtgattggactttgggattactcaggtagttaggattttctagccatgctaagagtaagaatggacttgtggaggataggagctccaggcatagaagtctcctcaagtgttagtctaaacataaagcagcacttgcatagaagattttccacaagaaaatatggcaaaaaaacaccatatattgaggaacaacaactacaagggaacagtgagcttaataaaggtgacagagctcacatagtgctctggaatattggagttttgaccagctagagagaagagacctcattgaaaatcttgggcattcagtagagacctcagaaaagtcagactttatgagtagactttgtatattcctagaataaaggcagctccagaaaaaacctagcaaagctgaaaagcaaatctccaagcattaaaatggtgtcctagtcaattaactgccttctagaagaaaactcaacactctttacaggtgaacaacaaagttaagttgctgagctatgcaatatccacagtgtgagtcctaaatttataactttactacacataaaaaagcatttagtgtgaaccataaccaggaaaataatcagtcaataaaaatagaaccaggaatgatagaaatgatttaaatggcatgagaatttgacatattagtatcataactgcattgctggatttaagaaaacataaacatggaacgtaacagatatcatatcaagggaaagtaaaaggataaaagagtcaaatcaaattaaaggactattaaaaggtatatcttaaatgaaaaattcactggatggtctcccaatcaggttagttgtttccagggaaaaaattaactgaaaaataattcaatagaatctacagaaatagctgcacatatatacacacaatggcacacgtgcacacacccacacccacacaggtgtgaatcctagagccacacsagcattgaaacatagagaagtaaaaattgttcattgaggaatatgtagcaatgctcaatgtgttttaccctaataagagcttttgtgatgtatgattgaaaaactgacacaactgaagagagaaatagataagcccacactctgagttagagatttccttgattctctcactatggttataaatctttcccaaacacaacaggctagaacaaatatgcagaaaattagacatagtatctttgttctcaataaaaacgtcgacctatttaacattataccgaactaccgaatacacattaaagtgtgcatggagcattcactgaggtgtactctacacatgaccttccagcaagtctccatagatttaaaagaattaaagtcatacagagtgtgtcactttattctcccagaataaagtgagatatgaataatgagaagtttgccagcttctcaaatatttgggagtcatayggtgcatttcaaaatactctttgggacaaagaaaacatcactaaggaatttagaaaagttttgaactgagtaagaatataacacaatttatccaaacttaggagatgcagtgaatgtctttaggcttttacataattttagatgctcttagggaaaaacagaagcatgtaataatcaagatttcaaactgcaattctcaaagtgtagtctagagaaacctgaggacctttgagtaccttcagagacagtccatgaggttaaaggactttgctacgtgaaaagtaagatgctattggccctttttactttcattttccaacaagagaagaggggagttttccagcagttacataatatgtaatggcatcatgtctctgatggctaagaaaatgggcaattgttgactttgtgtgttaaaaaaattctcagtgttggtttcttatactataaatattcatcttgtgttttgaaaaagaaaagctctttggaatcccctatgaacaaagactttgacagttgttgatctaagaccacagcttaartatctacacaagaaaaaaaaaaaaagcaaataagagccaaggaaagcagatggaaggaagtagtccaaaccagtgacattcagtgaacaagaaaagagaccaacaagggagtaaactcttgaaacagaaagttgattctttgaaaagatccatatgattgaacacagtctggctaaacaaatgacagaccaatgagggtgcacaaccatcaccatctggagtaacagaggagaggtgccattactatagcatcttccagttctgaaagctgaaaagaagattttgagaacaattgtatgtgaataaattcaggaatgttaatcatgtgggmcaattcctgaggaagacaacaaatcagcaaaccagatgctgaatagttagtgtagtcctgtagagagacatacagagaggctgacagagaaatatttgtatgtgcataaaacaatctacaagacacacttcaaaatcaatctcagttaatctggaggaacatatttcacagaaggtggaaggagggtattctgatcctcttgtacattgtacaacattgtacaatgtacagagtataattgtacaagtacaattgaagttgtacaagtacaagtgcaacttgcacaatgtacagagtaaacattgatgtttactctcaattttcttatggagcacagatgactttggatgtgttacaatatgaatgataatttgtctttgagatgttcgcagttgtttagaagttgaggaccatttgtgcatattatgggacctttagtgaaaatatttcaaagtctctttttacactttgttacagcaaaatgtagagggcgctaagtgcccttgaatcttctcccatctctggtgacctgtgttgttttgaaatttgcagtggcctgascaggaactactgcaggaatccagatgctgagattcgcccttggtgttacaccatggatcccagtgtcaggtgggagtactgcaacctgacacaatgcctggtgacagaatcaagtgtccttgcaactctcacggtggtcccagayccaagcacagaggcttcttctgaagaaggtaggaagtctrtggccagacaaccacaccctaggacgttgggatgaaaasagttgcaaaatcttagtgatatagaagccttccatgctcacacaattccaagtagaatgtggactcagggtcagccactgggaaggaacactcagcgccttctctgggagaaccagagctgtgatgtttggtaccctgtgaaagggtggtatctataggaagggtgcagaccctctagggcactggacttaccactcccctggttattcaaaggatcattttagtgtcttagccagaagaatattctaacattttgccaaatttgtgaagatttaccaagctcatgataagcctttcatggtatttcttcaagtagtcagtgttcrttgcatctttggctttgyggtttcggaggaatgcggtttttgagtctgtcatccttgagaaacctaatatgacttttcttagttccatatacttctgggtccaggtagcagtacatagccaacaaatgctccatcgttctggcctatctccatcttaagccagtcctgcacaactaggctttgatgggagggatctctcagtgttcttgcccctccttctcatggaacatatatctgtgttggtctytgagaagaagagtagtggatatctactttgttgcaatgcagaatcctgggccaaagataccagccatccctccaagggaataaaattttggccagtagccctctctgagagacaatttgtctttgcctacgagtcctagatgcaggaccgcttcctgccccatcttcaagaagctgaaggctttggctttggaggatcagcagtctagggaaatgtgtgacggtttcatgtctgtccccactgacagtcaatcaccacctacaacctgcacagcctgatgcatagcagtctagtttcctgccttattctcaggaacacccagaagatgtctatattaaagagcatgcacatgagtrcaattttgactgataggcactctgatctttcctttggtgcctgtgttttaaaggaaatctttctaagaactcgttaaagttctagaatgctatgaatctttgggttttattattggtatgtccatctgcctgctagtacagaacagagcatggtagtctttctcagagacaatgatcctgtttcagtcacagatttcttctgatgcttctgtgttctagaaattactcagcttkatttctcctctttgaatttcagcaccaacggagcaaagccccggggtccaggattgctaccatggtgatggacagagttatcgaggctcattctctaccactgtcacaggaaggacatgtcagtcttggtyctctatgacaccacactggcatcagaggacaacagaatattatccaaatgggtacaaccttgagttttcttcaaagacagacagcagcccccttacatttctcttggaagggccatgcttccaactaacttcttatgacaaatttatctcagatctggaatgttgggtagaatgtctcaggcttctttcttcaggcacagtgtctgaaaggagagaaatgtcaggccagctctcttttctcatagttgacagaagcaggaggatatttgaaggtggtgagttctcatgaatagaaagctcaggacacatggccacgtgcttagaaatagcaccattccacaatgcccactaaagaccaatgcaatagttcaaccagggatttctgtcattctaatctccaagtcctgaagtgaaggttgtattagccatgttcatcttgggcaacaaataaaggatatctatgttgacatccagatcttccaatcactttctcctctaacctgtacctgggttctgagaacaaggtatctgaagagctatgtgttgccagcacatgaggggcaaaagtaggaaggcagctgagagtcaggaagtataaagattctgaagagttacacatgcaggaagatggacagaaacccagttcagaccacgtcagcgtttctgccatgaaggactatcaaatacataggaaaagtgttttcataggttggacaacagacatgacaggcctgagaaaattcagaaagggaatcaaaggagatcaaccttatcatgtccctggcatccttccttgagacccttgaagggcaagcagatggagcccagctgaccacagcagtcttgcttaactgaggagagagactggagtttgtgatgcctcaggcatctgacgtattctaggctggctaagaatgagaggggatttgtggaggaaaggagctccaagaatacacaccgaagtcttctcaaggctttggctaaatacaaagctgcgtatgcacaaggagagttttcacaaagaaagaacaataaagaaaagctactggggaaagaacaactgcaagggaacagtgagctcaatggagatgctagagctcacatagcactgggggatatttgagttctgaccactcagaggagagacacctcactgaacatcttgggcattcagtagaggtcaaagaaagccataatttgggagtaggatcttcggattcctagaaataaggtgactccagaaacactccagcaacccttcttccaagccagtctaaaaggatccaaatgatttccaagtaaattaactgccttccagaaaaaagtaaactcaaccctccttagaggtaaggaacgaatacaagtttctcagttatatgacatccccagagtgcaacttgcatttaaaaatttactagacacaaaagaagttttcactgtgatccataactgggagaaaaatcactcaacacaaataggcccagaaataatagaaattatggcattggcaagaacatttaaaatgcacctctgagaactgtgtttcaggaaaatgtcagcaaaagctgaccatgagagaaatgaatgcataatatcagaaaagaaaagaattgaagagccaaatggaaatttaaaaactgagaaaagttatatctgtaatgaggaattcactggatggccttataaccagtttagatattatggtaggaaaaggtgaaygagaaaatgattcaattaaagctagacaaaccacaagacagacagacagacacaaatacacatacacacaatgactgaaccaattaatcaacagagcctcaaggacatctaggaaaacatccacacatttaatatatgtgttaggcaagtcacagaaagagaggaaaaagataatgtgacagaagttatacttgaagccatgacggctgacaaatttccaaacatacagaaaatgagaaattcatagtcatgaagctcaatgactcaggtatagatttttaaagagcaaaactctgatttacyggggtacatcatagttaaattgtctgatttcaaagctaagaagaaaaaaagggggttcctatgaacaaacattttgacagttgatctaagaccacagcttaaatatctaggcaaggaaaagcaaataagacacaaggaaaggggatggatggaaatagtccaaaccaatgacattcagtgaacaagaaaatagaccaacaaaggagtaaatccatgaaacagaaagttggttctttgaaaagattcatgtgattgaccacagtctggctraacagatgacagaccaaggagggagtacaaccatcaccatttgaagtaacaggggagaggagccattgctataccatactccaggtctgaaagctgacaagaagatatcaagaaaaactgtatgtgaataaattcatgaatgtagatcatgtggatcaattccttaggtaaacaacaaatcagcaaaccagatactgaatagattgggtactcctatagaaagacatacagatagccagacagagaaacatttgtacgtgcataaaacaatctacaagactcacttcaaaatctctcagttaatccaaagtaacatatttggcagaaggtggaaggagggtattctgatcctttcttgtacacattgatgttttctctcggttttcttatggagtatagacgagtttggatgtgttacaataagaatgataatctgtctttgaaatgttcacagttgtttagaagttgaggacgatttrtgattgttacaggacctttagtgagaatatttcaaagtcactttttaccactttgttacaacaaaatgtagrggatgtctggtgcccttgtatcttctcccatctctggtgaactgtattgttttgtaatttgcagtggcctgaccaggaactactgcaggaatccagatgctgagattagtccttggtgttataccatggatcccaatgtcagatgggagtactgcaacctgacacaatgtccagtgacagaatcaagtgtccttgcgacgtccacggctgtttctgaacaaggtaagaagtctctggccagacaaccacacccttggacgttgggataaaaagagttgcaaaatcttagtgatacagaagccttccatgctgcacgggaatctgaatgtggactcagggtcagccaatgggaaggaagcctcagcgccttctctgggggaaccagggctgagatttttggcaccccgtgacagggtggtgtctttaggaagcgtgcagaccttctagggcactggatttaccactcccctggttattcaatagattatttcagtgtcctagtgaaaatggatattctaacatcctgccaaatttgtgatgatttaccaagctcatcatgagcctttcctggtatttcttcaagtagacagtactcattgcaaacttcagctttacagtttcagaggaatgtggtttttgagtctgtcatccttgagaaacctgatatgactttacttagttccatatcctcctgggtctaggtaacagtacatagccagcaaatgctctatctccctgtctaccttaatcttaggcaggtgctgcacacctaggctttgatggaagggatttcttagtgttcttgcccctccttctcatggaacacgtatctgtgttgctgtttgtgaagaagagtagtggatgtctactttgttgcaatgcaggatcctgggcccaagatttcccgccgtccctccaagggaataaaattttggccagtacccctctctgagagacaatgtgtctttgcctggaagtcctagatggaggaccacttcctgccccatcttccagaaacttaaggctttggctttggaggatcagtgctctggagaaatgtgtgacggtttcatgtctgcccccactgacaaccaccacctacagcctgcaccgcctgatgcatggcactctggtctcctgccttgttctcaggaacacccaaaagagatctttgccaaagaacaggcacatgagtgcaattttgactgataggcactctgatctgtcctttggtgcccaggttttaaagaaaatctttctaaaaactcattgaagttccagaatgctatgaatctttgagctttgttattggcatgtccatctgcctactaatgtagaacagagcatggtcgtcattttcagagatgatgtcctgtttctatcatggattttttttctcatgcttctgtgttctggaaattactcagtttgwtttctcctctttgaatttcagcaccaacggagcaaagccccacagtccaggactgctaccatggtgatggacagagttatcgaggctcattctccaccactgttacaggaaggacatgtcagtcttggtcctctatgacaccacactggcatcagagaaccacagaatactacccaaatgggtatgtctttgagttttctcccaagagaaasagccacccacttaaatttctcctggaagagccatgcttccagctaacttcttatgacccaatttctctcagacccagaatgttggacagaatgtctcaggcttcttgctttgggcacagggtctgagaggagagaaatgtcaggccagctctcttttctcatagttgatagaagtaggaggatacttggaggtggtgagktctcatgaatagaaagctcagaagaacatatgaccatgtgcttagaaatagcaccattccacaatgcccactaaagaccagtgaaatagttcaaccagggaattctgtcattctaatctccaagccctggagtgaaggttgtgtttgccatgtttgtcttgggtaacaagtgaaggatatctatattgacttcgagatcttccgatcactttctcctctaacctgtataaacacattgggttctgagaacaaggtgtctgaaaagctatgtgttgccagcccatgaggggcaaaaggaggaaggcagctgagagtcaggaagtatagagatgctgaagagttacacattcaggaagatggacagaaacccatgtctggctatgccagcctttctgccatgaaggactatcaaatacatgagaaaacagttttcacaggttggacaacagatatggtaggcttgagagaactgagaaagggaatcaaaggagatcaacttcatcattaacctgtcttccttcctggacacagtgttggattgaaggacaagcagatggagcccagctgaccacagcagtcttgcttaactgaggagagagactggagtctgcgatgcctcaggcagctgatgtgttctaggctggctaagaatgagaagggatttgtggargaaaggagctccaggaatacacacagaagtctcctcaaggctttggctaaatacaaagctgcgtatgcacagggagagttttcataaagaaagaacaacaaagaaaagctacttgggaaagaacaactgcaggggaacagtaagctcaatggagatgccagagctcacatagcactgggggatatttgaattctgaccactcagaggagaaacacctcactacattttgggcattcagtagagaccaaagaaagctgtattttgggattgggatcatcttattcctagaatcaaggtgactccagaaaaactccaacaacccttcttccaagccagtctaaaaggatccaaatgatctccaagtaaattaactgcattccacaagaaaaaaaaaactcaaccccccttagaggcaagggacaaatacaagttgctcagttatatggcattcctattgcgttacttctatttaaaaatttaatagagacacaagaagctttcactgtgatacataactgggagaaaaaatcactcaacacaaacaggcccagaaattatagaattgatgacattggtgagaacatttaaaatgcacctctgagaactgtgtttcaggaaaatgtcagcaaaagctgaccatgagagaaacaaaagcagaatagcaagagaaaagaaaagaaccggagagccaaatgaaaattaaagaactgagaaaaggtacatctctaatgaagaactcactggatggccttatcatcactttagacattacggtaggaaaggtgacctagaaaataattcaataggagctacacaaatcacaggacagacagacagaccaacagacagaaacacacacacacacacacacacacacacacacacacacacacacacacaaagactgaacctattaatcaacagagcctcaagggcatctaggaaaaatccacacatttaatatatgtgttaggcaagtcacagaaggagaagaaaaagatatcatgacagacattatacttgaagcgatgatggctcrcaacacgccaaatatacagaaaacaagaaactcatagtcaagaagctaaatgactcaggtatagaattttaaagagcaaaactctatgatttactgggatatatcatagttaagttgcctcaattcaaagctaaaaagaaaaaaagggggttcctatgaacaacagctttgacagctgttgatctaagaccacagcttaaatatctaggcaaggaaaagcaaataaggcacaaggaaagaggatggaaggaaatagtccaaaccaatgacattcagtggaaaagaaaatagaccaacaaaggagtaaatccatgaaacagaaagttaggttctttgaaaagtctatatgattggccaaagtctggctaaacagatgacagaccaaggagggagcatatccatcaccatcatgagtaacaggagagagatgccattgctatagcatcctccaggtgtgaaagctgagaagtagatattgagatcaactgtatgtaaataaattcatgaatgtagatcatgtggatggattscttaggtaaataacaaatcagcaaatcaaacactgaatagatcatgcagttttatagagacttacagacagcctgacagataaacatttgtatgtacgtgaaacaatctccaagacacacttcaaaatccctctcggttaatccaaaggaatgtatttggcagaaggtagaaggagggtattctgatcctttctggtacacattgatgttttctctcagttttcttataaagcatagattactttgaatgtgttacaataagaatcataagctgtctttgaaatgttgacagttgtttagaagttgaggaccatttgygagygttatgggactttagtgagaatatttcaaatttgcttgtttacactttgttacaagaaaacatagagggtgccaggtggtgctgtatcttctccaatctctggtgacctgtattgttttggaatttgcagtggcctgaccaggaactactgcaggaatccagatgctgagattcgcccttggtgttataccatggatcccagtgtcagatgggagtactgcaacctgacrcaatgtccagtgatggaatcaactstcctcacaactcccacggtggtcccagttccaagcacagagsttccttctgaagaaggtaagaagcctgcagtcagacaaccataccctcggacattgggataaaaagatttgcaaaatctttgtgatgcrgaaaacttccatgctgcacaggaagtcgaaggtgaagtcatggacagccaatgggaaggaagcttcagtgccttctctggggggaccagagctgggatgttgagtgccttgtgagggatggtgtctttaaaaggggcacagaccctctaggacactggatttatcacttccctgttatcaaacgaatcatattagtgtcctagccaagatggatattctaacatcctgccaaacttgtgaagatataccaagctcctaagcctgtccagccctttcttcaagtaggcagtgtttattgcagtcttcagctttaccattttgaaggaatgccatttttgaggctgttgttcttgagaaacctaacatgtcttcattagatccgtattgtcctgagactttgaagcagtacatagccaccraattgtttatctccccagcctaccttcatcttgggcatgccttccacacctaggatttgagggaagggatttctcagtgttctcatccctgcttctcatggaacatttatctccgttgttttttgagaagaagagtagtggatgtcagctttcttgtaatgagggatcctgggcccaagattccctgtctcccctcctaggctataaaattttggcctgtactccttctccctgagaggcaatgtgtctttacctacaagtcctagatgcaagatccttttctgccccacaccccagaatctgaaggcttttgctttggaggagcagtggtctagtgtgcaagggtttcatgtataccccccactaacagccaatcaccacctatagcctgaacagcttgatgcatggcaccctggtctcctgccttgttctcatgaacacccagaagaggtgtaagcaaaagaccattcacatgagtgtaattttgaagtataggcactctgatctgttttttgtttgtttctttgtttgtytgttttccagggttgaattaaaatatttatgactacttattaaatttctagaatcctataagtctatttgtatttttattctacatttcaatttgcatgctaatatagaagagtgtaaattgttaatcctcagattattccactttgtgtgtcataatttttttcacatttcccttttctaggcaatactgagcttgattttctcttttaatttcagcaccaactgaaaacagcactggggtccaggactgctaccgaggtgatrgacagagttatcgaggcmcactctccaccactatcacaggaagaacatgtcagtcttggtcgtctatgacaccacattggcatcggaggatcccattatactatccaaatgcrtatgtctatcatgttagccataaaaggaacaatagtcaactaaaatttctcttagctggcccatgctacaagctcacttcctaggtccaaatttctcatagactcagagtttgtagcaaaatgtctcaggaaacttacttttgagcaaaaggtctgaatgaagagaagttttaggattgctatctttcataacaatttgatggaagcagcaggatatatggaggtggtgaagtctcattaatgtaaagctaaggagatcaaatgaccaaatgctgagacaaagtatcattccacaatgcccactaaaggtccatgcagtctttcaaccatgcaattctatcattctatcctccattccctgaagtgaaatttgtgtttgccatttttgacacgaatcagaagtaacaaattcaggctgggtgcagtggctcaggcctgtgatcccaacactttgggaggacaagacgggcagatcaccagaggtcaggagttcaagaccagcctggctaacatggcaaaaccccatctctacgaaaaattaaaaaattagccggtcatggtggtgggtacctgtaattccaactacttgggaggctgaggcaggagaaacacttgagcctgggattcagagtttgctgtgagccgagaacatgccactgcactccagcctgggtgacagagcaagactcaatctcaaaaaaaaaaaaaaagaagaagaagaagaaaagaagaagaggaagaagaagaagaggaagaagaagaagaagaagaagagtaagagaaattttttggagccgcaggaggagccagaagaagaagaagaagaagaagaagaagaagaagaagaagaaggaggaagaagaagaagaagaagaagaagaagaagaagaagaagaagaagaagaagaagaagaagaagaagaaaatagaaatgagtgcatatatttatatatgagtactagcctgtatgaacacactgggttctaagcaccagttttctgaagggatatgggttgtcaggcagagtaaaagcaggaatgcagatgagagtcaggaagtaaacagatgtggtgattaaaatgggcaggtacatggacaaaaaaatgcatgtctgacaaaaactggcctcttgccataagtgagtatgaataatatggaaaaactgtttgcacatgttgaacagcagacagtacaacctgagatagtttagaaagggaaacaaataagatcaaccccataattacccttcctagacttaagggcaaagagttttaaccaaagcattccacagcagtcttgctaaactggggagagagactggagttttgtttactaataaaaccgagattttctaggttaggtaataatgagaaagtatttgtggagaaaaggagctccaggaatacacacagaagtctcttcaagtctctggctgaacagaaagctgtgtatgcacagaaagagtttccagagagaaaggagaacaaagaacagctactggggaaagaacaactgctggggaacagtgagctcaatgaagatgccagagctcacatagcactgggaggtatttgagctctgaccagcctgaggagagacacttcattgaacatcttgggcattcagcaaagaccccaaaaaaccatacttcaggagtagaattaatgcattcctagaataaagtctactccagaaacaccctagaaaagcttagaaaccaagtctaaaaagatccaaatgatctccaagtaaattaattgcctgtcagaagaaaacaacctcttcagaggtaaacaacaaaattaaattgctcaattatatagtatgcacaatgtgtggcatacatttaaaaatttgctaaacatacaaaaagcatttagtgtgacccataaccaggagaaaaatcagtcaatacaaatagacccaaaaatgataaaaataacagaattggcaaggagatttaaaatgtatgtatcataattgtgttcaaggatttaaagaaagcgtggacaagaaataaataaatggataatatcaacagaaagaaaaattgtaaaaggaccaaatggagagtcaagaactgaaaaaaaagacatctctttaatgagaaaatcactacatggccttataatcatattagatagtacagatgataaagctaactagaaaatattagggtggtgcaaaccatagcacgcttatacaaagcctgagaagataaacagagcctcaaggacatctatgaaaatatcaaaatatttaatatttgtttaaagcaagtcacagaggargggaaagagatattggaacagaaaaaatacttgaagcagtgatggctgatgactttctaaatatggaaaaaatgataaactcacatagtcaagaagctcaatggatcagatataggattttaaaaagtaaagctgtatgatttatttggacacatcataattaaattgtccataatcaaagatagaaagtaaaatcttatttgaagcccaagggaaaaaacatacctttacatagagtaacagtgacacaaatgactgatgccttctcatcagaaacaacacaaatcagaaacaatagaataacacctttagagtggtaagaagaaaaaaagatcaaatcagaaacaacaaaataacacgtttagagtggtaaggaggaaaacaagatcaaatcagaaacaatggaataacacctttagagtgtaagaaagaaaaaaagatcaaatcaggaacaacagaataacgccttcagagtggtaagaaggaaaacaagataaaatcagaaacaatgaaataacacctttagagtagtaagaagaagaaaagatcaggtcagaaaaaatggaataayatgctaagaagaaaaaaaaagatcaagtcagaaacaatggaataacacctttagagtgaaaagaaggaaaaaaacccagcaagcttaaacgctatgcacagcaaacaattccactgaaaatgaatgttacgtaagtacatattctgtcctcctaaaaacaaagaacaaataaaagaatgtttcatcagcaggattatgtaataaaagatgtgaaagaatgctatgtaagtagaagaaaaataataccatatgggaattggcatcaaaaccacaaaatactatcaaaacaaaaaaactttattgataaatttaacacaatatgcaaaagaactataccatgtatactacataacattggtgagaagaaaattagaagatctaaataaagacacatcatgcttatagattaaaaaatccaatgtcacttttcacaaaactgatctttagtttcaacccacacccaagcagaattcctgcagtcttttcttgaaaacctaacagaatgtatatgctagaatcaccaagacaatctttaaaaagaataaaaaacttggaataaaatcacaagtttgtgggatagatgcatatggtaatatggaaattctcataaagacacagtaatcaagacatgtggtattggctgggacgcttggctgtaatcctaacactttgggaggccaagatgagaggattgcctgagatgaggagttgcagacaagcctgggcaacatagcaagaccctcatctctacaaatatttaaaaaaattagccaggtttggtgccatgtgcctgtagtcccagctattcaggaagctgaggtgggaggatcactggagcccatgaggtggaggctgaaatgagccatgattgtgctactgaactttagcctgggagacagattaaaaccttccctctctctctcaaacaaacaaacaaaaaatacatagtattgggcaaaacatatgcaaacaaaaacagaaaagggtcagcataaatttacatatatggtcaatttattttcaatacaggtagcaaagcaatttaatgaggaaatttttttccaaaattggtctgaaacaactggatagccatagaaaaaaactataacaaatgtgacgcttgaatcctactgtatgactcaaattaaattaatttgagatagctcttagacctcaatgtaacagctaattctgaggctgaaatataagactgctatgaaaaagtatagtatcttataaccttggagaaggaaaaattttttgagggaagaaccagaaaacactaactgtaaaagaaaacaaatgataatgtggacattcattgaataaaaacttatgctcaccaaatatgactgttaagaaaataaataagtaagtaacacactggaagaaaaacactctcatccatatatctgacaaatggcctgtatccagagtatagaaacatttctcccactcactaatcagaggacaaacaacctaatcaaaatgggcaacaggcttgaatagtcatttcttaggagaagatgcacacagagccaacaatcacctgaaaaagtgcacaacatcttagccatcaaaaatcaagagttataaccctcataagatgacactgaacatccagtgtacatggatatcattaagaagacacaataataagtggtgtcaccgatttggagctagaatgtgccactctctcatatgctggtggaagttcaaaatcatacaacaaattaaaaaatcagtctgatgctttcttataaagttcgataaatatgcatctatcctacaaacctgtaattctattcttgaatatttaccccccaaaatgaaaacataagtccacaaaaatctatataaatattcatagcagctttatgttttataaactcaaaataaaaactatttcaatgttttcatcaaaagaaaatgaaaactatttaaatggtttcatcaaaagaaaatgaaaaaagaatttccagtatatttatacaaaggaatactattcatcaacaaggaacaagttactgatagtctcagaagcatgaacaaacctcraaaatatattaaggaaagaagccagacgtcaaagtgtatagtctgtatgagtccattcatgtgagtttatagaaaacacaatttatggtgaaagaaaccaatagcatttgacactggccgtgggaagagggtagcagagattgattgagcagccacacaagggagtttctggggtggtgaaaatgttctgcattgtgagggcagtgtgggctacacaagtatatgtatttatcaaatctcatccagctacatttaagatctgtgcatctcactctatgtgaaaatatactcaactgaaaaacagagcaggtatctgtttcaggtgctacatcacttgatacgtccagttgtgttaaaaaccactgcctaacatcctcaaatgggggatctgggcttgagactaggtcacatgtgtagagtctctacagagaccgtgttggattcccatgctccataatacgttccaagttttctcagacagccacaggtcatgaatgtgaggattctgagaggttggagcaacgttcttgggaggcataatggggaaggcattctccaagattcctccagcctggggtcttcacctgctgtgcctcttactgcattgttttctgactcatccatagccacttgaccccttcagatcccatagtctacctagccgtctccctttatgccttgggtcccgctgttctttcaactcatcacccattccttcagtcccagagtggctgcagccagcagaggatggactgagagcaggagaggaggtcgtgcccatgaacccatcctagagaagcagcatcctgcctgggagctagttttccagggaagcttttataagtcctgtagacccaaacccacttgctctaccagatacagtatttatagtaatactattttcatgattattttatattgcaaatgtagagcatttatgctacactatgagtaaatagagtaagggggctggcatgggaattatataatcttggatgccacttcttccttggggaaatgtatttgagttccaacttacatattactatatagtcttatagagagagagacaaagagctagacagacagagatatctttgtatgtgcattaaaaaatctaagatacatatttcaaaatctgtgtcatttattctggaggaaagtatttggcagaaggtgaaaggaagatattctgatcctttcttgtacagacatgtattatctcagttttcatagagagcatatactacttttgatgttttaaaacaaaaattataatctgtgatgtgtccacagttgtttaaaagttgaagctgaagaccatttgtgcttgtggcaatattattgtggtataatgggaatatttcaaaggcacttgttaacactttgttacagcaaaatgtagagggcgctaagtgcccttgaatattctcccatctctggtgacctgtgttgttttgaaatttgcagtggcctgaccaggaactactgcaggaatccagatgctgagattcgcccttggtgttacaccatggatcccagtgtcaggtgggagtactgcaacctgacacgatgtccagtgacagaatcgagtgtcctcacaactcccacagtggccccggttccaagcacagaggctccttctgaacaaggtaagaaatttgtggttagacatctatatactgggatgaaaaaccatggaaaatcttactgatgcagaagccttcagtggtacactggagggttggttgagggtctgcaatgtggaggaaagcctcagcgccctctctgggggatccagaactgtgatttttggcacgctgtgaggaggcagtgtctttaggaagggcacggtgtctttaggaagggcacagacccgccagggcactggacttaccactcccctggttattaaatgggtcatttcagtgtcctagccaaaatggatattctaacagcctgccaaatatgtgaagatttccaagccaataagcctttccagtgatttaaagtagrcttttttcattgcaatctacagtttgcagtttcttaagaacatggcctttgagtatgatatcctagagaaacctaaggagactgcattatttttctattgtcctggggctgcatagcaggaggtaaccaacgaatgctgtctctccctggyctatctcagtctttcacaggctctgttcacctcagctttgaagttagaaatttctaggtgttcttgcctcttcttctcatgaaacctgcattggcagtgagtctacagaagaagaggaagagaattctgctttgttacaattcaggactctgggcactagaagattccctatctctcctccaagggaataagttgtttgtctctaaccctccttgagaaacaatgagtctttgcctgcactcctaaatgtaggatgatttcctgcccaaattttcaaaagattaagccttttgccttggtatgagcaatggtctagggaaatgcgcaagggtcttgtgtcggcccctgactgaccaccagtcacctcctacagcctgcaccaaggaatgcattgcattctggtcttctgccctgtggttctcatgaaaaccagcagagattcatatgatggagctgcacatgaatgtaatttccaatgtccagcattctcctctgttctttatctttagatttaaaaataatgtttctatgaacttattaaaattctagaatactatgaatctactgggtcttttcacatccttttgctactagtagaaaaaagaatagtaataattttcagaggctactgtccagtatgtgacataaattgtctcccatgtttctctgctcatgcaattactgagtatgatttattttattttaatttcagcaccacctgagaaaagccctgtggtccaggattgctaccatggtgatggayggagttatcgaggcatatcctccaccactgtcacaggaaggacctgtcaatcttggtcatctatgataccacactggyatcagaggaccccagaaaactacccaaatgcgtatgtatttgattaaaacmataagaggagcaacagccaactcaaatattggttagaagacccatgctttaagctcacttcctagggacaaatttctcttagactcacattttggcaaaatgtctcaggacctttgcttttgagcaaagagtctaagagaagagaaattttaggcctgctatttttcctaatagttttatggaaggagtagaatatacggaagtggcgaagtcatattaatgtaaagctcagaagataaatgaccaaagcttaaacacagcaccattccacaatgcccactaaaaatcaatgtcatctttcactcgtgcaattctgtcattctaaatttcaattcccgaaggtttgtttgccatttttgtcatgggtaataagtaaaaaaaaaaaaattaagatgtgtatatatatatatatrtatatatatatacacacacacacacacacacaaacatctgaatatttatatatatgtctgaatatttatatacttgtgtataaaacttatatttaaatttttgcataaatttatatatttttaatatttcactaaaaattatattgtttcactatgtatgtctgagtatttttatatattttaatataacattttaaatatttatatataaatattcaggtatgtaactgaatattcatttacacacacaaatatatgtgtgcatgtgtgtatatatatatatacccatatatatatatatatatacacatatatatatatatatatatagtatatatatatatatatatatatacacatatatatatatatatatatgtatatatatatatatatatatatacacacacacacacacacacatacatacaggtataaacacactgggcctgaagcaccagtggtctgaaaggacatgtgttgccaggacttgaagagcaaaagcaggaaggcggatgagagtcaggaggtacacaaacgctgaaaagtaaaatggacaagtacatggacaaaaagcaggtataagcataacagccttttggaagtaaatgactataaaatatatgaaaatactgttttcacaagttgcacaacagatagtagtgtattgagataatttagaacagaaaacaaatgtgatcaaccccataagtgtgctgtatttcatcatggattgaaggaaaaagagatggagcccaagaagaccacagcagtcttgatgaactgagagacaccagagtttgggattacaaaggcagctgggattttctacacttggtaataatgagaaagaatttgtggagataaagagctacagtcatgtacctagaagtcacctcagtgtaatataaatctgcatatgcacagggagtgattccacaatgaaagtaggacaaagaacagctactggggaaagaayaactacaagggaacaatgagttcaatggagatggcagagctcacaaagcactgggggatatttgagttcttaccagctagaaaagagacctcattgcaaatcttgggcattcagtagagaccccagaaaagccactctttggaaacagagttgatgtattttaagagcaaaatctactccacaaaaatcctagcaaaattgaaaagcaagtcagaaagaccaaaatcctctcaacataaattagttgcccatcagaagaaagcttaacctcttcataggtaaacaataaaatcaaattgctcagttatctggcatccacaatatgtgacataaatttaaaaatttactagacatacaagaagcatttagtgtgatccataaccaggagaaaaatcattcaatacaaatagacccagaaatgacagaaatgatagaattagcaaaaacatttaaaatatacatatgatcayttgatcttgtgatcagatatcacaagagaagaaagagatacttgaacagaaaaaatgcctgaagcaatgatggctgaaaactttccaaatatgaagaaaaaaaarctcacagattcaagaaaactaatcaatcagaaatatgattttgaaaagtaaaaatgtatgatttactttggcaaatcttcttggttaaattgtctaaaatcaaagaaagctaggaaaattttataagccagaggaaaaaagattgtttatataaaggaacagttacacaaatgactgatgccttctcatcagaaacaatgaaagtcagaaacaataaagtaacatctttaaagtaatagaagaaaaacccaagaggtgagggatcatggcagacaggaggcaggactagattgcagctctggacagagcagcatgcagaggctcatattgtgaattttagccccatattgactgcaagaacagaccagcaatcctgagaggacccacagaccgtgtgaaggaagcagactgctcctgcaggataagggagacaccccaaatactgtgagttccccaactgcagaagtggaaaagggaggccttactccctcaaacacaccccacaactggagaagctgaaagtctgtttgcaggagaagttcccaactttacctgggcctcagtaaatttagagagctgagccaagcaaaatataggggtagaggaagcagcagagaagacctcagagcttgctggatccccaagcagctcattcctgcctggcaccacagagatccatcagaagtgtggccaaaggaacagagggtaaaactccacatggaggactgctctacctgaactttctaacaatttgaacagggggagaagcctcctggccagaacttgggggagggcatgaatctggtttgcagacttcacaggtgggggaaggactaaagcccttttctttcacagctgggaggtggaaagcctcaggcaagttttcaagcctgactttccccccacctggaaacagacttggagctgttgcggggttgggggcatggtgggagtaagaccagcccttcagtttgcatgggtgctgggtgaggcctgtgactgacagcttccctccacttccccgacaactcagatgactcagcagaggcagccataatcctcctaggtacacaactccagtgacctgggaacttcacccccacaccatacagaagcttcagtaagacgtgcccaaggaaagtctgagctcagacacgcctagtcccacccccaactgatggtccttccctacccaccctggtagcagaagacaaagagcatataatctttggagttctagggcccacccacctctagtccctctccacactagtatagctgatgcaggaggccaaccagcacaaaaatagagcattaaaccaccaaagctaggaacccctatggagtccattgcaccctcctccacctccaccagaacaggcactggtatccacagctgagagacccatagatggttcacatcacaggactctgtacagacagtccccagtaccagcccagagctgggtagacttgctaggtggcaagacccagaagacaggcaataatcactgcagttcagctcacaggaagccacatccataggaaaagagggagagtactacatcaagggaacaccccatgggataaaaacatctgaacaacagccttcagccctaccttccctctgacacagtctacccaaatgagaaggaaccagaaaaccaaccctggtaatatgacaaaacaaggctcatcacactcccagttcaccagcaatggatccaaaccaagaagaaatccctgatttacctgaaagagaattcaggaggttagttattaagctaatcagggagggaccagagaaaggcaaagcccaatgcaaggaaatccaaaaaaaaaaaggtataagaagtaaaaggtgaaatattcaacaaaatagatagcttaataaaaaaacaataaaaaattcagtagactttggacacacctttggaaatgtgacatgctctggaaagtctcagcaatagaactgaacaagtagaaaaaataaattcagagctcaaagacaaggacttcaaattaacccaatccaacaaagacaaagaataaaggataagaaaatatgaacaaagccttcaagatgtctgggattatgttaaatgaccaaatataagaataatcgtggctcctgaggaaaaagacaatactaaaagcttggaaaacatatttgggggaataactggggaaaacttacctggccttgctggacacctagacatgcaaatacaagaaacacaaagaacatgtaaatacaagcagcacaaagaacacctgggaaattcatcacaaaaagatcttagcctaggcacattctcatcaggttatgcaaagttaagacgaaggcaagaatcttaagagctgtgagacagaagcaccaggtaatgtataaaggaaaccctatcagattaacagccagtttttcagcaggaactgtacaagctataaaggattggagccctatcatagcctcytcaaacaaaacaattatcagtcaagaattttgtatccagcgaaagtaagcatcatatatgaaggaaagatacagtcgtttttggacaaacaaatgctaagagaattcaccattaccaagtcaccactagaagaactgctaaaaggagctctaaatcttgaaacaaatcctagaaacacatgaaaacagaatctctttaaagcataaatcacacaggacctataaaacaaaagtacaagttaaaaaacaaaaacaaaaaacaaaaccaaagtacggaggcaataaagaatatgatgaatgcagtggcacctcacatttcaatgctaaaattgaatctaaatggcctaaatgctccacttaaaggatacaaaaagagttggtggctggcaagatggctgaataggaacagctccagtctgccgctccccgtgagatcaacacatagggtgggtcatttctgcatttccaaccaaggtacccggctcatctcattgggactggttagacagtgggtgcagcccacagagggtgacctgaagcagggtggggtgtcacctcacctgggaagtggaaggggtcagggaactccctcccctagccaaaggaagccgtgagggactgtgccgtgaagaccagtgcattctggcacaaatactatgcttttcccacggtctttgcaacctgaagaccaggagattcccttgggtgcctacaccaccagggccctggatttcaagcccaaaactgggctggcatttgggcagacactaagctagctgcaggagttttttttcataccccagtggtccctggaatgccagcaagacagaaccattcacccccgtgaagaaagggctgaagccagggagctaagtggtctttctcagtggatcccacccccatggagcccagcaagctaagctccactggcttgaaattcttgctgccagcacagcagtctgaagttgacctgggacgctcaagcttggtgggaggaggggtatccacaaatactggggcttgagtaggaggttttcccctcacagtgtaagcaaaaccgctaggaagtttgaactgggcagggtgcactgcagcttggcaaagccattgtagcaagagtgcctctctagattcctcctctctgggcagggcatctctgaaagaaaggcagcagccccagtcagaagcttatagataaaactcccatctccctgggacagagcaactggaggaaggggtggctgtgagtgcagctccagcagacttagtttcctgcctgccagctctgaaaagagcaccagatcccccaacacagcactagagctctgataagggacagactgcctcctcaagtgggtcctggtttcagaagataataagaaactcctctgagctaaaggagcatgttctaacacaatgcaaggaagctaagaaccttgaaaaaggtcagaggaattgctaactacagtaagcagtttagagaagaacataaatgaccttagggagctgaaaaacacagcacgagaacttcatgacacatacacaagtatcaatagcaaaatcgatcaagtggaagaaaggatatcagagattgaaaatcaacttaatgaagtaaagcgtgaaaacaagattaaggaataaagaatgaaaaggaatgaacaaatcctccaagtatgggactatgtgaaaagattgaacctacgtttgattggtgtacctgaaagtgatgggagaatggaaccaagttggaaaacactcttcaggatattatccaggagaacttccccaacctagcaagacaggccaacattcaaattaaggaaatacagagaataccacattcaaattcaggaaatacagagaacaccacaaagatactcctcaagaagagcaacctgaagacacataatcgtcagattcaccaaggttgaaatgaaggaaaaaaatgttragggcagccagagagaaagtttgggttacccacaaagggaaccccatcagactaacagtggatcttcctgcagaaactctacaagccagaagagagtgggaggccaatattcaacattcttttttactattattatactttaagttctagggtacatgtgcacaaggtgcaggtttgttacatatgtatacatgtgccatgttggtgtgctgcacccattaactcttcatttacattaggtatatctcctaatactatccctccccactccccccatcccatgacaggccccggtgtgtgatgttccccactctgtgtccatgtactctcattgttcaattcccacctatgagtgagaacattcggtgtttggatttctgtccttgtgatagtttgctgagaatgatggtttccagcttcatccacatccctacaaaggacatgaagtcatccttctttatggctgcatagtattccatggtgtatatgtgycacattttcttaatccagtctaccattgatggacgtttgtgttggttccaagtctttgctattgtgaatagtgccgcaataaacatatgtgtgcatgtgtctttatagcagcatgatttataatcctttagatatatatccagtaattgtatggctgtgtcaaatggtatttctagttctaaatccttgaggaatcaccgcactgtcttccacaatggttgaactagtttacagtcccaccaccagtgtaaaaatgttcctatttctccacatcctctctagcatctgttgtttcctgactttttaatgatcaccattctaactggtatgagatggtatctcattgtggttttgatttgcatttctctgatggccagtgatggtgagcactttttcatgtgtctcttgactgcataaaagttttcttttgagaattgtctgttaatatcctttgccaactttttgatggggttgtttgattttttttcttgtaaatttgtttatgttctttgtagattctggatattagccctttgtcagatgggtagattgtaaaaattttctcccattctgtagcttgcctgttcattctgagggtagtttcttttgctgtgcagaagctctttagtttaattagatcccattggtcaattttggcttttgttgctattgcttttggtgatttagtcatgaagtccttgcccatgcctatgtcctgaatggtattgcttaggttttcttctagggtttatatggttttaggtctaacatttaagtctttaatccatcttgaattaatttttatataaggtgtaaggaagggatccagtttcagctttctacatatgkctaggcagttttcccagcaccatgtattaaatagggaaacctttccctatttcttgtttttgtcaggtttgtcatagatcagatggttgtagatgtgtggtattatttctgagggctctgttctgttccattggtctatatctctgttttggtaccagtaccatgctgttttggttactgtagccttgtaatgtagtttgaagtcaggcagagtgatgcctccagctttgcttttttggcttaggattgtcttggcaatgcatgctcttttttgttccatatgaactttaaagtagttttttccaattctgtgaagaaagtcattggtagcttgatggggatggcattgaatctataaattaccttaggcagtatggccattttcacaatattgattcttcctatccatgagcatggaatgttcttccatttgtttgtgtcctcttttatttcattaagcagtggtttgtagttctccttgaagaggtccttcccatcccttgtaagttggattcctaggtattttattctctttgaagcaattgtgaatgggagttcatccatgtccctacaaaggacatgaagtcatgtatgggaatgcttgtgatttttgcacattgattttgtatcttgagactttgctgaagttgcttatcagcttaaggagattttggtctgagaagatggggttttctaaatatacaatcatgtcatctgcaaacagggacaatttaacttcctcttttcctaactgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctatgggtttgtcataaatagctcttattattttgagatatgtcccatcaatacatagtttattgagagttcagcatggagagctgttgaattttgtcaaaggccttttctgcatctrttgagataatcatgtggtttttgtctttggttctgtttatatgatggattacatttattgatttgcatatgttgaaccagccttgcatcccagggataaagccaacttgatcatggtggataagctttttgatgtgctgctggattcagtttgccagtattttattgaggatttttgcatcaatgttcatcatggatgttggtctaaaattctcatttttgttgtgtctctgccaggmtttggtatcaggatgatgctggcctcataaaatgagttagggaggattccctctttttctmtgattggaatagtttcagaagaattggtaccagctcctctttgtatctgtggtagaattcggctatgaatctctcctggactttttttggttggtaggctcttaattattgcctcaatttcagagcctgttattggtctattcaaggattcaatttctttctggtttagtcttggtaggktgtatgtgtccaggaatttttccatttcttctagattttctagtttatttgcacagaggtgtttataatattctctgatggtagtttgtatttctgtgggattggtagtgatatcccctttatcattttttattgcatctatttgattcttctctcttttcttctttattagtcttgctagtggtctatcaattttgttgatcttttcaaaaaaccagctcctggattcattgatgttttgaaggtttttttgtgtctctatctccttcagttctgctctgatcttagttatttcttgccttctgctagctttttaatgtgtttgctcttgcttctctagttcttttaatggtgatgttagggtgtcaattttagatctttcctgctttctcttgtgggcatttagtgctgtaaatctccccctacacactgctttaaatgtgtcccagagattctggtatgttgtgtctttgttgtcattggtttcaaagaatatctttatttctgccttcatttcgttacatacccagtagtcactcaggtgcaggttgttcagtttccatatagttgagcagtttttaatgagtttcttaatcctgagtcctagtttgattgcactgtggtctgagagacagtttgttataatttctgttcttttacatttgctgaggaatgcctcacttccaactatctggtcaatttcagaataagtgygatgtggtgctgagaagaatgtatattctgttgatttggggtggagagttctgtagatgtctattaggtctgcttggtgcagagctgagttcaattcctggatatccatgttaactttctgtctcattgatctgtctaatgttgacagtggggtgttaaagtctcccattattattgtgtgggagtctaagtctctttgtaggtctctaaggacttgctttatgaatctaggtgctcctgtattgggtgcatatatatttaggatagttagctcttcttgttaaattggtccctttaccattatgtaatggccttctttgtctcttttgatctttgttagtttaaagtctgttttatcagagactaggattgcaacccctgctttttttgttgttttccatttgcttggtagatcttcctccatccctttattttgagcctatgtgtgtctctgcacgtgagatgtgtcttcagaatacagcacactgatggatcttgactctttatccaatttkccagtctgtgtcttttaattggagcatttagcccatttacatttaaggttaatatttttatgtgtgaatttgatcctgtcatcatgatgttcgctggttattttgctcattagttgatgcagtttcttcctagcatcgatggtttttacaatttggcatgtttgtgcagtggctgataccgattgtttctttccatgtttagtgcttccttcaggagctcttgtaaggcaggcctggtggtgacaaaatctctcagcatttgcttgtctgtaaaggattttatttctccttcacttatgaagcttagtttggctggatatgatattctcagttgaaaattcttttctttaagaatgttgaatattggctgccactctcttctggcttgtagagtttctgctgagagatctgctgttagtctgatgggcttccctttgtgggtaacccgacctttctggtgaatctgacaattatgtgtcttggagttactcttctcgaggagtatttttgtggcattctctgtatttcctgaatttgaatgttggcctgcctttgtaggttggggaagttctcctggataatatcctgaagagtgttttccaacttggttccattctcctcgtcactttcaggtacaccaagcagatgtagatttggtcttttcacatagtcccatatttattggaggctttgttcatttctttttactcctttttttctctaaacttctcttctcgcttcatttcattcatttgatctttaatcactgataccctttcttccacttgattgaatcaactactgaaacttgtkcatgtgtcacgtagttctcgtgccatggttttcagctccattagatcatttaaggtcttctctatgctgtttattttagtctgccattcatctaaactttttcaaggtttttagcttctttgcaatgrgttcgaacatccttctttagctcggagaaatttgttattacagatcgtctgaagccttcttctctcaactcatcaaagtcattctctgtccagctttgttctgttgctcgtgaggagctgcgttccttcggaggagaagaggcaccctgatttttagaattttcagctgttctgctctggtttctccccatctttgtggtttatctacctttggttcttgatgatggtgatgtacagatggggttttggtgtggatgtcttttctgtttgttagttttccttctaacagtcaggaccctcagctgcaggtctgttggagtttgctggaggtccactccagtccctgtttgcctgggtattaccagtggaggctgcagaacagcaaatattacagaacagcaaatgttgctgcctgattcttcctctggaagcttcatctcagaggggcacccagctgtatgaggtgtcagttggcccctactgggaggtgtcccccagttaggctactcgggggtcacggacccacttgaggaggcagtctgtccattctcagatctcaaactctctgctgggagaaccactactctcttcaaagctgtcagacagggatgtttaagtctgcagaagtttctgctgccttttgttcagctatgccctgcccccagaggtggagtctacagaggcaggcaggtctccttgagctgtggtgggctccacccagtttgagcttcctggtcgctttgtttacctactcaagtctcagcaatggcagacgcccctcccccagctttgctgccgccttgcagttcggtctcagactactgtgctagcagttcaatctcagactgctgtactagcagtgagcaaggctctgtgggcatgggaccctctgagccatgtgcaggatataatmtcctggtgtgccgtttgctaagaccattggaaaagtgcaatattagggtgggagtgtcccgattttccgggtacatctgtcatggcttcccttggctaggaaagggaattccctgaccccttacacttcccgggtgaggcaatatcccgccttgcttcggctcactctccgtgggctgcacccactgtctgacaagccccggtgagatgaacccagtacctcagctggaaatgcagaaaccacccatcttctgctttgctcatgctgggaactgtggactggagctgttcctattcggccatcttgaaacctcccctctctcacgatcacaaggtcccacaataggccgtctgcaggctgaggagcaagaaaagccagtctgaattccaaaactgaagaaattggagtctgatgttcaagggcaggaaacatccagtgccaaagaaagatgtagaatattcaacattcttaaagaaaataattttcaacctagaatttcatatccagccaaactaagctttataacaaaggagaagtaaaatcctttacaaacaagcaaatgctgaggaattttgtcaacaccaggcctgccttacaagaggtcctgaagaaaacactaaatatggaaaggaaaaaccagtaacagctactgcaaaaacataccaaattgtaaacaccatcaacactataaagaaactgcatcaactaatgggcaaaatagccagctagcatcataatgacaggatcaaattcacacataacaataytaaccttaaatgtaaatgggctaaatgccccaattaaaagacacagactgggaaattgaataaagagtcaagacccattggtttgctgtgttcagaagacccatctcagggtgaaaagacatacatgggctcaaaataaagaaatgaaggaatatttaccaagcaaatggaaagaaaaaaaaagcagcggttgcaatcttagtctttgatgaaacagactttaaaccatcaaagatcaaaagagacaaaggagggcattacctaatggtaaaagtatcaatgcaacaagargatctgactgtcctacttatatatgcacccaatacaggagcacccagattaataaagcaagttcttrgagacctacaaagagacttagacttccacacaaaaatagtgggagactttaacaccccacagccaatattagatcgacgtgacagaaaattaacaaggatattcaggacgtgaattcagctctggaccaagctgacctaatagacatctacagaactcgacaccacaaatcaacagaatatacattcttctcagcaccacattgcacttattctaaaattgaccacataattggaagtaaaacacttctcagcaaatgccgtagaatggaaatcataacaaacagtctctcagaccaaagtgcaatcaaactagaactcaggattaataaactcactcaaaaccacacaactatatggaaactgaacaacctgctcctgaattactactgggtaaataacaaaattaaggcagaagtagataagttcttagaaaccaaagagaacaaagacacaatgtgccagaatctctggtacacagctaaagccatgtttagagggaaatttatagcactaaatgcccacaggagaaagcgggaaagatctaaaatcaacaccctaacatcacaattcaaagaaccagagaagcaagagcaaacaaatacaaaagctagcagaagacaagaaataactaagatcagagcagaactgaaggggataaagacacgaaaaccctttaaaaaattaataaatccaagagctggttttttgaaaagattaacaaaatacatagaagcctagccagactaataaagaagaaaatagagaagaatcaaatagacacaataaagaataataaaggggatatcaccaatgatgccacagaaatacaaactaccatcagagaatactttaaacacctctatgcaaataaaatagaaaatctaaaagaaatggataaattcctggacacatacaccctcccaagactaaaccaggaagaagtcaaatccctgaatagaccaataacaagttctgaaatcgaggcagtaattaatagcttaccaaccaaaaaaagcccagaccagagggattaacagtcaaatcctaacagaggtacaaagaagagctagtactattccttctgaaactattccacacaatagaaaaagagggactcctgcctaactcattttatgaggccagcatcattctgataccaaaacctggcagagacacaacaagaaaagaaaatttcaggccaacatccctgatgaacatcaatgtgaaaatcctcaataaaatactggcaaactgaatccagcagcacatcaaaaagcttatccaccatgatcaagttggcttcatccctgggatgcaaggctggttcaacatattcaaatcaataaacataatccatcacataaacagaaccaatgacaaaaaccrtatgattatcgcaatagacgcagaaaaggcctttgataaaattcaatacccaatcatgctaaaaactcttaataaactaggtattgatggagcatgtctcaaaataataagagctacttatgacaaatgcatagccaatatcatactgaatgrgcagaagctggaagcattccctttgaaaaccagcacaagacaaggatgccctctctcaccactcctattcaacatagtattggaaattctgtccagggcaatcaggcaagagaaagaaataaaggtattcaagtgggaagagagggagtcaaattatttctctttgcagatgacatgattgtatatttagaaaactctatcatctcagcccaaaatctccttaagctgataagcaacttcagcaaagtctcaggatacaaaatcaatgtgcaaaaatcacaagcattcctatacaccaataagagacacagagccaaatcctgagtgaattcccattcacaattgctacaaagagaataaaatatacctaggaatccaacttacaagggatgtgaaggacctcttcaaggagaactacaaaccactgctcaaggaaataagataggacacaaacaaatggaaaaacattccatgctaatggattggaagaatcaatattgtgaaaattgccatactgcccaaagtgatttatagattcaatgttatccccatcaagctaccattgatttcttcacataattagaaaaaactactttcaatttcatatggaatagaaaaagggcctgtatatccaagacaacctaagcaaaaagaacaaagctggaggcatcatgctatctgacttcaaaatatactacaaggctacagtaacaaaaacagcatggtatggtactggtaccaaaacagatatatagaccaatagaacagaacagaggcctcagaaataacaccacacatctacaactattggatctttgacaaactggacaaaaataagcaatggggaaaggattccctatttaataaatggtgttgggaaaactggctagccatatgcagaaaactgaaactggatcccytccttacaccttatacacaaattaactcaagatagattaaagaattaaatgtaagacctaaaaccataaaaaccctagaagacactttgggaggccgaggtggatggatcacgaggtcaggagatcgagaccatcttggctaacacagtgaaagcccatctctactaaaaatacaaaaaattagctgggtgtggtcgtgggcacctgtagtcccagctacttgggaggctgaggcaggagaatggcatgagctgaggaggttgagcttgcagcaagccaagattgtgccactgcactccagcctgggcaacagagtgagactccatcaaaaaaacaaaaacaaaaacaaaaaatcaaaccctagaagaaaacataggcaataccattcaggacataggcatgggagaagacttcatgactaaaacagcaaaaccaatggcaacaaaagccaaaatttacaaatcagatctaattaaaataaagagcttctgcacagcaaaaaactctcatcagagtgaaaaagcaacctatggagaaaaattctgtggtctagccatctgacaaagggctaatgtttagaatgtacaagcaacttaaacaaatgtacaagaaaaaaaaaacaaccccatcaaaaagtgggcaaaggatatgaacagacacttctgacaggaagacctttatgtggctgacaaacatgaaaaaagctcatcatcactgttaattagagaaatgcaaatcgaaaccacaatgagataccatctcatgcccgttagaatggcgatcattaaaaagtcaggaaacaacagatgctgaagaggatgtgtggagaaagaggaacacatttacactgttggtgggagtgtaaattagttcaaccattgtggaagacagtgcggtgattcctcaaggatctagaaccagaagtaccatttgacccagcaatcccattactgggtatatacccaaaggattataaatcattctacaataaagacacatgcacacgtatgtttattgtagcactattcacaatagcaaagacttggaaccaactgaaatgcccatcaatgatagactggataaagaaaatgtggcacatatacactgtggaatactatgcagccataaaacaggatgagttcatgtcttttgcagggacatggatgaagctggaaaccatcattctcagcaaactaacacaagaacagaaaaccaaacaccatatgttctcactcataagtgtgagttgaacaatgagaacacatggacacaggaaggggaacatcacacacaggggcctgttggggwgttgaggctaggggagggattggattaggagaaatacctaatgtagatgatgggttgctgggtgcagcaaaccaccatgacacgtgtatacctatgtaacaaacccacacattctacacatgtatctcagaacttaaagtataataataataagatacagaactgcagaatgaataagaactcaccaaccatctgctgccttcaggagactcatttaagacataaggactcacataaacttaaagtaaatgggtggaaataataataagtggtgtcactgatgtggaggtagattataaaactcttatcatatgctggtggaagatcaaaatgataaaacgaattaaaaaatcagtcagatggtttcttaaaaagttccatcaatatgcctctatcttacaaacctgcaattctattcctgaatctttatcccaaggaaatgaaaaagtaagtccacaaagagttctatatgaatatttataggagctttatttattataattcaaactgtaaaaataatttcaatgttcatcaataacaaaatgaaaaaataatttgcaacctactggtacacttgaatactattcagcactgagtatcttaaatagcatggatggagctcaaaaatatactcaggaaagaagccatgtrtattctgtatgagttcatttacatgagatcatttacatttcctccaaaagaggaaaaactaatttctgttgaaagaaaccaatgtatttgcctctggcagtggtaagggggtagcacagattaattgggtagggactcaagagagtttctggggtcacagaaatgttccgtgtggtgatgggagtttgggctccacaggtataggtgttgatccaaaatcatcaaaaaaacaacattgcagatctgtgcatctcactctgtgggaaagtatatctcaactgtaaaaagggcagaaattgcttttaaacgctcagccttttagcacatccagttgcttggagaaccagcttactcaaatgggggtctaggctggagactaggtcacaggcatagagtctctaaactttcccatggcacataatacgtttcaggttttctcagagagctgcaggttagtaatctgaggattctgacaagttgggtcaacgttcctaggaggcatgaatgggagtgcattctctaagatccctccaccccagggtccttgctttctgtgcctcttactccattgttttctgactcctctgtagccactcgacctcttcagatcccattgtctacccagccatcgccctttatgacttgggtcccactgttctttcatctcatcctccattccctcagtttcggagtggctgccgctagcagaggatggactgagagcaggagaggtggtcctgcccaggaacccatcctagagaaatggcatcctgtctgggagctagttttttagggcaggttttataagtcttgtaaagccagacacacttgatctacctggtatgttatttacagtaatactattttcataattgcttttcactctaaaagtagagccttttagctacactgtgagtaaataaaggggctggcctgggaatggtatcatgttggatgttgtttcttccctgaagtaatatatatcagttacaatttacatgttactgcagagtcctagagagagacacagagaatgagacagataccaatacatttttatgtgcattaaaaaaatctaaggccaggcgcagtggctcacacctgtaatcccagcactttgggaggccgaggtgggtggatcacgaggtcaggagattgagaccatcctggctaacacggtgaaaccctgtctctactaaaaatacaaaaaattagccaggcgtggtggcgggcgcctgtagtcccagctactcaggagactgaggcaggagaatggcttgaacccaggaggcagaccttgcagtgagccgagattgcgccactgcactccagtctgggcgacagagcgagactccgtcacaaaaaaaaaaaaaaatctaaaatgcactcttcaaaatctatgtcatttattctggaggaatgcagttggcagaaggaggaagatattccgaatttttcttgtatacatttatgtatgatctcagtttttttatggatcatagaccaattttgatattttaaaataaaaattataatctatcttggaaatttacatggttctttagaacttgaggaccgtttttgcttttcggaatattattgtacctaaaatgggaatattacaacgtcactttttaacactttgttataacaaagtttagacagcgctgggtgcccctgaattttttcccgcctcttgtgacctgtgttgttttggaatttgcagtggcctgaccgagaactactgcaggaatccagattctgggaaacaaccctggtgttacacaaccgatccgtgtgtgaggtgggagtactgcaatctgacacaatgctcagaaacagaatcaggtgtcctagagactcccactgttgttccagttccaagcayggaggctcattctgaagcaggtaagaagtctgtggccagatatctacacatttgaacattgggatgaaaagagatrgaaaatctgactgatgcagaagccttccatgctacacagaaacttgagggtatggcaggtggaaagaagcctcagcactctctctggtggagcaatttttggcgcaacgtgcgtgggcggtgacttcaggaatggtgcaaacccacctgggcacttgacttaccactcactttgttatgaaaggggttatctcggtgttccagacaaaattccaattctaacatcaggccaaatttgtgccaaatttcacactagtgagtgtttccaggcatttattaaaatggacagtgttcattgcaatcttcagcattgcagttgctgaggtatgtggccgctgagtttgtcatcctggggaaacctaatatgatgatatttattccatctaatcctggggctatttggcagtaaataccacagaatacactatttctctggcttatttcagtcttaggtaggctctgcacacctatgcttggaaggcaggaatttcttggtgttcttgtgccttcttctcatggaacgtgcatctttggtgtgtgttgagaggaagggtagtagacttctgctttgttgcaatgcaggatgctggaacaagaggattccctgtctctactgtaagggaataagattttagcctccatccttctctaagaagcaatgtgtctttgcctccaagtactagatgcaggaccatgaactgccccgtccaccagaagcttaaggctttggcttttcaggagcaatcatctagggaactgtgcagggttttcatgtctgtcccctactgacagccaatcaccatacagcctgcataacctaatccatcatcgtctggtttcctgcctcattgttttcatgaacaaccagtagagagccatacgaaagagcttgcacatgagtctttgttccaattgtaagagcactgataggtccttttcccaccaggttttgaatataaaatttctaagaacttattaaaatattagaatgytattaatctattgtttttgcttcagcatgtccttctgcttgtgagtatactaaagagaacagtcataattctgaaactactgtcctgtttgtgtcataaattgcttcacatgtttctgcatactagtagttactcagcttgattttgtctattttcagcaccaactgagcaaacccctgtggtccggcagtgctaccatggtaatggccagagttatcgaggcacattctccaccactgtcacaggaaggacatgtcaatcttggtcatccatgacaccacaccggcatcagaggaccccagaaaactacccaaatgagtatgtctttgatgttacttgtaagaggagcaacagccaacttaagttcctcctagaagagccttgcttcaagctaacttgttaggacaaatttcccttagacccagaaggtgtgtcaaaatgtccagacaactttgcttttgatcaaagagtctgagagaataggtattttaggcttgctatcttttctaatagtctgatggaagcagaaggctacatggagctgatgaggtctttttaatataaagctcaagagatcaaatgatcaaatacttagagtgccattctacaaggctcataaaagatcaatgcactctttcacccatgcaattctatcattctaacctcccttctctgaaatgaaggctttttgccatttttgtcatgggtcacaagtaaataattcacatgtatatgagtatatatataaccaggtgtgtttattcagactagtatgtatatatatacatatatatgttcatataagttagtattcatatatatgttcatatatatatgttcatacagactagtattcatatatatatacatatatatatacacacacayatatatatatatatatatgttctagggaaacatgcaaggtttttatgtctgtccctgactgatgaccaaataccctatagcctgcacagctgcaagctgtatagccatacaatttgcaggacacacacacatacacacacacacacacacacacacacactaacwtataatataatataatataatataatataatataatataatataatataattaatatatataaacctgtgtgaacacactgggttctaagctccagttttctgaagggatatgggttgccaggagaggaagagcaaaagcaagaatgtagatgagaattaggaagtaaacagayatggagattaaaatgggcaggtacatggacaaaaaaccaggtctgacaaaaactggctttctgccataaatgactataaaagatattaaaaaacactttccacatgttggacaagagacagtacaggactgagataatttagaaaaggaaatgaatgagcgcaactccgtaactattatgactttcttcctggagaaccttcctggactgaagggcaaggaattggagccaaagccaaccacagcagtcttgctgaactgaggaaagagactggagtttgggatagctaagaaaatgtgtattttctatgctaggtaataatgagaaagaatttgtggtgaaaaggagctgaaggaatatgcatggaagtctaatataaactgcatatgcacagggagaaattctacaaagtgggacagagaaccactactggggaaaggacaaattcagggaaacagtgagctcaatggtgacgccagagctcacgtagcactgggggataccggggttctgatcagyccgaggagagacacctcattgaacatctcgggcattcagtagagaccccagaaaagtcatactttaggagtaggatttatgccttcttagaataaagactaccccagaaacaccctagtaaagcttaaaaaccaagtctaaaaggacccaaatgatctccaagtaaattaactgcctgacagaagaaaactcaaccatcactggaggtaaataacatgattacagtgctctgtaatgttgcattcacaaggagtgacatcatttaaaaatttatgaggcaggaaaaagcaattagtgtgatccataactaggagaaaaaccagtcaatacaaatagaccaagaaatagtagaaacgatggaattgacaaagaaattaaaactgtatatatgataattgtgttcaaagatttaaagaaaacatgaacatgagggaaacaaatgcagaatataaaaaaaagcaaatgcgtaaaacaaccaaatggaaattaaagaactacaaaaaagtataaccttaataaaatactcactggatggccttaatattagtttatacattacagaagaaaaagtgaaccagaagataactcaatgaaagccatacaatctgtaagacacacacacacgcacacgcgcgcgcgcgcacacacacacacacacagagagagagagagagagaaagagagagagagaaaggctgaaaaaaataaatagaaccttaaggatatcagtgaaaatagcaaaagatttaatatatgggtaaagcaagtcacagaaggacgggaaggagatattgggacagaaaaaaatactcaaagcaatgatggctgaagactttacacgtatgaagaaaatgataaactcacagtcaagaagctcaatgaatcagaaatagtatttttaaaagcaaaactctatgatttacttgggtacattatagataaatcgtccaacatcaaagataacaaggataatcttataagccagaggaaaacaatatcatttacatagagggacagtaatgaaagtgaccgatgccttctccttggaaayaatggcataacatctttaaagtgataaagagaaataaaaacagatcaacctaggacgacatgtccagccaaaacaaacaaataaacaaaaaaaccctttaaaataaacgtgatgtaaatacgtattctgccacctccagaggaaacaagsaaaaaaacaaaagaatgtttccaaggcaggcttctgtattaaaagattttaaggaaagttattcaggtagaagaaaaataataccagatgggaactttaatccatactaagtaatgaagagccctggaaatggcaaatggcaatgtcaatataaaatactcttatttatctaatttttaaatgtatttaaaggacaatttgtgatattaattaaaataataggaatatattgttgtttcaacgtatgtagtagtaaaattcataaaaacagtagcacaaataatgcagatgataactggaagtatactgttaatgagttttttgcattatccatgaagttatataatattaatagatggttgaatgtgatagtttaaggtgggatattataaatcctaggacaaccaaaaaaatttaaactgagaggaatggatagtaagaggaatagtccttttatgcaaaagaaggaagaaaaagaggaataaagaatataaaagatatggtgtaaacagaaaatacatagcattattgtagacacaaactgaactaccttatgagtatattaaatataaaaggattaagcattacaaataaaaggcagagattgtaaattgaataaaaaccacagctaagtgtgttctttttagaataaatactctttaagtgtaaagatctactttaaacaccaaaatatgaaaaaggatatataccatgaaaacctgaatcataaataagctggagtggtgattaatggatgcaggcactcctaaagactaataagtgaatgtggtcaaattgaagaaacaaaagtatatacgtgctcaatgtgcaaaaactttttctgtatacatgctatgatcctttggaaaattaaagttttaaagcaatatcactgacaatagtatcaaaaccaaaaaatatttagtgataaatttcacacactatgctcaaggactatacaccttgcactagaaaacaatgttgaggaaagaattaaaagatctaaatatacaccatgcttatagattaaaagactccatatcagttctcgtgaaattgatctttggatgaaacccacacccaagcactattgcaacagtccttttttggaaaaaaaaattggaggacttatataccttaatataaagacttataaaagtacaggaatcaagacatgtggtattggcctggccccttggctcatgcctgttaccccaacattttgggaggctgagtctggaggatggcttgagcccagatgttcaagaccagccttagcaacagagtgagaccctctctctacaaaaaataaacaattagatcgatgtgatgacttgcacatgtagtttcagctactcggaatgctgaggtgagaggattgcttgactcaggaggtctagccatgagtgagcattgatcatgcctctgcattccagcctggatgatggaatgagacactgtctcaaaaaaaaaaaaaaaaaaggatatgtgttattggccaaaaaagtatgcaaacctaaaaagggatggcccaccaccagacccacatacatatatggtaaatggattttccgtatagatggcaaagcaattcaatggagacaaaaatgttttacaaaatcattctgaaccatttggatatccatgatacaaaacaaaagcagaacttgacttttgcttttcatctcaaattattttgatatctcttccacctaagtgtcagagctaaaactgaacctgaaatatgaaagttccatgaaaaaatataaaatcttcacaaccttggagaaggcaaacttttttgaggcaggagtctgtaaacactcactataaaataaaacaaattataatgtgggctttcatgaaaactcatgcttaccaaaagtcattgttaagaaaataaataggcaagtaacacatgagaagaaaaatgctctctgtccatatatctgacaaatggcttgtgtccagaatataggaacatttctcccactcactaaacagaggacaaacaactaatgggcaacagattgaataggcatttcttggggatagatagatgtacacatagccaataagcacctgaaaaaatgtccagtatctcagccatgaaaaataaagagttataatcatcatgagatgtcaccaaacacccaatggacatggatattattaagaagacaccacagtaactgatgtcactgatgtagagcaaggatgtgaaactctctcatatgctggtgaaagtgcaaaatgatacaaccacttttgaaatcagtctgatagtttctccaaaagttcaataaatgcacttttaccctacaaacctgcaatcctgtttgtgaatatttaccccacagaaatggaaacataagtccacgaagacatctccaagaatattcatagcagctttattttttataaccccaaactgtagacaatttcaatgtcaatcaataagaaaatgaataaataatttgtgaactagtcatayaatggcatactgttcagcaataaaagggagcatgtttttgatactctcaaatagtatggaagatgctcaaaaatattacattaaagaaagatgccagataacaaaaatgaacattatgtatgagtctattgatgtaaggttccagaaaggtaaaactaatttctggtgaaagaaaccaatatcatttgcctctggccatgggaagagagtagcagagattgattgagcagtaaaacgaagtttttttctggggtgatgtaaatgtcctgtattgtgattgaagtgtgagttacacaagtgtacatgttcatcagaagtcatcaaactacatctaagatctgtgcatttgactatacatgaaaatatacctcagttgaaaatagatcaataacctccctcatatactatacttgctaacacagccagctgcttggagaaccagcttgctggaatggagaatctgggcttgagactgggtcacatgtatagagtctctacagagacaatgttgcattcccacggtacataatacatttcaaggtttctcagacagccacatgtcatgaatgtgaggattctgagaggttggagcaacattcctgggaggaacgaaggggagcacattctccaagatcccccaccaccggggtcctcaccggctgtgcttttttttttttttttcttgacagagtctcgctctgtcgccaggcaggagtgtaatggcccaatctcggctgattgcagcctccaactccagggttcaagagattctcctgcctcagcttcatgagtagctgggactacagatgtgcgccactgcgcccagctaatttttgtatttttagtagagacggggttttgccatgttggccaagatggtctcgctctgttgacctcgtgatccacccgccttggcttcccaaagtgctgggattacaggcgtgagccaaagcacccagcctgtgcctctyacttactcaattgtttttctgaaccctccatagctggtggaccttttcagatcccatagtctagccagccctctcactttatgccttgggtcccactgttccttcatctcatcccccttctgtcagtcccgcagtggctgtggccagtagaggatggactgagagtaggagaggaggttctgcccaggaacccatcctagagaaacagcatcctgcctgggacctagtcttccaggtcagcttttataagtcttttagactcaaactcacttgacccacctgaagtggtattgacaataatgctattttcatggttgtttttcactgtaaatgcagagccttttagctacacgactagtacagagagtaagggaggctggcctgggaatgatatcatcttggatggcatttcctccttggagaaatatatgttagttccaactcacatgttactatacagtcctgtagaaagagatacagagagttagacaggtatagacgcatttgtatatgcataacaatctataagacacacatcaaaatccgtataccggttcctctaggggtatgtgcttggcagaaggtagaaggagggtattctggttcctttcttttgcacatttatgtatgatctcagtttttatatggagcattgatagggtttggctatgtccccacccaaaatctcatcttgacttgtaatctctataatcctgataatccccatgtgtcaagggcaggaccaggtggaggtaactggatcatgggggcagtttctcccaggctgttctcatgacagtgagagagtctcctgagatctgatggttttgtaagtgtctggcatttcccctacttgcacttactctgtcctgccgcctgtgaagaaggtgcctgtttctcccttgccttctgccatgactgtaaatttccagaggcctccccagcaatgtggaactgtgagtcaattaaaactcttttctttgtaacttacccagtctgtctcgggtatttcctcatagcaatgtgagaacgggctaatacaagcatatactacttttgatattttaaaataaaaattatcatctatctttgaaaggcatgcacaaatgggaagttgaggaacatttgtgttgtggcaattgtatgatacctttaatgggaatatttcaaagacacttgttaagactttgttagaacaaaatgtagagggtgctggatgtccctsaatattcttccgcctcctgtaacttgtattgctttggaatttccagtggcctgacaatgaactactgcaggaatccagatgccgatacaggcccttggtgttttaccayggaccccagcatcaggtgggagtactgcaacctgacgcgatgctcagacacagaagggactgtggtcgctcctccgactgtcatccaggttccaagcctagggcctccttctgaacaaggtaagaagtctgtgtcttaccttgtctagcacatacctctctatgtgcttggacaacgggatgaaaagacatgaaaaaccacactgatgcagaagcctttagtgctacacgggagctcgagtgttggttgaggttctgccatgaccaaggaagtctcagtgccgtccctgggaaagccagagctgtgatttttggcacaacttgtgggagtagtgactttaggactggcgcaaaacctccagggtgctcaacttaaccactcaccttattctaaaatgggttatttcagtgtcccagtcaaattcctattctaacatgctgtcaactgtgtgattatttccaagccaataagcatttccagtaatttcttaaaatagtgttcattgcagtcttcagcgttgtggctcctgaggratgtggcccctgattctgtcrtcctagagaagcctgacatgactgcattgattctgtatcgtcctgggtctatgtggctgcctggctgtctgtaatcatctgttttatttttatttttttctacagaytgtatgtttgggaatgggaaaggataccggggcaagaargcaaccactgttactgggacgccatgccaggaatgggctkcccaggagccccatagacacagcacrttcattccagggacaaataaatgggcaggtctggaaaaaaatgtaagccactttgatttggactctttttccctttgctgacaaatcttttcaaacagaagaggggcagaggaaaatactggaaagacttcaggaggctaagcgtaattagccttagcatggaaagtgcaagcagcacaggccagcaaagccccacgcgtgtgggggttctcaggcctcttctcttttgacatttctttactgtttccattgttgggtgctgtttctcgtttctagtgcttgtcctctaagccaggggtccccactccagtactggtactggtactggtactggaactggtaattatctgtggcctgttaggaactgggctgcacagcaggaggtgagcttcgggggagcaaacaaagcttcatctgtattttctgctgcttcccatcactctcatagctgcctgagctctgccagctgtcagatcagaggcagcattagattatcatagcacaaaccctattgtgaactgcacatgtgaggaatctagattgcatgctccttatgagaatctaatgcctgatgatctgtcatgcttccatcacccccagatgggaccacctacttgcaggaaaattagctcagggctcccactgattttaccttatggtgagatgcacatttatttcattatatattacaatgtaataataattgaaataaagtgcacgataaatggaaggtacttgagtcatcctttaaccatcgccccctcaccccaggtgcacagaaaaattgccttttatgaaactggtctctggtgccaaaaaagttggggaaccacactgctctgggttctagtagtcagagatgccctctatgaggcttaagtcagatttttctagaaaagatttggatgggccatcaggtcaccatgagacttcccttagcctcatgcattctctgtgatggtttactttggggcctatgaatagggaagactgagatataggaaaaaccaaagtgtctgtgttcccccactctcacacccatgtaacataacacttctcacaccagatatggggggatttctcctcacaccccaagcgagtctccagcagataccagctgggtgtcctacaatgtaactcggtcctgacactctatctggagacagtgtcagatcccacaagttaaggctcagtcctacaagactgccccactgcagatgccaatcccaagttscaggctgtgacctgtacttctgcccagctggataaagatctgtttttctatatgaccctccatgggtttgattactttgctagagtggctcacagaactcagggaaacacgttacttttatttacccatttattataaaagatattaaaaaggatcctggtgaacagccaggtggaagagatgcacagggcaaggcacgtgggaaggggctcagagcctctatgccctctccagtgcaccagtccccagtaccctaagtgttcagcaacccagaagctctccaagtgcagtcttgttgggtttttatggaggcttcattacagaggcacagttgattacatcattggccatcggtgatcggctcaccttcggcccctcttccctccctggaggttggagggtggggctgaacagttccaaccctcaagtcacatggttggttcccttggcaaccagcccctggggctatccaggaacccaccaagagttgcttcattgcagctcccttcacccaggaaactccaagggatttaggagctctgtgttaagaactggggggcagagacccaatatacatttcttattctatcacaatatcacaggaagctaaggatgatactgcctttgtgtgtcttggctgtggatggtgcataatgcatggaagtaagcatttctgaatcaacagcaaacaggctttatcaggtagaagacccctcagcgccccagggacaaagctcatcaatgatgtcccactgtcctctgaggctctagctctaagacctccagtgggtcaagctcctggagaagtggcacattctccaaagacccttcagggtcaccacaccctggttaagggtgtggcctcataactccttttgactatgactgatggcttacagcatagaaagaaataactttgtcaaaaaatataataatgatagaaaggaagaaggaacgctcccttttgtcttctaagaatagatgtgaaatgtgtgtgccttrgaatatcttctccctctcctgctccacgtgagctggagcttacatgcctgcttgttttcagtactgccgtaaccctgatggtgacatcaatggtccctggtgctacacaatgaatccaagaaaactttttgactactgtgatatccctctctgtggtaagttgccttctgttttggtaaggaaactgcttccttaatatggatttggaaaaaaaaaagcaaaaaaaacagaaaatggcttttgagctgagtgcttctggggaggagatggctgccctctccaccagagcctgcttttcatcatggccaccttgaacctgccctactattggccccatttgttaggaaaacacccgcccctcccaccacacacacataaataaaataaatgtcaaattcccaaagggcaaacttagaggtgatctaatcagcccgggatagtcccaccgaacccttctttgtctagcgtgggatgcatgaaaaacaaatttagagtcattatgatgaaaaactgtcctcttctgcagctgagaagaaaaaaaaaatacgagcagcaggaaacagctaagcatgtaatgcacattgtaaacctcagatggccatcctaggaaatcaatgaagggtagtgcagctctttagccccagatggcctttctcgtaagattactactcatgagtcccattagcgacattgcttagagactgcttgttaggttccttcctcattgctctgagactcttattgggagtatgaggcttggatcaggggaaggggaattgacattagatcttaaatgattggggtaacaaatccatgggggaaaaaaagccacttgtacttgttccctattttcttcctgctgaccaatcaacttgtctgtccgagttacagaacaccaccctggacttttcttttgtgtaatttggttgcttgtggttgggtctgccatgtgaagggaccttgagctgggggaagaaggttggcctccaagtccactgaagaccagcatcctgagattgcctggggaggtggtacagggcagtgatgaagatcatgggagccacactgcccatcgtcacatttgggccactcctggggagagcaagagggaagaaggagaggttagggtgataggaaagattctacttggccaatattattataatgtggcattgtggtctctggatttagtgtgagttgatagctgacttttttctcgagtgggtgcttttgttctattttgtcggtgctattgcagaagcatcttggtggttcctctacctcaaagtctcttgatggggtcagttccagttctccgcttctggccccatctagtacacgccactgcctctcactgcctgggctctctatccttgacaggctgccttgaatttaagcccagtctgacttacctgcctcaaacacccacagtagtgcctgggactcatgcacctttgactcccatggaagggaagtgcagtagcttcccaggtgcaattctgctgtcctcacccacattgaggatgtatgagaatcaggttcttagagattggagaaagaaggaagaatgggaacaagatttcttccaatggactgtgaggttccccaccttactttgatgtaagacaagtgaggttaaccccaagcctggtgaggagggttcccatcagacacttggaaatcctgaggactgtttcctgcagaaggatgtggttggtgggatattcaggtttgactcatgattgagaaagttagagcctctggttggagaaagagtttaataactatttcatttccaccaacacattcagtacgaataataaataagtaaaaataaatagaaacattcagttttattttgaatagtaggagtagggtataatttctgtagttactcttttagtacaatgatgcatgtttactgtatgtaaggcatactagcagaaattgagctcagcactagaaaagatgattgcattccatgccatgcttcttttttacaaaagacttctatagatagattctcaaaacaacccacagcaaatgaaaagttatttggaaaactcaggttccagattcactggagtgtagaatctctggttggttggggaggaatttcctcttgcagttgttattaataattatatgaataattattaactatattaatatttatagttttgaagaccttgaagggctggagacaacagagaagcatttttgaacaccctctgtagcccctgcactgttgtaggcattgatgggtggtaccaaagatgggacactttccctacctccagagaccttgtgggcttgctgcagagagaaggcagggaggaggaaaagaagaatagaggcacatgtgtgtaaattacccccacagcagtcagttagtcatgggaggctccccagaagaactgtcctgaagctggctgagagaaggcaacatttcaacataggacagttatccttgctacataaaatcacatacacacatgcacatatgtccacacacagagactcacatgcaaaagaatcctttgtgcctttcagtaaactttacatggtttagaaagaacttatatttccttgaaaggagagtgtcctttgttgtttactaccactttttaaacttagaaagaaaaatctaaagagtgtttatsattttaccatttaatttcacctttgagatgtgaaaaactagtgcttggaattcgtcctgaattaaacgacacaattgctaacttggactcaaatgcgacttcttttcccaccttgtgccacagcatcctcttcatttgattgtgggaagcctcaagtggagccgaagaaatgtcctggaagcattgtagsggkgtgtgtggcccacccacattcctggccctggcaagtcagtctcagaacaaggtaagaacaggcccagaaaccatctatactgtccttccatgtaagccccacaaaacccttctacatttacacagaacccacacagctgatgcatcaatacctgcctctctgttttctgaaggaggaaaaaatatagaaaaattaaaaaaagttatattattataggttctctacttggaaaatagccaaaatacaaatctttttcttgatctgggcagttccatcaaaatctgtaggcacagtgatttgcaccaagttccaatacttttggaaaatattgaagatgctctgagggtttctatggatatccattgtctcactgtcagatgaaaagaaagggaagtttttagaaatgtgacactttgcagtgagggaggacaagagcaaacttacctacagtctatcacaggcacagatttttttttacacttttgtgaatcattgaattcaatgccgaggctattcatctattcacaaacacatgaacaarttatgggttgtgatccccataaatgaagagtaatcagtccgaacccacagaacctggacattttgggtatcgtttcagtggaacatgcaattcgtaagttcagtttgcttgggtgtctcttaggaagaacacataggacacagacccatctgcctgcatgttttgcttcctcatctcctttctacaccagggcacctgtgctcaattgctgttctcctctaaagagacttccttctgtaagtttgtgaaatgccatcgacaaacctgatcgcatcgcatttcactctgctgttgagttgatttttctttactttatcgtttgtaacttcttgctctacagagctttcaccttccacatatttcagattcattctttcctaaactgtgtggtggtctatgtcctcactgactatcaacatactgccatcatgcacttcctatctctattcctcttcgttgcaatctggctccaagtggctcacaccattattctgatctatcaactgcctacacagtcctagaaagtaagtgagtcaagaaacatcccccaaaagtaaacttttcaggtaagatcagaagaccctcatgagtcactgctgctcaggatcgtatctggctccttgaagagtgaccttgcatagatcttgtcataaaaaatgaaagagaccttgggaaggtcttgggctggtcacttttgtcagagtccagggctgtggggtgaaagccrcagctatagagcttcattctggagtcacttagctttgctctcctggggacaggctgtgcctattcttgcctcaggcatcaaaaaaagtggcacagatgggcccttctgaaaaatctcactactggagcacagctcgaagtttctactatcctgacgttgggcggtagtcctttgctttgggaatatgaacatgatcaaaactgagtgaacttgtcttcctggctttctgtacaatgaagtagaacaaaccatccaatttgaccaaagycttggcatgttttctttctaggtttggaaagcacttctgtggaggcaccttaatatccccagagtgggtgctgactgctgctcactgcttgaagaagtaygtttaagggaaaactgacatggggtcttatcttcaagacttttttcctccctctcttcctccatcccttctttcttcccaccctccccttccttcctccccacctctcttccttttctggaaggaacactaggaaccagggaatgcatgcagaatcctgaggcagaatttccagggcaattggatgagagaggagggaagtgtttctagagggaatctgcagagggaagacccagtgcaagtgattttttggacctgtataaaccgcaggacagagctgttcactaccagaggcatcaatctgtattgcattgctctagagcaatatctgaggctgaataatttataaagaaaagagtttaattggcacatgtttctgcaggctttacaggaagcaggatgctgtcatctcctctgcttctgtgtgggcctaaggaagattacaatcatggtggagggcaaagtgggagcaggcatgtcacatggccagagcaggagcaagagacagagagagatggggtgggggtgctgcacaataccaaatgaccagactttgcaagaactaagagtgagagctcactgatcaccatgaagatgtggcccaagccattcaagagggatgcacctctatgatccaaacccctttcacaggccatagctccatcactggggactacagttgaacacgagatttaggtggggacaaatatacaaactatatcacagtctctgatgaaacagattgagaacagaccttaactgtcagtttccagcaaattgtgaattttgtttcttgccactcataagtcactgattctgggtggccgagggtgtcagagggacagcgccaagttcatggcacagaggatacctgaaggggctggaccatatttttctcttgacatcctcatcttttctaggtcctcaaggccttcatcctacaaggtcatcctgggtgcacaccaagaagtgaacctcgaatctcatgttcaggaaatrgaagtgtctaggctgttcttggagcccacacaagcagatattgccttgctaaagctaagcaggtactcgctcacctgtggtcttcaccccacgctggtgaagatatttgctttatgtctgggttttatgggccatggccactgcatggcagtggggaggaactgtctatcacatgaaaggctcaagggctttggggacagcatcaatcttcaaccccagccctgccacatgttagttgtgctctttaaaaaggcagaaggattcgtttcctcacgtggaaaaagagataccctgttacccgtaaaacttacttaatgttcaccagttcatccacattcatgatcagggaaaggttgttattccaggctaactattctcctttcataataatatgctggagagaatcaaatgagattgcatttcaaagcgcttgaaaaaccaccatatcgagccatgcttagtgtgggcgcctctaatcactgctattcaggaggctgacgaggaagaattgcttgagcccaggacttcaaggctgtaggcagctatgattgtgccactgcactccaggctgggtgacagatcaagaccctgtctcaacaaaagaaaagaaaacaaaacaaatgaacagaaatattccacaatgtcaaaaaaaaaaaaaacccacacaacatacaatttacaaatgcaaataataatattattgttgtcttctttgattttctctttcctggtgaaattttgttttattaagcctgacaaagtgatacctttgcttacrtcacttaaagttagtctatttggacctaggtgacagtacaatcagctaagaaacagtatttgtaggagaggcaggtttgggacaggtgacaaggcatgtggggtgctcgctgtgctggtggctctggaaggcagggtgtcaatgcagacagggatgagcatggcctggttgggaaggcatggggcaggcaggagcctgagctgctctcctgggcctggtcacaagcccatggcagcttctctgggtctgtgaactgaggggtgatgtcctggaatcctctgacactctaggaaggagagaagggcctttctggctcagcctttataaacagtagctgatctccctcttgctccccagggtcctccccaccatcccagcaaatgtgcaaatacaagatctctgctcctcatggtcctcagagagctggggtgttctgatggcttgaacaagtcacttaggaaatgtggggttttggaggcattctctgataggctgatacgttttgagtttagagttcccaccgcacatccccacacccctagagtctagggcatttagtgctccatgagggaacctgtagagtgaggacatctgcatcacaggctgggccttctagtgtccagaagcagaaagtgtgtctgcttcaaagttggtgctaatgatgatttttggtcagaatacggcatttctcatttccattcctttatccccttgaacttactaaagtagaatcaggtctaaaaaccagagttctaatctttaagagtccctgggattctaaggtatatgaatgtccttggaaaacaataccatttagttcatgcaaggtgcttatttcccatcctctttcatttgatgtctagcattttactgcattcttaccaccacggtttagtaacattcacgaggaggaagtggaggatccagatggagcaacttgctctgggcacacaaggcatttgcaattttataccctcttgatgatgtctcagccagacattctgcccagtcatcaatgccctcttcaattaatatgaaaggacacacttggcatgagattccaatcgtgcacagaatatacatgagaagtgtgcctttgtcatccctactttcaaaggctaaggccaccctcagtttcttgcatgcaactgatgcctttcaaatgaaaccttacatctgtgtagtccataggcaaccacaggcaaatgtgagggtgaaacgctgtgttctacattgttctgtgtcagtgaagcaaggcagtgccagctcagagggctctggggcttcaaggcagggatgcctggttgtaggtactgccacttccagctgggcagtgaaacataactgctaatactttccttacaggcctgccgtcatcactgacaaagtaatgccagcttgtctgccatccccagactacatggtcaccgccaggactgaatgttacatcactggctggggagaaacccaaggtgagatcaattccattgcccacgtaacaaattgtttttgaccttcagtgcatgttacaaaatgagcattttggagatagttgtacaaattcctacccatgaatgtggtctacccactcctgactttgcctggacacctgtctatgtctccataatcagtcttcaagggacttgggcaaggggagcggtgccatttccttgagtctctctcttttttgttttcagaatcttttaattttttttgtaatgattgtatgtttcccttacaacaaaaacaaacaccagtagaggtctttgagtctcttaatcataatttcagcattcatattgcttccccaggtaagtggggttttgacccagccctcaagttaagggtgttagattatttttcatgtgaaattagacagactgcgtttctaaacatggtgcaaaacagtaacgacaaaagttgtaattaaactattcttcttcccaaatacccacatgtctaatgtgtgtgtgagggtgttaggcaggggacctgaagctgggggagaggcagacagttcccatggccccaagtctaggatggcatttggtattggttgatgggtgagagcaagagagggaatatttttgtgcatgatgtggtatcagcacctgtactacattttatggattccttcttctctttgcggtatgccctgacaataattatatccgtcagccttacccccttggcagtaggaaaactraaactgtcttaaagtctcagctctactttctcagaggtgcaggcaagggcactgggagtctggggccctggaaaactgttctgactctgccacttgccagatagacctgaactagacacgttacctctttgtaccacttggctctaatcccttatctgtaaaaccagcattttcaaatggtgctttgcacatcagccttttgcataagctttgatttgataaaatgttttttgtgtttttaaaaagattaaaaaccacaggtttagataatttcaaagtaggcttccctttttctgtcattttcctattatttttaaaacctcacctccttgactccttgttccctttttctgcactgctgagtctgggagcactgaggccaggtaaaaggaaacttggcaaatgaggggcacctatgggtgtgggaggctgctcctggtgtttgcatattttaaartttaaatgctacaaaccactgtgagttaggtattattgttcctattttaccattgaggaagctggggctcagagaaggtggagggtggtacagacaaacctgaattggaaccctggctcctgcctatgggctgtcaggacttagaaaagtcgtgagctctcgctgattgtttcctcagctgatgtgggctgcagggctgttatgggggaaataataagaaagtgcatcaagtgctgagcacatcctaagcactccatcatggcagctcctactactaataaagaatagaattatatctaacatgattctttcttgcaagtgacagaaaatccaactcaaattggattaagcaaaacaagggaaattcttagtgagctgcaaagttttcaggctcacatgatggccccaaatcccaggtcctcccaatcatggagtaggcactatttgggggcacaaaggtgacattcccatggctgcagatgctgtggtgctgtggctgtaccgggaaagaataagaaaggccactctcccaattatgtgaacaatagtctgcccactctgagaagtcaaacttgggtcaccgtcctgcccctgaacccatcactgactggctctgacctgcaccaattgttccatgttggaggtgaaggcaagaccccactaatacccataaggggcaaaagttagatagatccttcaagaggattatgggaggtagggcaaaaagctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaccatctccaataccaccatcactgtaaccatcatcaccaccaccatgatcactatcaccatcatcacaatgatcactgtaaccatcattactacccaccaccatcaccactactccaccaccatcaccattatcattaccatcaccattatcaccaccatcatcatcaccagcaccaccatcatcaccagcaccaccatcaccatcaccatcattaacaccatcactatcaccattggtttaatcatcaccaccatcatcataaataaacatcacataaccagggtgtagctgggtgttgaccccagagcccactcactgtttcctctctcccacccccatccacacatttctaaccaccatcctgcactgggctcccagtctcctctggtctcacccacatgtccactgagaaaaggattttcagaacaccaactagaccaggaggagccacatacataactcaggcctgcttatcaactttctacatgttaataatgacatcagatcaatgggtgttctcagcttctcagaaggaggtcaaaattctccccctctccccttcatgtgtccagaccttcccggatttggatgtaccaagtgcagagtggtgttgaggccaaggggctcatccatgtaagtctcatctgcaatcactgggctgatcccgtggccctgtctccagggcgccatcagagagggcttcaatcctcaggttacctgtggcccaccctgccctcagaggtgccatctctacattggccacgagatggcagcacatactcatagactgcattaatttcccagcaactcctggtgggttttccctcttatcaggatgtttgccttgctcagagagcaaatctgagagcagtgacacctaacttaactttcagcaaaatattttgagaagggtgcccctttacacatctgtgcagtccaggtgatgcatcccatgcccaatgctcggtagtcaggaggagcttcctccatgcagctctgcggaagagactcttccacgctgctcatgtaaactccagattcggtgtcagttttctgacaccgaagacaatgatctaagtgcagtcaagggctttggggaaagcaggagagagtgcctcagttctagcctgtgccatgcttgcaaagttttgcaaaattctaatgagagctgggcttgcaacattggaaacttggattatttgtgagagcactgagaaatccctgggcatgtccatctggaaaaacagcatttcctctggcactttarcagaggttctgtttcaatttggcgaaggaaattaagcagtttttcacaaaagaagaactacaaygaggagaattgtccctagtatttcttctccctaattgtcaaggaagtgtaaattagaaaatgaatcaggacaatttccacctactatgttagctaatattttaaaaattgaatatcacaagggtgaggcaaagtaattgttttccagtgacattttccactgtcacacccttttagagaataatttggcaatgttactgtgagatagaaatatgtctatataattatgggaactgagayttcagaaagtaataaggaataagaatgaaatttatgaacaaacatgtggaaggttggaagcaagagtggggccaacacgcatggggaggaagcatttgggcagygactccgcagacccagactcaagctgagctatacaacctccttacgcctcagtttcctcaactgaagaacaggaatgacaagtgcctgtttcataggaccgttgtgaggattaagtgagatataccacattatgagcttgtgcctggaaaggttgattcttagtaaatgatgactattcttttttattgcaataaaatttatacaacatagagttactattttaaccatttttgcaggtaccactgagtggcattcagtacattcacaatggtgtgcaaccgtcaccatatttccaggacatttttctcatccccaaaggaaacctcatgcccattaagcagtcactcctcattaaaatattagttatgaagactgtakcatttttttaaaaactcatgatataacattgattgaaaaaatcagtataggaaattgtgcattatgatgtaatagtaaaagaagcatataaaaatctgaaaaaagtatataaaaagaatagcaattgtatttctcagactctctttacattgtaaaaatcattttgatagcttcaaaagaaaagcaaaaagtacacaaacaacaaccaaccccaaagcagcatgacaaagcccagattgttgaatccaggtcttgggaacataaaatcttatatgacatttgcactttaatgggtcagagagtccagtggcattgggagctgccttgtgttctgcagcctcacggacagacaggaggtccagctccactgctctgttcttctggaatttcctcgtgaacaagctttggcctcagtaaccatttctttcatctttttaaacacaggtacctttgggactggccttctcaaggaagcccagctccttgttattgagaatgaagtgtgcaatcactataagtatatttgtgctgagcatttggccagaggcactgacagttgccaggtaagaaaagatcaatagatcaaagtcttgtgctctcccgtctcagtctcagtcccttagacgtcagtcccaaagtggcaaattcaggaaggttttgtcagtggaagaccccagtctaagtgttgctcagaaactccccagatctgtccctgaatgcatattcagatcatctaaggagacgtcttggggcttgagttccagatccatagcaagggagccgtaagtgccataactacctcaggccactcaccttcctggtgtgtgctggtcaccagtgactgaagtggtggcttttccagtagagaggaaggtagagggtacaggaccgagacaaattacacacacttaacaatgatgtccaggctagcccagtctaaaggaaacaccaagttaggaagcaatgcatgcaggattcacaagggattattttttttcccaggaaaaaactaagtgatgtggttttgttgaatagactttgctaagtacttaagcactgcagatgcttgagtaatatgctcataagttcctttctgatttgaattactgggaaaatgtacatatggataagagaaggatggcatcccatattaaaaggttggcagcttaaagctcacatgaattttcccctacctctgtttagggtgacagtggagggcctctggtttgcttcgagaaggacaaatacattttacaaggagtcacttcttggggtcttggctgtgcaygccccaataagcctggtgtctatgctcgtgtttcaaggtttgttacttggattgagggaatgatgagaaataattaattggacgggagacagagtgaagcatcaacctacttagaagctgaaacgtgggtaaggatttagcatgctggaaataatagacagcaatcaaacgaagacactgttcccagctaccagctatgccaaaccttggcatttttggtatttttgtgtataagcttttaaggtctgactgacaaattctgtattaaggtgtcatagctatgacatttgttaaaaataaactctgcacttattttgatttgaattaattttggttttggtcttcaaaattttcatgctcttttcatcccatctatttttatttttattttttagactttacgtcctggggtacatgtgcagaatgtgcaggtttgttacatagatgtacacgtgccatggtagtttgctgcacccatcaacctgtcatctaattcggtatttcttttagttctatccctcccctagccctccaccccttgacaggcccaggtgtgtgatgttgccctccctgtgtccatgtgttctcattgttcaactcacacttatgagtgagaacatgccgtgtttgtttttctgttcttgtgttagtttgctgagaatgatagtttccagcttcatccatgtccctgcaaaggacatgaactcatccttttttatggctgcatagaattccatggtgtatatgtgccacattttatccaatctaacattgatgggcaattgggttggttccaactctttgctattgtgaatagtgccacaataaacatacgtgtgcatgtgttttcatagcagaatgatttataatcctctgggtatatacccagtaatgggattgcagggtcaaatggtgtttctggtgctagatctttgaggaatcaccacactgtcttccacaatggttgaactaatttatgctcccaccaacaatatcaaggcattcctatttctccacatcctctccagcatctgttgtttcctgactttttaatgatcgccattctaactggcatgagatggtatctcattgtggttttgatttgcatttctctaatgatcagtgatgatgagcttttctcatatgtttgttggctgcataaatgccttttttggagaagcatctgttcatatcctttgcccactttttgatggtgttgtttttttctggtaaatttgtttaagttctttgtagattctggatattagccttttgtcagatggatagatggcaaaaattttatcctattatgtaggttgcctgttcactccgatgatagtttcttttgctgtgcagaagctctttggtttaattagatctcatttgtctattttggcttttgttaccattgcttttagtgttttagtcatgaagtcttctcccatgctatgtcctgaatggtattgcctaagttttcttccagggtttttatggttttaggttttgcatttaagtctttaatccatcttgagttaatttttgtataagtaatgcccttctttgtctcttttgatctttgttggcttaaagtatattttatcagagactagaattgcaatccctgcttttttttttctttttgctttccttttgcttggtaaatattcttccatccctttattttgagcctatgtatgtctgcacatgagataggtttcctgaatacagcacaccaatgggtcttgactctttattcaatttgccagtctgtgtcttttaattgggggcatttagtccatttacatttaaggttaatattgttatgtgtgaatttgatcctgtcattatgatgctagcgggttattttgcccattagttgatgcagtttcttcatagtgtggatggcctttacaatttggtagtttttgcagtggctggtaccaattgttcctttccatgtttagtgcttcgttcaggagctcttgtgaggcaggccttgtggtgacaaaatctttcagcatttgcttgtctgtaaaggattttatttctcctttgcttatgaagcttagtttcgctgggtatgaaattctgggttgaaaattattttcttttagaatgttgaatattggcccccactctcttcgggcttgttgggtttctgcagagagatccactgttagtctgattggcttccctttccgggtaacccaacctttctctctggctgcccttagaaatttttccttcatttcaaccttggtgaatctgacgattatgtcttgaggtggctcttctcgaggagtatctttgtggtgttctctgtatttcctgaatttgaatgttggtctgtcttgctaggttggggaagctctccttgataatatcctgaagagtgttttccaacttggttctattctccccatcactttcaggtacatcaatcaaatgtagatttggtcttttcacatagtcccatatttcttggagcctttgtttattccttttcattctttatcctctattcttgtcttcttgctttatttcattaagttgatcttcaatctctgatatcctttcttttgcttgatcgatttggctattgatacttgtatatgcttcacaaagttcttatgctgtgtttttcagtcagatcaggtcatttatgttcttctctaaactggttattctacttagcaattcatgtaaccttttttcaaggttcttagcttctttgcattgggttagaacatgctgctttagctcggaggattttgttattatacaccttatataatagcctgatataactataagatttttttgtaagcaccatcgtaaccacaaagcaaaaacctaaagtagatatacaaaagataaaaaggaatcaaagcataccactagagaaaatcacttaatcacaaataaagatacgaagagtggaataaaggaacgaagggtctacaaaacaaccagaaagcaattaacaaaatggtgatagcagatcttacctataaataattatcttgaatggaaatggattaaattttccaataaaaagacatacagtggccaaatagattaaaaaataagatccaactatatgatgcctataacacactcacttcacctgtaaggactcaaacagactgaaagtaaagggatggaaaaaatattctatgcaaatggaaacaagaagatagaggggtagttatacagattgagtatcactaatccaaacatctgaaatctgaaatactccaaaattaaaaatgtttaagtgccaacatgatgttcaaaggaaatgttcttcggagcattttggatttttgtgtttagggatgcaaaaacagtaaatatataatttgtattagtccattctcacactgctataaagaatactacaaagagactgagtaattataaaggaaagatgtttaattaactcagagttccacaggcttaacaggaagcatggctaaggaggccacaggaaacttataatcatggcggaagatgaaggagaagcaggcaccttcttcacaaggtggcaggacggagtgtgagtgtgtgaaggaggaactgtcaaacacttataaaaccatcagatcttgtgggaactcactcactctcacaagaacagcatagggaaaaccgcccccatgatccaatcccctcccactgggctcctcccttgacacatggggatcatgagggttacaattcacgatgagatttgggtgggacacagccaaaccatatcataatgcaaacattgcaaaaacaattcaaaattcaaaacatttctggtttcaggcattttggataagggaaactcaactcaacatgaggtaaagcagactttaagtcaaaaactgtaaaaagagacgaagaagaatgtaataataaggagatcagttcattacaaatatatagcaattataaatatatattaatatatatacccaaaattgtagtacctacatatagtaactaaaacaaacattaatagatctcacaggagagctacactgtaatataatcatagtagcacacttgaatagctccactttcactaatggacagatcatccagacagagaatcaatatggaaacacgagacttaaactacactttagccaagtagacctaacagaaatatatagaacattccatccaacagcagtagaatacacattattctcaagtgcacagggaatattctccagaatagatcatatgttaggtcacaaaactagtcaaaaaatgtaagaagattgaaatcatatcaggttttttttttagatcataatcgtatgaaactagaaatcaataatgggggaatattggaaaatccacaaatagatagaaattaatcaatatgctcctgaacaatcaatgagtcgaagaagatattaaaagaggaaattttaaaaaatcaagacatgagttcatgtcctttgcagggacatgaatgaagctggaaaccatcattctcagcaaactatcataaggacagaaatccaaacaccgcatgttctcactcataggtaggaattgaacaatgagaacacttggccacagggcggggaacatcacacaccagggcttgtcagggggtgggaagctggtgaagggatagcattaggagaaatatctaatgtaaatgacgagttgatgggtgcagcaaaccaacacggcacatgtatacctatgtaacaaacctgcacgttgtgcacatgtaccccagaacttaaagtataataataaaaaaagaaatatttgtttttgatttatatgccaatcagacaaaatgtgaaaagccctactgaaattaagtatcaccatgaaagataaattctggataattttttcaagttttaacaatgtagctttaattggagaaagctatcatttggaatgagttaatctatcctatactaaaataagtcacttgctttaaaacataataaatatgattttgaattgaaaacaaaaacaactcaagacaaaggaaaatggacacactaacataccaataatttatagtatgcagcaaaagtggttttaagagggaagcttttaccaataaacacttccattaaaaaagaagatctcaaataagcaacctaagattacacctcaacaaactagacaaagaactaactaacccaaaagttagtagaaggaaagaaataataaagatcacatcagaaatagtaaagactaaaaaactgataccaaaaagaaataaaactactagttggttttcaataaaataacaaaattgaccaacttttagctagattaagaaaaacagagaatactcaaataaaaccagaaagaggagacattacaatagatactacagaagtacaaacgatcataagagactactatgaataattacatgccaacaaattggataacttagaagaaatggatgaattcctagagcaaaaaacctacaaagactgactcagaaagaaatagaaaatctgaacagaccaataatgtgtacatgattgtatcagtaataacaagtctcccatcaatgaaaaggccaggacctaatggcttcactgctgaagcataccaaacattacaaagactaatatcaaccctcctcaaactcttcttaaaaactaaaaagaaggaatgctttcacattcattttatgaggatagcattacactgatactaaacacagaaaaataatacgctaataaaagaacattacaggcaatatccctgataaacatatgtgcaaaaatccgcaacaaaatactagaaaactgaatccagtagcactttaaaaagatcattcaccatgatcaagtgcgatttgtttcacgaatgcaagaatagttcaacttacacaaataaataaatgaaaggatggatgataaaaatgtgtatctatatatatatgttttatacacacacacacacacacacacacacacacacacagaggaatattattcagccttaatgaagaagaaaatcctgcctttgcatcaacctggaggacattataataagtgaaataagccagacacagaaaggcaaatactgtgtgatctcgcttacatatggaatctaagaaagtcaaattcctagaaatagagagtagcttagtgattgccagagccgtggaagggggaaatggagagatgttgatcaaaggatacaactgtatagctttgcaagataaataggttctggagatctaatgtgcagaatggtgactagagttaataatactgtattgcatacttgaaatttgctaaaagagttgatcttaagtgtcctcaccatatacac

SEQ ID NO: 12228 - DNA, 185248 bp, Homo sapiens
aaaaaacacaaaaaacaacaaccacaacagaaatattttttagagatggggtctccctatgttgcccaggctggtctcaaactcctggcttcaaattatccttcaaattatcagcttcctaaagtgctgagattataagcataagccactgcacttggccaacacttggttttgactttggctttgtttggctctcacttgtaaatctctcatgaaggtattactgcctctccactcctactgtcactgatatagttgagaccttcagaaactcttgcttggatcattgcagtaactaactgatcctctgccaccactgtcttccttcatctgttatgtgccacactgctcatagattgcgggtttgaaaccaatattgtcatattgctcccaggctcaaaaaccttcaatgacaccaactgtctggagaatcagactcaaatgcattagcctgactttcaagttgcccattatttggccttcagttcctttcccagcaccatgtcccagtgcacctcaccacacacatgcgtatgcacacacatagacacacacactacatttcatttcccacttagattgaggtttcaggggttaggcatagcattgggtttagggttgaatctaagtttgggtttgtgctaatcagccttcaagatgatcttcagtgattcctgcttcctggtatttatgccattgtataatcctctcctacagtgaatagggccaatctgtgtaaccaataggatattgtggaaatgttggactgtgtgtgatagttcgttttatttataaccttgacttgaccatggggtgcccagaaatttggctagacattatttctgggtgtatctgagaggatgtttcccaatgagattagcatttgaattgatggacttgacatggtagatttctcactgccccaccactgtggatggggcatcatctaatctattgaaggcctgaatagaacaaaaaggtggaggaagggaaaatgtgatctctctgcctgactgtttgagctagaacattggtcttctcctgcctttggattgggacttaagtgattggtgctcctggtactcaggccttcagacttggactggaacttaaaccattggttcttcttctggaactcaaactggaactacaccactagctttcctgggtgtccagtttgcagacacacatcataagacttctcagcctccaaaatcatgtaagtcaattctttacaataaatctctaatgctcctgttctactcttttagggaaccaattatatgcacgtccatcccttgaatgtcttctccaatctgctaatcttttttatttctcattcattctctgagttttagaataattttttcttttcttcttcttcttcttcttttttttttctttttagagatagggtctcactctatcacccaggctggagtgcagtggcgtgatcatagctcgctgcagtcttgggctcttgggctcaagcaatcctcccacctcagcctcttgtgtagctaggactacaggcatgcaccaccatgttcagttaatttatattttttaaatttttgtaaagacagggtctcactatatagtccaggctagtctcaaactcctgttctcaagtgatcctcacacctgagccttccaaactgctaggattacagccatgagctactgatctaggcatagaaaaaattttaaatcgtttcttcagactcactgacttaatttcaggcaacatccaatcttctgttaggtacctctgttgcctttttagactccatagatatatttttatctgtagaatacttttatgttctaggattattttctaagaactgctttagagagtcaatagcctctaatcttatgaatattacaaagtaaccattttttttcttttaaattttggcctctgggcagcaagggtgagatatccaggaacatttgctctaattcctcatgtcaatatccttttgacctgctagatctttgtatgtgttcagtcattattctctatttgctcatttttacagaaggaggtctttatttgttcaacactgagtgttaagatgggttaaacagtctgtctaaatatttttggcctggacaaagaaagaaggggaaagtttmtatttactatacctttactttgccttagtaaagagtcagcaatctgtggcactagtggggaagtgtcagcccagggcaaatgtgaccgtgtatctctcctttgtgtcagatgtctttttgtgtgtccacatttgttttagcagtcagatttaactgaagaaacaacaccttctttaacaagcccagctggccttatcagggggctgtgcttgggggtgaacctgcttaattgagcacatctcctagtgtgaagaggcattggtggatactttagcaggcttaagctttgcttccttataaactgcatccatggtccactattatccccttgaaactggcagggatcataatgaatgtttggttccttctacctccaacttgaatgggcttttctcctgcttggaatacaccatggttcgtcaggtctactctcaatatggtttaaactcaatgtatcttgcagaaattcctaaatgtttctggactggtctaaagggcacccttccttattttccatctgtggggcagaggtttttttctcttttgataaacctggttctccctttcctttatcctccttcacttggccaaccaagtcatgcctcaagtctcagcttaaaccctgcttcctccaggaaatggccctggaagtttctgcaagtagacaccctatgctgtgctcttagaatttctcatattctgccagtcatagagctcatcttctggaattcgaactctgtcttcccctgtagattgtagtctacagagcaaggacactgctcattcattcattcattcattcattcaaaaacggagccaagtatatgtgagtactaacactgtttttctctcctgcccagtgcctgttacagattatttagttaatattcactggaaggatttatggccagcttcagggaaccaggcctgagatggtggctgggtgagcaggaagaatgctggaacaccagtggttggggcttcaccgcagacccagggagcaagagagtcataggtggagggagctgagacctgccaacctgggctcgtgccctggggttggcctgcagtgggaactacctcacagggaccatcgtacgaagagtgagccagggctggtcattgtgcagaccctctgatgctgtgctaagaaatctcagagagccaaaggaaaacagtgtgtctgtttccatggaggctgagacctccatggctagagttttgcaccagtgaaccattattctggaatgcagtgaagtgtttatgcctataaactttgcagtcagcctgggagactcaagaaggttacagaaaagttatcagaaggccaggcatggtggctcacacctgttatcccagcactttgcgaggccaaggcaggcagatcacttgagctcaggagtctgagactagcctgggaaacatggtaaaaccccatctctgcaaaaaatacaaaaattagccaggcacggtggtgtgtgcctgtggtcccagctacttgagaagctgaggtaggagggtcacttgagcccgggaggttgaggctgcagtcggttgtggttgcactactgcactccagcctggacaacagagcaagaccctgtttccaaaaacaaaaagttcttagagcctcagtttccttttctttaaaatggatatatgactagtacctcatagggtcattgtgataataataataattattattatctaataataatattattgttagtttgtgataataataataactattattagtttttgagacagagtcttgctctgttgcacattgtggtaattaaatgagattatgtgtgtagcacatgagcctgctgtttggcatagggtaaaagtttaataaatgggaattattattatcctgtagtattgctggtcgatacggtttggctgtgtccccacccaaatcccatcttgaactgtagttcccataatcctcacgtgtcgtgggagggagctggtgggaggtaattgaatcatgggggcagttatccccatgctgctattctcatgataatgagttctcatgagatctgatggttttataaggggcttttccccctttggcttggcacttctccttgctgctgccctgtgattgcttccccatccaccatgaatgattgtaagtttcccaaagcctcctcagctatgctgaactgtgagtcaattaaacctctttcctttataaatcacccagccttgggtatgtttttattagcagtgtgaaaacgggactaatacctgggaattattttcaatgcatctaaaggggatgagaggagcaaagttttgcttccttttagatgtacatcttcccctacgtcttagaacttctggttgtgccagccagtagccagtaggtcctgggccagcacctacccagatttcttcttatttttacatttttatttatttatttttttgagagggagtctcgctgtgtcgcccaggctggagtgcagtggcacaatctcggctcactgcacctccacctcccaggttcaagtgattctcctgcctcagcctcctgagtagctgggactacaggtgcccaccaccatgcccagctaatttttgtgtttttagtagagacagcatttcaccatgttggccaggccggtgttgaactcctgacctcaagtgatcatccgcctcggcctcccaaagtgctgggattacaggcgtgagccaccgtgcccagctgacctacccagacttctcctggactgcgttgcagcacagaacagctgggtttcccctaacatgctacatctctatagatgaggcctaaagctgccatcacccatgtgagaaggccaggaatcgcagcactagccagtcatacctaattacagtgaaacatcctaagataaaatgagttacccagatatcatcgaaaagctacatttagctataaaaaaattatcctgggaccaagtggagaggaatgtagaccacagaaggtttaaaagagctgccgatgggctctttgagacttttgtgccaaaattgaggtgtctaaattacggttcttgtccaatccattagaccaactctcttttgaagcctgtccaacatgtaaggcttggtgactggatttggggtgagggctgacttttgtgttttttttttcttttgactggatgagagtgagggggctaacttgtaggtgttttgcctgacaaactgggtagatggagatgctgccagttgacgttttgggagggtgaacagatttggacaggcaagaaactaagtctagttttgaacatagagactttttaaaggtgcttgaggggtgttgaggtagaaatgtctagaagataattaaaatgtggatttggaacttcatatagagtcacatgaagatgtagaattagaattgtaaataaggaggggacaatggcagttgtaggtagggacaagatagcccagaagtataaagtagaatgagaagagaactaaaaagaaaagcatgaagaattgttatttggggagggaaagcaaaagaagagaagtcagcaaaagaagacatgaaaggccaggtgcggtggctcatgcctgtgatcccagcactttgggaggccaaggcaggaggattgcttgagcctaggagtctaagaccagcctaggcaacatggcgaaacactatctactaaaaatataaaaattagctgggtgtcatggcacactcctgtggccgcagctacttgggaggctgaggtaggatgacagcttgagcccaggaggttgaggctgcagtgagccatgatgatcacaccactgcactccagcccgggcaacagagcaagaccctgaaagaaagaaagaaagaaagagagaaagagagacagagggagaaagagagaaagagagagaaaggaaggaaggtaggaaagaaggagaagggaagggaaggagggaggaaggaaggaaggaaaaggaagaaggaaggaaggaaaagaaaagaaaagaagaaaggaaggaaggaaggcaagaagaaaggaagagagaaagagaaagaaagagaaagaaaaaagagagaaagaagaaagaaggaaggaaagagggaaagaaggaaagaaagaaagaaaagagaaagaaagaaagagggaaggagggagggagggaaggaaggaaggaagagaaaaaaatcagagaaggaagacaaaagccaggggctagatgttctaccaccagacatctgaaggagacctttaattcactggaaaagaaatgcaattaaattttaaacacatgaaacatactcaacctcactcatgatggaagaaatacatgatcaaaaaatgaagtggtaccattttttttaaaggttttgtttttcttgttttttatttttttaattttaccccccaaaagaactacttgaggcttcatttttttagagcagttttaggttcacagcaaaatgtagaggaaagtattaatacaaatatttcccatccctctcctcccccatgcgtagccttcccggctatcagcaacccccaccagagtggtacattagttgcagttgacggacctacattgacacatcatgatcacccaagtccatagtttacattagggttcactcttggtgttgcacattctatgggtttggtcaaatgtataatgacagcctggcatggtggctcagacctgtaatcccagtactttcggcagctgaggtgggtggatcacaaggtcaggagttcaagaccagcctgaccaatatggtgaaaccctgtctctactaaaaatacaaaaattagtcaggtgtggtggtgtgtgcctgtagtcctagctacttggaaggctgagacaggagaattgcttgaacccaggaggctgaggttgcagtgagtcgagatcacaccactgcactccagcctgggtttcagagcaagactccttctcaaaataaataaataaataaataaataaaataaacaaatgtttaatgatatgtgtccatcatcatagtatcataatggagtaacttcactgccctaaaaattctctgtgctcagtgtattcatcccttcctcccactaccccctgtcacatagttaaaatcatatagtatgtagcctcttccggttggtctttttcatttagtaatatgtgtttatgtttccttgtttcattttcatggcttgatagctcattcctttttagtgatgaataatattctgtcatctggatgtagcagtttatttatccattcacctactgaagggcatcttggttgcttccaagtttgggcaattatgaataaagttgctataaataaatatctgtgtgcrggttttttttgtggacacaaattctcaactcctatgggcttttttttaaagctatccaattggcaagaatggtgaagtttaacactgtgttggagaggatgtggggaaataggtaatctaaaatagtgaagacacataccctttggcctggtaattctccttccaggaatctattggacagatatacctacacatgcatagagggaggttcgcacaaggatattctctgcagcattatttgttgtagcaaagggttggaaagaatttaaatgtctgtcaatagtggacttgccaaataagttatggcacatcatttcagtggttgtcatatgggattaccaaaacaaataaggtcacccaataagaattgatatggaaaaatacccaagatttttgttgttgttgttgagatagagtcttactctgtcacgcaggctggagtgcagtggcgcaatgtcagctcactgcagccttgacctcccgagttcaagccatcctcccatttccacctccctagtagctgtgactacaggtgtgcggcaccaggcctggctaatatttttgtatttgtagagatgagatcttgctatgttgctcaggctggtctcaaacccctgagctcaagtgatcccttcacctcagcctctcaaagtgctggaattacagccactgccaggccaatacctaagacatttgaagtgaaaaagtcagtaacaggatggaaaatggtgtactaccattgatgtaaaaatggataagggtctatccattttttggagccagactgccttggcttaaatcccagctccaccactttctagctttgtaacctgggaaaagttgcctgttcctcagtttcctcagctgctgccctcagagggttatcagggaaaggaaggagtttacttctcccttttgtatttttaaatattttaaaaccatgggactatgttaacctatttttttcttttcttttcttttttttttgttagacaatgtctctgtcacccagactggagcacagtggcatgaagatacctcactgcagcctccatctcctgacctcaagcaatcctcccacctcctgagtagctgggactacaggcacctgtcgtcatgcctggctaatttttaatttcttgtaagacagggttttgctatgtcgcccaggctggtcacaaactcctgggctcaagtaatgcccctgccttggcctcccaaagtgttgggattacaggcatgagccacagcccctggcctacctaattgtttttttttttagttgagatgagattttgctacattgcccaggctggtcacaaactcctggcctcatgcaatcctcccacctcggcctcccaaagtgctgggattataggtataagccactgcacctggcctacctcattttatttcaattaaaaattctaatcaaagaagatacacaagtagcaaataaacacgtggaaaagacgctcaacatcatcattagggaaatgcatattcaggccacaatgagataccacctcatacttattcgtgtggctaaaatgataaaggctgacaataccaagtgctggtgaagatgtggagcagctggaattttcatgtgctgctggtgggaatgtaaaatggtacgatcactttggaaaacaagatggcagtttcttatcaagtgaaacatgcacccactgcaccttcacagtgacctgcaatttcagtcctaggaattgacccaagaggaataaaaacctacgtacttgaatgttcttaacagcttccttcaaaatagcccaaaacttgaaaccaccccaaagttcatcaacctggaaatggatagccagactggtatatccatacaatgatataaaaagaaatgaactgctgatactcggaacaacattgatgaattacgctaaatgaaaacatttacattatactaagtgaaagaatccagaaacagaaaccttggctgggcacgtcggctcacttctgtaatctcagcactttgggaggctgaggtaggtggatcacttgaggtcaggtgttcgagacccatctggcaaacatggcaaaaccccgtctctactaaaaatacaaaaaattagcagggcgcggtggcattcacctgtaatcccagctacttgggaggctgaggtagaattgcttcaacccgggaggtggaggttgcagtgagccaagatcctgtcactgcgctccagcctgggtgacagagcgagaccctgtctctaaaaacaaaacaaaataaaacaaaacaaaaaaccccacaacacccaaatactgtatgcttctgttacagtaggcaggcagacatgagcagggcaggagagggctccccccgatccacagaccaggactgtcaggcgacaatcaggtgatggtcaggcagctgttaagctgttctctaaaataataattggtcacagccagggccagggaaagacagtctaccaatagatagaaagacctgaaactagtgaagagcatcttcccaataagctcttgggagttgagcgagtggactcaagcatgctcattaacaggcaaaatggcagagtttaactgatatatggccttctaggaacatttggccagtaagggaagaacgcctcaagtaggcatatgtacaactccagtaaacacagtatgcatgcagcccctcccaagcactggcagatcactgtacatgcagacagcccaccctaacagaagaatcagggaacagatacaagaccctggaagtatgccaacatataaaaccctaagtcaaaaggtccaaccatgcacttgagctctctcaagtcgcctgcttggccctcttccaagtgtaccttccttgcttttgttcctgctctaaagcttggtaataaactttccctcctgctctaaaaattgccttggtctgtcactctaccttatgtcctttggatgatttctttcttccgaggaggcaagaattgaggttgctgcactcatacagattgactgttacagttccatttatagaaaattctagaaaaggcaaaatcatagtgataagaagtagattagtggttgctagggagtaggagtagggagggcttgagagcaaagaggtgcaagggaactttaggggactgaaatattctatattatggtcgtggtggtggttccatgactgcatattgtcaaaactcaaattggattaaagaaattgtgaatttgggccaggcacagtggcccatgcctataatcctagcactctgggaggccaaggcgggtgtataacctgaagtcaggagttcgagaccagcctggccaacatggtgaaaccctgtctctactatgaatacaaaaattagccaggtgtggtggcacgtgcctgtaatcccagctacttgggaggctgaggcaggagaatcacttgaacccgggaggtggagattgcagtgagctgagatcacaccactgcacaccagcttgggctacagagtgagactccatctcaaaacacaacaaaacaaacaaaacaaaaaaacaggcttcgtctaacaactatacattttttttagaaggatggcctggcctaagaggctcagggacagaggcatggcctggtctctaatgtttggtgrmagggaaattaaacaggatgaggctgggaagggcccatttggttggatgcttttgtggcccttttgctggggcatcttggtgggggcgggatggagtggatcccaaactgtaaggagtaaaagagtcaatgtggggtgaataaggggaggtagccatctgagatcaacttccaagaaatttgtctgttcatagataatggaataaacatgacccaacctttctggttacaaaagaaatgcagattaaaaggacaacactgtgacttatctgcttggtacagtctgatagcctgggcagccaaagtggtgtgtaatctttgtagaaagcaatttggaataaaaggactctctcttctcaaagcgtaagctctaggccgggtgcggtggctcacgcctgtaatcccagtaacttgggaggccgaggtgggaggatcaattgaagccaggagtttaagaccagcctgggcaacatgacaaaaccccatctctactaaaaatacaaaaattagctgggtgtggtgtsgcacatctgtaatcccagctactcgggaggctgaggcatgagaatcacttgagcctgggaggcggaggttgctgtgagccaagaccgtgccgctgcattccagcctgcgcagcagagygagaccctgtctcaaaaacaacaacaacaacaacaacccaaaaaagtgtaaactctttgacctggctgctccagtaggaatttatcctaaggaaatagtttggcaaaggcagtggtgaatcaaagtgtcatttataacatatacctatagaaacaacctatgtatccagtaatagaggattggctgagtgaaataatggtttattcatcccagaatttgctctcagctttaacctgttttgacctacacaatcgtgtgttggaggaaaggattggtgagtgggaaatggggatgggagggagatttttgctaaatattcttttctaccttttgtattttgaaccatgtgaatctattacctatcaaaaagttaaaataaaaatgttaatatgataaaaattatgatcttgagctataattgccaacatgaaaagccatttatgatacacaatttagtgggaaaagcagattgtaggacagggtgagcatatttttgtaaaaaaaatgtatatatatacatatttacatgggtaaacactgcaagagaaaagcaaaatgtcacctatagttgtgtctggatcgtggattttggtgactgtgggtttttttctcttttatatttgtattttctaatttttaaaagaatgatgaatgaaggtattgtataatttaaaacacacactttttggacattagtgggaaaactggtgaaactgaataaagtctatagttcggttcaaagttttgtaccaacattcatttcttagttttgacaaacatcccacggctctctaagccacagtaacatcaggagaaactgggtaaagggtatacggaaactgtccatactatttttgcaattcatccatagagctaaactgatttaaagcaaaaagccttttttgtttgtttgtttgttttaaggaaattgggtcttgttctctcgtccaggctggagtgcagtaacacaatcaccgctcattgcagcctcaacctcccaggtcaagtgatcctcccacctcagcctcccaagtagctgggactgcaggtacatgccaccatgcccagctaatttttgtatttttttgtagagacagggtcttgctaygttgccagggctggcctggagctcctgggcacaagccatcctcctgattcactctcccaaagtgttgagattacaggtgttagccactgagcctggcccaaaaagccttttaagaaaagtttttagccaggcacagtggctcacgcctatgatcccagcactttgggaggctgaggcaggcaggtcacttgaggtcaggagttcgagaccagcctgaccaacgtggtgaaaccctgtctctactaataaaaatacgaaattagctgggtggggcagtgcacatctgtaatcccagctattcaggaggctgaggcaggagaatggcttgaacctgggagacggaggttgcattgagctgagatcacaccatagcactacagcttgggtgacaagagcgaaactccatctccaaaaaaaaaaaaaaaaagttgtgtttaaaataagtttacttaactgggtgtggtggcacacacttgcggtcccaactactctgcaggctgaggtgggaggattgcttcagcccaggagttcaagactgcagtgagccaaggtcacaccaccgcattccagcctgggtgacagaacaagatcctacctcttaaaaaaaaaaaagtttatgacatagaaatgtctcacaggcaggctgggtgtggtggctcatgcccgtaatcccagaactttgggagggtgaggtgggtgcctggccaacatggtgaaacccagtctctactaaaaatacaaaaattagctgggtgtggtggtgcacgcctgtaatcccagctacttgggaggttgaggcgggagaatggcttgaacccaggaggtggaggttgcagggagctgaggttgtgccacagcactccaccagcctgggcaacaagagtgagactccctctaaaaaaaaaaaaaaaaaaaaataggaggggagccgtgggataacaagggggatgaacagcgggtgggaatgggatagggtagaagaggcacccccttctccaacgttggagggaaaagaataaagataagaggggatataagtgaagtttcactcatgccaacacaccttagttttctctggaaggtcagggccagctcacctgctgaggcttatggtgatgagcaaagggtggggattgtgaacggcagagaagttctggaatccaaaatgagacatgcaaatcaaattacatgaaagaacactgttttccaattatcccaggagataagtcacttcaaaattgttaaaattaaggagcccttttggcctccaacccctatatattgagtcagaaattccatggaagagatctgatatcttcatatttaacaagcaccccaggttcttgaggagtgtctgagggacactaaggtaaaggaatgctgaaccctggccgctgaaagtgtgctctgaggaccagtagcttctttttttattttgttttgctttgcttgagatggagtttcgcccttgtcacccaggctggagtgcaatgtcaggatcttgactcactgcaacctctgcctccagggttcaagcaattctccctcctcagcctcccgagtagctgggattacaggtgcccaccatcacacccagctaatttttgtattgttagtagagacggggtttcaccatgttggccaggctggtctcgaattcctgacctcaggtgattcatctccctcagccttccgaagtgttgggattacaggcgtgagccaccgcgccaggccaatgtccagtagcttctgcctcacctgggagccggttagaactgcacacctcattccagacctaacagatcagagtgtgcattttaaattggatccctaatggttcatatgcagatcaaagtttgagaagcattatgctaagyaactgctgtaaccataaatgtgtaactgatcaattggtataattacacaattttccccagcggggctaatgagcccactagccgaaagagagaaactcccatttgcactgttccagggttgcaagggtgaaactgtagggaggtgttgaatgcatggctaaagtgtttgactattaggtctcctatagaaacaagatggagagggcggatgagctgggagtttagggaaggccgagggggtctggagattccgattgggtcaagaaagagggtagagaacaaaagtaggaaaagtggagggggccgggcgcagtggctcacgcctgtaatcccaacactttgggaggccgaagcgggtggatcacttgaggtcaggagttcgagaccaacctgaccaacatggtgaaccccgtctctactaaaaatacaaaaaaattagtcgggcatggtagagggagcctgtaatcccagctactcgggagactgaggcaggaaaatcccttgggccccggaggtggaggttgtggtgaaccgagatcttgccactgcactccagcctgtgccacagggcgaactccctctcaaaaagaaaaaaaaaaaaagtggagggatgggaggtatttcaaatcaaaggtgtagctttgggaatgtgtggctaccaaagactgaagaggaaagttactggagttgagaaactcaaagaattgttaggtctcctgattgagtggtccattcagaattcaagtacaatttgctcaagatgaggacttgggcttctttgctcggccactgctcttyggggaatccacatggtgtgggtggcacgcacctttatccaggatgggcacatgactcaaacatggccaatgagagtgtcatcctctgactgctgtgattggttgaaagctgggcatgtgacccaaacaggaccaatcagaatcccttgctgggtttgatatatgaatgcaggctgaaggaggatctcgttttcttagatatgaatgagctggaaaagcagtagaggcttagaagggtgagtggttgtcaggggtgagtgattgtcagaggccatctttgcaccctgtggagagaagtgatctcagaagaaagttaaggagatcaggggaatggaggagggcgatggatgggaccctgatgactgaacattgcgtccatctgcccttaaacctggatgcatctagatggttaagtgagtcacaataaccccctcccccactctttaccaaaaccagtgtgagctggggtgtctgccacacctgaaaaagcacaaataaggctcggtgccgtggctcaggtccgtaatcccagagctttgggaggccaaggcggtaggatcacttgaggccagtagttcaagaccagcctggcaacacagtgagaactcatttttacaaaaaattaaaaaaaatttttttttcttttaattagcctggcatgctggtccatgcctgtagtcccagctactcagaaggctgaggcaggagaatcgcttgagcccaaggagttggggcttcactgagctatgatggtgccactgcactccaacctgggtcacagaggaagactccatctcaaaaaaaaaaaaaaaaaaaaaaaaaagcctaaatgtaaggagcaaacagggcagcaggggctgaagtcttcgggggatgtaaacggtcctggatgatgctgggtggtgttggcaagggtgaaagaagtggtatgttggtgctgggggcttcaaaggaggaaggctgtaaatagtgcagtggaagtggcagagacagcctgggaaaatgtcaaggtcaccttgaggaagcctatggacaaggtagcagactgcagcctccacacaaagcctgacattgaggcaggaccatcaggaccagagatctgtacacgaactgaacctggcccttattcgggtttaaccctgatcctgaccacagattgacccctgatcctgactgcactgggctctcctctggccattggctcaccctcgactcaggccccatgccaagctctgatcctgtcctttttctctccctcctttcatactcagtgtaaagaccctggtgcatgctggctggcccatggccatcataatctctccttatttcatgagctgtatccatccctcgccaaggccaagaacattattctaagatctcaagccatggcccagaaagccatatccagttttccacttaaagaaggagctagtgacctcctaaatcctcgtctctttttcaacatctctgcaccaagggaggatgtgatgaggacactcccttgactcccaagatattctgtaaggccatcaatttccataaactgtccattgagggtgggctggcatttgcctgccctactccccagatctgcatgaatgtgggggctccttagatgtccagtttggtygtttttcaggtgcccagccttaagcccgaaagtttaagtcaataatagcagaccccagaaaactcccttgaggatcttcaggagttacaaagcctgagttgcatttattactattattttaaagttcaagatatagcagctttaaaaaccagaagatcccagaggacatttccctgtggtcctaaaagttctttacagcatctgcctctagggcagcagaggaaaaaaattgtagttggcagtgcttacccaaccttagcccattcagctgcctgtaggcaggcttactaatgtctgatgcatggtaaatacctaatgttataaaaacaacaacaaaagcccaacactaaaatattctgctgaggatctttcatgagtcaggccctctgccaagtgctcagaatcaaccttatctcattttatcctcaaaataagcttaggcagtaaaaactgttattacccacccctgcctccacctgcttttatggatgagaaaactggggcagagactggttaagaaactggcccagagtcatacagctaataagtgttggaacttggatttgaacaaggtagtctgacttcagggcttaaaaaataattatggatcgcttcttggccttttggctaagatcaaatgtaaaaaataattacaggatacatgtgtagtagaatggatggatggatatgtgaatggatggatggatgaatggatggatggatacgtgaatggatgagtgagtggatgaatgaatggatggatgagtggatggttggatatgtgaatgaatggatggatgagtggatggatggacagacacgtgaatggatgagtgagtagatgaatggatggatggatggatatgtgaatggatggatggaggaatggatgcactgttatgtgaatggatggatggatgagtggatagatgaacagatatgtgaaaggatgagtgagtggacggacggatggatggatggatatgtgagtggaagagtgagtggatgaatggatgaatggatggaaatgtgaatggaaggaaaatggatgaacaagttaatgtcagatgattcagaggctggaggtattcagggggcagaagtgtgttctgaggctgrcagggatctggggactgactggctgcagaagattggcaggcaaccacagatagccagcctccctgtcttgccaaaactccctttgcttttcttctttttctcaagtttgtacttgaatctctttcacgttgctgggttggaaaatcctctgagctggcttgagataccccatgtaagaaaagagagcccagatggtatctcctggaagcctgtcactgctggagtaatggctggtctttattttcttctttgtgcttttctgaaatgcccagttttctatagtgtggaatggggtatctattgttgtgctaaaccttggtggctcttgggcaatcattccttaccctcctcttttaatgtgacttttagggggagggctgctctcccaattcagaagtacacacaaaatccaggcctggcaacccacaatgttttcattcctttggccacagtgattggttcaagaaaagccccatgacctaagtatgtccagtgcaagcccattcaataatttggggttttgagatagttgtaagacagaagttctctttctttgggtgaggggagtgctaagagacagtacacatatctagggtttctagcacccatcttgacactgtatggcaagtatgtctgagaatggagctaacataagggaagacaaatgagagagagaacttagagttcagatctcatcttctgaattcctggatccagccatacctgaagcagagacccatggacttttcaattatgtgagcctatatgtatttactttttcttaatgcaatgtaatttaggcttttaccactcacagacaagattccaaacacaatgcttactacttttctacaactacaaataaaaatgtatttttaataatgttattaccagtcatggaggctcatgcttgtaatcccagcactttgggaggctgaggtagatggagcccaggagttcgagaccagcctggacaacatggtaagactcatctctgcaaaaaatacaaaaattagccaggtgtggctactgactatatgcttgcctgtagtcccagctacttgagaggctgaggtggaaggattgagcctgggaggttggggctacagtgaactatgatggtgacattgcactccagcctgggtgacagagtgagaccctgtctcaaataataataacaataatactgttgttaaaaaagaacaaaagacaactgtcagatccctgagtacatgcaatcatttaacaaagagagctgttgaacaacagagtttgtcagacaaacacctgcccatctggccagaggtatgagcagatgaggctgggaagattcccctgggaatgttcctggaggagggcgaaggagcgttttaacaatcagttctgtttcacctcctcctgctgctccttccagcttgcasctgggcacaatggggcaccttcagtctgcagcccgcaattagagcacatgtctcgggaatcctgctgatccagaccccttctccaccctgggcctgtcctgccttgggagtgaaggagctagaactgttcctccgtttcctaggaggtagcggtggctgcgtgagccagaggtaggcctggaggggacattcccagggcagccaccctggggaatgccaggccgatcatttcttggggatgcctctatggaggaggggacagagccagaaagatatttgcaccttgrggacatttctttgaatgctaggttgcttttaggatgtgttgtgaacatccatgcaacacctgtgttaacacscactcatcattttctttcttttctaagatttttttctargacaaggttttgctttgtcacccaagctggagtgcagtggcatgagcatactcactgtagccattgggaggcagagatgggagaatcacctgagtctgggaagtcaaggctgcagtgagctgtgatcatgccattgtactcactctaccctggagtgaaacaaacaaacaaaaaaagcaaagcaaacaagtgggtttctactgccacttcaggtgagaaatagctccttgctaccaagttttccaaatgtcctgtgtacctctagtcacttctactttcttctccactaccccagccccaggccagaagtttctgctcttctaacttgctcagttagaactatgctcttctaactgtgctcagtgcatcttgcttttctttataatttcacttattatttttcattaggtcaactcgctctcttttcatttaaataaatttagtttttggattttgtatttttttaatcacataactcttttttttttttagatggagtttcactcttgctacccagggtggagttcagtggcatgatctcagctcattgcaacctccgcctcctgggttcaagccatttttctgcctcagtctcctgagtagctgaaattacaggcatctaccaccatgcctggctaattttttgtatttttagtagagatggggtttcaccttgttgaccaggctggtctcgaactcctgacgccaggtgatccaccctcctcagcctcccaaagtgctgggattacagaggtgagccaccgcgcccagccacgtaactgttttaaagtgcacagttcagcagcatttattatgtcctccatgccatgtaaccaccacctctatctagttccaaagctttttccttatccccagaggagactctatatccattaagcaatcactctccatttctcctccctgcaatctgctttctgtctgtgaatttatccattctgagtatttygtataaatggaatgggaccatatatgaccttttgagtctgctggctttgttcacttagcgtgatgttttcagggttcattcatatgtcagtagttcattctttttaaactttttgttttatttttatggatttagggatacaaatgcagttgtgttacacggatatattgcattagtagtgaagtctgggcttttagtgtagctgtcacctgaacactgtacattgtctccaataggtagtgtttcattcctcccaccttcctacctcttggagttcatttctttttaatgggtgaataatattctgctgggaatatacttattttatttatttatttatttttgagacagagtcttgctctgttgcccaggctggagtgcagtggtgcgatcttggctcactacctctgcctcctgggttcaagcagttctcctgtcyagcatcccaagtagctgggattacaggtgcaygccaccacacctggttaatttttgtatttttagtatagacagagtttcaccatgttgrccaggctggtctcgaactcctgacctcaagcgatccacctaccttggcctcccaaagtgctrggaatacaggcatgagccactgtgcccsgccaagttaaggatctttagatgtggaaaatatcttgaattatctgggtgtaccctaaatgtaatcacaagtgtttttattaaaaggaggcggaaggagatttggcaacaacagaagtcaatgtgatgactgaagtaagaggcttctctgctggctttgaagatggaggaaggggccaggaaccaagggatgcagttctagaagttcgaaaaggcaaaaaaccagattttcccctagagcctctggagggagcacagccctgctgatagcttgattttagctccataagattcatttcagagctctggcctccagaactgtaagagaataratttctgtggttttaagctactatgtttgtggtagtttgttacagcatccacaggaaatgaatacagtgctcaataaacgtttgttgcatgaataagtgattgttaaactagtgactaaaggagatgcgttcttctatagtacatgatcttgcactttttttttttttggcaaatctcggtcaatcaattgacttttttttctattgattacattaagcattggttacattaagcagaagaccactgagaaaacaaaggcagtgaagaattgatgctgmtaagttcaaattagatagcaagagagctagagagctacaggctctgaggcagctctctctttgttagaaaagagagacgaacagtgttagaaagtattgaagacatgtgaacatcgaaccgagattttgttttttgctttttggggatttatttttgagatggggtcttgctctgttgcccaggctggagtgcagtggttcaatcacagctcactgtgaccttgacctccytggctcaagccatcctcccacctcagcctcctgagtagctgggactacaggcacacaccaccacactcagctaatttttgtatatttttttgtagagacagggtttccctgtgttgtggctggtcttgaacycctaggctcaagcaatcctcctgccttggcctcccaaagtgctgggattcaggcatgagccaccayactggctgaactttgyttttgcacattggaaaatggactagctttcttattctgtttgtcaatgatatttgatgctccaacttgcaagggaagaccatatagagagagtgacatttgcatctgatcttgaaggaatgcgtgaatgagtggagggtgagtggaggaagagagagggaaccattcagagttgcagataagtctgtgtgctgcctaaaattatcaccgtagggtgagtcctgcaacttgagaaacatggccaaggtgtgatggggcagatggggcagatggggcactgccaagaagtgtctaagcaggaggtgctgtggtccagtctgcacttcggagacattctcttggcatagcctggagtagggaaggaggaaggagagctggaagaagggagattcatgaagaggaggggagcttcctgtcacttcaccttttgtccttattaagtctctttcttaaacgtcagtgtttcggagtctccatctttgactcttttctcttctttattatttttttttgagatgaagatcttgctctgttgcccaggctggagtacagacagactcacaggtcactgcagcccctaactcctgggctcaggcagtcttcctgccttggcctcccaaagtgctgagattacaggtgcgagccactgcaccgaacccttttctcctcttctgatctgcttctcctccatggtgacctaatccacacccctggctttgtcctgcctggatgatgcccatgtctccatctagcccagacctctctcctgagtttttaaccccagaagagactagcatgtttatctaatatcttcccttgtgcaggatcacaggacataggctgagtctgcagtgcctctgttcatcagggaggtggtccatgggtggcaggacactagggtctgggattcagtgactcagaggactagtgagggtggtggctccatttgagaagaccaggggtacattaagaacaggcattcttgtgacttacaaatggagtcggtgtcccttggaatcagtarctcctagctatggcagttgcttatgaaaggggtctgggaatgaagttgttctactctgtcctcacctttgtcctgggaaaagaagscccctcagctgagtaggccggatctgaagctaaagagggctggagaaaacttcaggggcagacacacttagcctctagggaaaagcttctatctgaaaggcagtttgcacagtgcttaagtgcattggctctgcctgctagcctgggcacagcagttactagcagtgtggccgtgagaactctttgtgactccatttcttttcttttctcttaattattttattttattttattttgagataggatctctctctgttccccgggctgcagtgcagtggcacaatctcagctcattgcagcctcaacctcctgggctcaagacatcctcctgcctcagtgtcctgagtagctgctgggactacaggcgtgcgccaccatcatgcccagataccttttcatattttttgtagagatggggttttgccatgttgcccaggctggtctcaaattcctgagctcaatcaatctgcccgctctggcctcccaaagtgctgggattacaggcrtaagccaccacatccggcctccatttctttctttatgagttcctgagctgttagaattacacaagctgatgtgtgtgaagtgcttagcagaatccctggcaaaccataagagctcaatgcatattagccattgttagtattgtcactgtttttataagcgccacaaacttttcctaaatgccaacactgtactctgtcccgtccccatctagggacaaggagataagacacaattcctgcccttgcagagctcatagtctaatgatagaggcagatgtggataaaaaattgtatacagggccaggcaccatggctcatcctgtaatctcagtactttgggaggctgaggcgggagaatagcttgagtccaggagtttgagactagcctgggcaacataacaggaacccatctctacaaaaaataataataaaaaattagccagacataattgtgtgcttctatagttacagctacctgggaagctgaggcaggaggattgctttagcccaggaggttgaggctgcagtgagctatgattgtttgaagtccaggagttcaagaccagcctggacaacatagtgagatcttgtctctataaaaaatttaaatatgagccatgggtagtgacaagcacctgtaatcccagctactcaggaggctgaggcaggaggatcacttgagcccaggaggtcaaggctgcagtcagctatgatcatgccactgcgctccagcctgggcaacagaggcaagaccctgcctgtttcatatatatatatacgtatatatatatataatatataaatacgtatatatatataatatataatatatataatatataatatatataaaatataatataatatattttatatatattatatatatatatgggtgaaagttgtgtaatggtggaagctccaacttcttggggcaagggaagagggtcagggaaaactttacagaggtgctgacatttgcagctggcctggaagggtgaagtggagaaggagggaagacgatgctgggcactgcaagagccaaacaagaatggagacagctggagtttgctgggtgtgcacgcccgtgtgcttggggggagttgagcggctgttggctttggattctcatggccttgcctttgacaagcctactagaagtgttcctccatcaggcagaggctggccaattccacgaatctgagggcacctcctgtccccaccattggggaggaggaggaagctcctgtctgtgctgtgctcaggtagacatcagctgcaagttccctgtcggcaccggctacagccgccagagcccagcatggacgaaagccaggctcacggcctctgtagcccaatcctcacctgcatgggcctggctcctgagcccacttcacaggggagctccctccagtctggggtctctatgacctcctccttgctggctggcatgcctcctggcaatgccctgccctataaggtctggtggaaacaccagatagagcagaggcttactctagccacaggcctggggttgagttggaccagggatgcccaggtccagacagggtccctacagcccctctcttttaccaagactcttgcccttactagcagccattctcatgaagggattagtcctgaaatgtggaccttccccacccatggatgaaggacttcctttagccctagagccagggtatttagcctctccctcttcctacccaaaatgacatcggactcactcttaaaaggtacagaccagaatggctgcaaaataatggagtgataaaaggcaccagctctggtgtcagactgtctggggtcaaatcctagctctgcaacctcttagctgtgtcaccttgggcaagtaacttaatcttttatgcctcagtctcttcatccacaaaatgggataatcatacccattgaatgtgctcatccaagggtcagcacagttttccgtaaagggacagagggaaaatattttagggtttgctggctttgcaggtctgggttgtagctactcaactctgccactgtagtgcatgaatggccataaacaaaacttgaacaaatggatgtggctgtgtaccaataaaactttatttatagacactggaattcgaatctcatatcattttcatgagtcacagaatcttcttcttttgctatttaaaagcaaaaataaaaattcttggctgggcacggtggcttgtgcctgtaatccctgcactttgggaggctgaagtgggaagatcatttgaggccaggagttcaagaacagcctgggcaacatagtgagatcctatttctacaaaaaataaaaaataaaataaaataaaattcttagttcatggtcaaaaacaggatttgctttgcggaacaccatttgcagtcccctatgctaacctatctaggtgcttaaaacagtacctaacaccctgttcttgggttggctttaaacaccaaccaaggatttaatacctgttagccatttcaggtggaaagatgtgaatgtggtatgaagtgggtcatctgtggcagttggcttgttggtgagggacaggccattggtaatggaagggtcagctctgtcttggaacagctgcccagagcatggcccaccatgctccccctccccacccaaagtgacacagacctcaccctttaaaaggcacagacacgaattggatgcaaaatcatggagtcagattgtctgggttcaaatcctagctctgccacctcctcactgtgtcaccttgggccggtaacttaatctttctgtgcctcaatttattcatccacaaaattgaataacyaaatccatctcctgggcccacccatgccccaaagtgaggacactctgacatagtcccagacctccaccwcggcactctgatctccaccaacactccaagggcyctgggccagttctctgctgcctgagggcatggaggacacctttctccagtgtcaatgatgaagaacagtttattcacaaacggctccagcttcagggctggcactttctcctatctttggcatctggcagtagctgtccagccttgacactcaaggtcacatccttgggccccaacccaggctggcagtgtgggtgaaaccctcggctttggggctttggaagagtccttccctctcaagacccgtaaagagctgcatcagtcctcactctggccttcacttgggccagcaccactgcctcggytcccagtctctagtgacgtgctaatagttcargtcccgggatttatctcagcctggacagttgtgagtgttgctgcgtagtacccgatggctcctcctgcgcatgcccmggccccatcttgcggtttaaagcaggctttttggtcagagtatctgaaaagcccagagtggggcagagggtcccctgtgcacaygtctgggggcacccgatccatgtccttagamcatggctggtggtcctgactagatctgtcttctcaaccctgcctcasagctcatccagcatctgggtatctgtgagctggttggaaaaggccctctccaagcgcaaggtattgtatttggggggcggtgtgccgggcacttgggttcctagggctggaggcaggtgcaaagcagagttgaaagtgggtaggtcatcgtctatatccagggctggattgtcctggccctgtgggctacggggagcttctggacatgggggagcctgtttcyaggccyaccactccttggctttctgccactggcggcgggcaatgatagagaagaagtcaatgaagaagacctcgatgatctcgatgacgcagacaacagagcagctcatccacaggcccagctggccaccgaagttggacagaagcatctcaatctgcaagacaggccaagccacaccatcaagaggaacctccccccaagttggcctcacacaggaaccctgattcccaagggagccacgggtcagccccgaccctgcacaggctgggaggaagaagcaggcagccttcctgtttcctcttactctgtgcattccgacctgagacctggctagcctacaacagccctcctagagtaggctggaaccccctaccctgattctgctccccaaggccaggaagatgctcacatttgtaggcccaggacaggtcctggaaggaagccactctactcacactgttggctgggctctccatgatggatctctggttcaggtctttgtagaatatcaagagtttggccaagtctgtcctgcaaaattccaacaggtgaatcaagagccttggcatcctaccagattaccagtcctcagcatggctgtctccctcctacccaagctggcagcatggccaaggcactgagctccttggggatattagaacctggcccataagggctccgtctacaccccagagcatatctccagcctggatctggtccacaggtcattcattcactcaagaactgctccccaacttccagattaagtcagtcgacccagccatactgccattgtaccctgttcttcattaaacattgacatttgtaattgattgattgcaatctcaagtatgtacaggtaatgtacatgagcagggtagttgaggtaatatgataataggcacaatggcaacaagcatttatggggcacttcctgtgttgccaagcactgtcgtaagaactttatgtgaactaactcattgaattctaccaacagccctatgaggcaggtatgtatattttcatcatcctcatttcgcagatgtggaaactgagatgcagattggttaaggaacttgtccaagactatgctgtcaataattggctgagccagtactccaactcatttagatctagcttcaaagtccatgctcttaaccattgcactaaactgcctcttgataggacgatggtgaactggaccatgactcagccaaaagagcaagtattactcagctgtttggtgctacaaaacagtggagggtcgttcttgccagaacttttgaattttcaggaaaagttggaaataatgggttgctttcatgaggctagatttgggccaaggatcagtcaccagcttgcaacacttggtttaatggtttgcaattgcttggtcaaagtctattttctcattagagtgtaagtacctcgggggacagagactatgtctgcttgattgtcctggttcccccagcacctcacacagcacctggcacctagggggtgctctatgaatgttggamgcaagattggccagattggctctcatggcaggcaggcccagcagtgcgcatgagggagatagtgatggcttagagaaatgtgagttcacatggcatgattcacagatgtgagttcaccgtctcccagctttgaggaaatgaatgagtgagtgaatgaaaaggagagggggccaggcttggtggctcacgcctataatcccagcactttggaaggccaagggaggtggatcacttgaggtcaggagttcgagaccagcctggccaatatggtgaaaccccatctctgctaaaaatataaaattagccagatgtgatgttgcgcacctataatcccagctacttrggaggctgaggcaggaggattgctgaaacccaggaggcagaagttacagtgagctgagatcacaccactgcactccagcctgggtgacagagtaagactccataaaaaaaaaaaaaaaaaaaaagaggatttggccatacacatacagaagcaagtgagaaggctgggggctgtggtgggmagagacagaggaacagggtagaggtaacttacttgttgagctttttgtttacttgccggccttggtcccaagtgagaacaggcagcaaccacttctacaayggagagagaaagcgtgggcctgagggtgcctgagaggctagggccagcctcccgcctcaggctccccaacttgtcccccagcctccacaaggtaattcttttccccctggaccatgtcccaggccagaggacacagcaaaaatgtcagtggggctccaggctgggggcttcagtggggaagggtgggcagaagaacttacctccgaaaccacagatggccattgtgccaggcttgtggttagtgtccactctttaaagctaagggaggaggggacagcatgagtgtaggcagcccaacccaacccagccrcccgtctcaccccttggggtccacatacctgcaggcttccttgcacacagactggcagcccagctcttcctggacaaaggctcgatgcagttggtagtaacaatacactgagggacaagggagagggcagcatgagctttggagccacaggacccttcctggccatccccaggtcaccaaggacagccccgcagtctcattttaatgatttctcctcccactttctaccaactctctggaaacacatattgcattgtgatgttgggaaacagaaagcaatggcggttgaggatgtgagttgaaggtcagaccacccttggtttggatccagctctgttcctttctggctgtgtgaccttgggcaagccacttagcctttctsggccttggttatctattctgtgaaaaggtaatatccaccgttcctacctcctggagttgactaaggtggtcagttgcaaagtataatttaagccaggcttgacaacagaagtaaaactctagttaatggctctcaaccaatacctccctcacgcaaaaggcaacaggggtggagtcccaggagtgcctattgccaggactaggctgaccctggtcctggggcatgcaaggctggagctgggtctcactcactccagttggggtgctgctggtagttgcagtagttggctgcaggaggtagaggctggctgtactgggcacacccacatttctccaccatctttgtctggaagcatgaatgaaggcagatctgaaagaggagacccaggaatgccattcatgtctttgctcagggatgtcagggrgtttcctgcacatccctcagcccagggggtcagcctcccttaaccttggccaaccacatgaacctgccccttatgccaactgggctgggcatggtcccggaactgcaaagggcccaacctggaagatgtattaataatttacttattatttttattttttatgttttttgagacagtcttgctctgttgcccagactggagtgcagtggcatgatctcagctcactgcaacctctgcctcctgggctcaagtgatcctcccacctcagcctcccaagtagctgcgattacagatgcacaccaccatgcccagctaatttttttgtatttttggtagagacagggtttcaccatgttggccaggctggtctcaaactcctgacctcaagtgatcctcccaccttggctttccaaaatgctgggattataggcatgagccacacctggccgatgtattaagaatttagactaactgagatatggagatggggctgagctggggctgcagtagttgggtggtcattttccatcatgtgggtgccaacacaaagataagtgggaaaattagaggagttgtcaagaaacagagagaaataaacacagtccctgtgttcctattctcaagyccaacccctccatgttggatcttcatggatcataagctaccacaatatccrtggagcttatagcataaaagctaatggcagagttcctgaaggcaggctactcargtcaaatccmatctttgctatttttctgctgtttggcatcatgcaagttacttaacctctcagatgctttgctttctttataataatatcaacttcatgaagttgtgagcatgaaatgaattgatacatgtaaggtgtgtgtgtgcatggtagytctcactaaatgtcatccagaagtatctttctgatgagctcactttttttatttttaaagacagggtcttgttctctcacccaggctgaagtacagtcgtgtgatcatggctcactgcaggcttgaacatttaggctcaagggatcctccctcctcagcctcccttatagctgagattacaggtgtgcaccagtatgcccaggtaattaaaacaaattttttttttttagaggcaaggtcttgctatgttgccmaggctggtctcaaactcctgggctcaagtgatcttcctacctttgtctcccaaagtgctgggattataggcatgagctaccatgcctggcccaaaagtcctcttttactcagtgtctacaccacctctcagctcagctcttatctaagttggaagactcagtgctgaaggtttctggtccttttgttctgctgggatgattytcatggactctctggggtatcctggtaggaggtgaactataaattcccagaatgtgagaggaggcagaacagatcatctcacttaagtgttgaaaagtcagatgtctacaggagacagtgatgkaagtgacatactggaggggtagtgaaaactgtgggagccagagaacacctgcttcatttattggggtagctacacccactgtttatcctgcaggaaatatgggctcaatgttgcygtatcgtttcattttttcgagaggctggraatctggattttcttgtgaaattccttgactttcgaacaccatccaggctcttgaaaaaccaggtatgccacctggaaggcgactgggagctgcaaattagcagcccctgatccaatcccacctccccttgtggttgctgaggggaacccagctggcccaaggccatyatccagmgaggggcaccagcaggcccggaagccatgctcttgacccttcagccagtgtctctcccagaccgcttctttcctgttcctcccttgccaaggcctacttaggaggtgggyctgtctcagctgtacattgagttccacrgaaacctcggtgtatcaattaagctctggttacagacgaactgcagaggactggaaccagccggcatcatttgttcttgaggtctctggatgaaccccagggatcctcaccagagttcctggtgcaagccacaccccagcytagatataactttgtctcctgggtccgggccataaacccagggctgggtgccccygccaatctgttacctggagcgagtaggcagcgttgtagatgttcctgattggcacgtcactcccgtcctccgtgcactgactgtagggctcactcagcttgaaggactctgtctgcaatcacagcagcacacactcagccctgtcctccccccggacccaggcgggggctttgcaaggagcaccagacaggggactttgcaagcagcccttgggagctgagaagctatttggtcattcatttaatgaaaagttagtgagaacctattaggtgcctggtactgtggtagacactgaaatcagcaatgatcaagatagataagttccctgctctcctggaacrtascttccagtggggtaaacaaatggtcagcaagcaaataaataaacaagatattttggataaatctggatggtgtttaatgaaatrgggtagggaaactggaggcgttaagagcagatgggcagtttttcccatagagtgattagggaaggtatttccgaaaaagggacctgttggcttagcgtggaactgcaagaaagagctggtcttgtcaagaagtggacaggaagtcgggaatggtgacacacacctgtagtcacagctactagggaggctgagatggggggatcacttgagcccaggaggtcaaggctgcagtgagccatcgtcgtaccactgcactccagcctgggcaacagagtgagactctatctttaaaaaagaggatgaagtggacagagtacgattgggtagagcaaacaggaaaggcttgaagcaagatgggctggtatggctgaaaatggcaaaatagagaaattgctggagataaagtcagatggggaggttgaggccaaatcatgcccagctgagaaatttggatttgattgtctgaatgaaatgaatttgcagttggcaaatccactgggacgtgggaggagggattagaaagatgagcaggggccaggctcagtggctcatgcatgtaatcccagcattttgggagactgaggagggaggattccttgagtccagggtttgaggctgcaatgagctatggttgtgccactgcaatccagcgttggtgacagaggaagaccctattttgaaaacaaagagagagagagagggagggaaggggggaaggagggaaggaaggaagaaaggaaggaaaaaagaaaagaaagaagagagagaaagaaagagagagagagaaaggaaggaagggcgggaagggaaggggaggggaggggaggggaagggaagggaagggaagggagagaaaggaagcgggagcagggactgtgagtgcttgggattctcgctcaggtgaaggacccattgccttgttttctggtcccagaagttgacttgaaggatgttgactttcttagaaaaaagctaaggaaagctcaacagagtagaatgctaccctgatcatgagaggaggtaaacagcattgtcactcaaaattcaaaatccttattcaataattttttttgcttttkttttttagagatgagggtctcactctgtcacccagggtggagtgcagtggcacaatcaagggtcactacagcctctacctcccgggctcaatggaccttcctgcctcagcctctctgagtagctgggaccacaggctcctgccactgcacctggcttcaatgatgttttattgtggattactaaattttgctctagcttaatatttgtcactgcaaataaataatccagccaagccaaacaagcaaaaatgggggtgggaggataacatcttctaaggtcagcaactcaatggaagataaatagtgaccagtttattacaactgtgtgtttgtgtgctgtgtgcatccacgtgcccatgtataattgtttttatttttttggttggggagatgggggtaaagasaaaaagaatggcagatttgtgggagggaagaaaattattttctctttgaagaaagaatgaamacgggtagagggggaaggaattaagaggtttgaggcaggtggaaactagccatctcaactggtataatccctttctgtttgtattgcatttcatctgctgacccattagtctccctcaattagctgcaagtacctccagggcaattgacgatgctcatttaaaactgtttaaacaacagaagcaaacaaaggggaaagtggctgtctggcctcccctctttcccagggtgcccgcactagcagatcagatcttgcatctcagacagacagacatggactcatacatttactttgccctgcaacccgcccttctcactaacaagagtgagtgtctttctatgtcagtacagaataaatagacttaatagatgggtagcaaatgcatgcagggcctctagtgcacaccagggctgggctgggcacagaggtgcaaagatgccaagcagtggccttccttgaggtcacaattccttgccatcctctaagcttctccaagcagcaggatccctgggcagaagcgttcctttggtccccccggtcctgctgaactgttcccagagtctagagtgtcagctacaggctctagcttcctggggtaggaaagcataatactctggcatccagatgaggggtctgtccacttaggcaagccgagtgcagccagcaggggtggctggggctccctctaccctgaaaaccagcccatggcctgcttccaggaaactgattatgagaaaccatttggatttcaacgctttctgagtactcaatggcccttcattctgcaacgatgcttatcaaactcacagctcttgaaaggttcaggttgttttccgaagcaaccagaagtagagcaaatggagcaaattttctgttcatgcctcgaatgcatgaactttgacagaatgctcttccctcggccccagctttcagttttctagaactgctggcttgtggaggctaggaagacattttgacttctatcctgacccctagggacacacaaaaaagagtgtgtatatgtgtgcatatgtgtgagtttgtatgtgtatctatgcatacacttatgcatgtaaaagtgtgtatgtgtgtgcacacataggtatgtgtggatgtgtgtgagtggatgtgggcatgtatgtgtaggtataggggtatatgtgtgggacacggagcccatttatatcaaaccagattctttctgcttctttctgaagatcttgggggaaggagacaattgtataggagtccttagctcaccaccctctctctctgagacagggtctcgatctgtcacccaggctggagtgcaatggtgcaatcatggctcatggcagccttgacctcctgggctcaggtaatcttcccacctcagcctcycaaagtgctaggattataggtatggggcgctgcacccagcaagctcattctttaaggtataaacagtgctaagggggaaagcccagatggcagcagagcctgaggggaagggaggtgacaagaggagggcctttatcaaagcccccacagcttctggggttagagagccagctcccaccttcttgcaaccttgagaccttccaaccagtataatcacttctcatctgtaaggtggtcagtccagccaagctattcccagacaaggtggctatcagaccattgttctcacatttcagtggtaactcttgtcccagccagtaatcccaagtcaccttctcagaaagattgcctgtcttgccacagcttagaggtttgcaaattctgttctgtctgcaccctgttttagggcccatcacagcggggtgggcrgtaagcaggctggtttcccaggctcagctacattcatcctgcatttctgtttccattgtgtacatttctgggtaagactttgtttgagtgagagattctcccagtagtaaaaaggacttcctcccccagccactgagggcatggtggaggtgtctaccagccccagtcaacaggctaaagtggcagctgggctctgggggtgggtggggggcttttctttcccttggtttccatgctatacccctgtttctcagaatggactgctgctgcttctgccagggaggggacagcagggatggccaggctggggatggaacaggtggatggttttcttcttgaacctgtgcagacctgggagggactttttttttttttttcttggagatggagcctcactctgttgcccaggctggagtgcagtggcatgatctcagctcactgcaacctccacctcccgggtgtaagccattctcatgccttagcctctcaagcagctgggattataggtgtgtgcctccatgcctggctaatttctttgtatttttagtagagatggggtttcaccatgttggtcaggctggtcttgaactcctgacctcaggtgatctgccctccttggcctcccaaagattacaggcatgagccactgtgcccagcttggactcattattgaggaggttttgtttgctttgggtctctaggctgtctcagggcccctcccatgaccctgtcctgatggtctcctctgaccgtgggcgtaagggggttgaattctgggcccttctagaaggctttttctcaacggaccgtattatggtcaatggtcattcacccctaaacaaccgggagcaccaggcaggctagctaaggggtcaggaatgtaggcttggatccgaacaagtctgaaatcagattcccactgtgctacctagtggctatttgattttgattaaacaataacaacaatagaccaggcatgatagctcatgcttgtaatcccagcactttgggaggctgaggcgggtgggtcacttgaggtcaggagtttgagaccagcctgtctaacatggcgaaaccccgtctctactaaaaatacaatatttaggtaggtgtggtggtgcacgcctataatcccagctatctgagaggctgaggtgggaggattgcttgaacccaggaggtcagagcggcagtaagctcccactttggcctcccaaagcactaggattataggcgtgagccactgtacccggtgaaaaaaattctgatggtttagaatattacatgaaataataaaataactggaagcaaactcaatttagtatctggtctcaaagaggaagaactctcattaacataatgattaaagaagaaaacaaagactttgactatgtaaacattcactattttgcatgtgaaaaagtaccctaaagaaaaccacaaactgggaaagatgtttgcaacacatacggcaaataatcattatcctttatgtatgtataattattaatagtatcttttatatataatgtactagtagtgtataatataaatatatattatatatgtatatatatataaaattcataaaggagagaggtgtcaaaaaagacaatagaaaccttccctaacccctctttttcctttttcactcaaagttatttttccttctcttcacctcttttcttaaaaaatatatagtaatagtctctctctctctctctctctctctctctctctctctctctctctatatatatatatatatatatatatgtatatatatatatatatatatatatatatatatatatatatatgtatatatttgtgatggagtatcactctgccacccagcctgcagtgcagtggcatggccacagctcattgcaatctctgcctcttgggttcaagtgatcctcccgcatgagcctcccaagtagctgggactacaggtgtgtgccaccacggctggctaatttttatattttttgtagagatggggtgtcaccatattgcccagactggtctcaaatctcctaggtgcaagtgatccactggcctcaacttcccaaagtgctggaattacaggtgtaagtcactgccctcagccaagccaatatattttaagcactgactatatgccaaacacatttccaagcgtttcacatgcaccaactcattaaattctcaccagccatgaagtaacgtcattattatcatccctattttacagatgagatcactgaggcagagattatacaaccaatgtgcaaaactggggtgggtttgaatctcagccatcagagctcttttttttttttttttttttttttttttgagacggagtctcactctgtcgcccaggctggagtgcagtggcatgatctcggctcactgcaagctccacctcccgggttcatgccattctcctgtctcagcctcccgagtagctgggactacaggcgcctgccaccacacccggctaattttttgtatttttagtagagacagggtttcactgtattagccaggatggtctcaatctcctgacctcgtgatctgcccacctcagcctcccaaagtgctgggattacaggtgtgagccaccgcgcctgacccatcagagcgcttaatccctgtttggcatagactgaacttgtgaaataaagtctggctatgtgctttagaatcaaaatgtacaacaggatttgtaatgacatggagtctccccattctccagggcctggtccccaaccccactgggtgagtggtccacccacgtccacttcttcattttccattcaccattcgacccactgcacttcggtttctgttccactccttccactgaaaacaactctggcatagaacactggtgacctcttggctgccaaaaccagagaatacttttgccttctaccttgcctgacctctcgactgtacttgcttatttggtcacaccttctgtaaaattctcttccttgatttatctgatgccaactctttctggcttctgttcctacttatctgcctctctttctccttttactttctgctcagcccttaaacatttgcatgtttaggkttctgtctcaggtcttgggtgatggcatttatttccatgtctacaattaccccccaaggttttctccttaactccaggtccatagcatctaatgaatgctttcttttcaccttgacttctcaaaggcataacaaattgggtctgtcccaaatcgaagtggtcatcttctcccaaaaacataccctgcccttggattctctaattctgagcctggcattcctccatctccctgcccaagccaggacctaaatatcaatctaacttcccccggcccttctggctaacattggctgtcaagtcctgttgcttctgtgctataatatccgtgaaatctatttcctctgctcatctccacagccattgcctcagctgaggtccacatcatttctttctagaattactacaaatgtgctgtctccagtgtactgattgtacttccactaaaatgattttttgaaaagtttctctacacagcttaaataaactcctttttgtgactcctctgtaattgctacattctttgtctggactggctcttcttgactatttgcctgcacttgtccttctaaatccattatttagaaagccttctccagtagcttctgtctgggcatccatccatccatgcacctacccacgcacccactcacctatctatccattcagccagccagccatccatccacctacccatctacccactcacctatccatccatccatccatccatccatccatccatccatccatccatccacccacccacccacccatccatctgtcatctatcaatatttactgaggatctgttatgttctaagaagtaagctttggaaccaggcagaaaaggtctgtttccacagagatggaaactgtattgcaaagttgtgcttacttttgtctttggtcaggtgtggtggctcacatctataatcccagcactttgggaagccaagatgggaggactgtttgaggccaggggtttgagaccagtctgagcaacatagcgagacccccatctctacaaaaatgtaaaaattagccagatatggtggcatgtgcctatggtcccagctacttggaaggctgaggcaggagaatcccatgaccccaggtggtcgaggttgctgtgatctgcgagctgtcatcacaccactgcactccagctggatgacagagcaagaccttgtctttaaaaaagcaaacaaacttttgtcttcccctctgaaagttaggaactttgaaggtaggagctctgttgggttcaccttttaatattcagtgctttggacacacaatctctcagtgaataaaggaagttttgtttaccaactgcctggccagcctgactgagcctaccagcttcacacacctattaatcaatcaatacataaataaaatcagaaaagaagaaaggaaggaagtctagtttggttggagtttttcttagtgacactctgctgacctcttcataaaccctgtttttttttgttgttgttgttctaaatgctcataaatcagacctagagctgactgaccctgctctgtggctttgattttctacatcttaaattaggtgtagcagaaaactcactcatgtctttgtttacccactactggtaaagagaacatttgcttaacaatgtggtgggtatttccaagctcagagcaagaaaacaagagagcagaattccttagttcttatacttttacaagctctagtaacttacaccagtttgaaaagggggaagagggcgaaaggataagggaaggatgcgctgcaaatcctggatcctacttcagggtgcagataaaagtgtgtgggacatgtctgaccaaaatgctcaccattgtgctctgaggttttgccatctgccagtgaacaaaagaatgagttgcccagctgcttaagtggctatctcttaaaaaagtcttttcaagtcacagtttgagcagattgagggttcgagatagtttttcctttttcattcacacagctcaagctgatacacattacttccctcccatgctggaacaaagcccctaagtaacatgcctcctgagagcatctgggggcccagaaagaccattttgatggtttcccttgtccagtgttgtccttttcatggggcaccatgaggcagtgaagccccasatttcatctgtcatacttccattccggttcatcatctcgctgtctcagcttaaatagcacctcctcaggaaagccttccttgaacctcatcttccccattgaaaatgagccccaggtcagtcgtgtcataatatgcactcatatggtcttacatttcttcttcatagcasttatggcaattataatgaatcatttgtattatttctggtttattactcaatcctctctsctggactctagactctctcaggacagggacggtgtcctccacactgaggtgycccatgtctagcacatagaaggtgctcagaaaatgtcaattgaatggataaatgacaggcggatatccaagccctaattgcccaccatctttttatgtaacccaatgcaaagctatagctagaactttgtgtcattctagcttcacttttacttgggaagacacaattagcttttcctctaattctgcattgctctaaagccaaggctctcaggagttcaaggctccagtgagctatgattgtgtcactgcactccagcctgggtgacagagcaagaacctgactctaaaaattttttaaatttaaacattaaaaaaaggtcaagccaagactcccaagggtgctgcctcttagaataaccactacaacttggtaaaaatatagatccttgggctcatcttctagagattctgattcartggctttgagtctgataatcaaccaggtttggaaaccacttctctggaggatatgtttgtgaaggataaaagctaggaagtttaattggggatattaaggttggatttaaataaaggcatgaacaaatgtatagtccacaaggagattttgtttctttctccccacccayaaacaggtaaagaaaaacgtcattatgggccaggcgctgtggctcacgcctgtaatcccagcacttcgggaggctgaggcgggcggatcacaaggtcaggagatcgagaccatcctggctaacacagtgaaaccctgtctctactaaaaatacaaaaaattagccaggcgtggtggcgggtgactgtagtcccagctactcgggaggctgaggcaggagagtggcatgaacctgggatgtggagcttgcagtaagccaagatcatgccactgcactccagcctgggtgacagagtgacactctgtctcaaaaaaaaaaaaaaaaaaaaaaaaagaaaagaaaagaaaagaaaaacatcattatgaaagaatgaaattaaaatgataacagataccatttttctcttgacagattagcaaagattaaacattaatacattatgttggttagagtgtggggaaatagctactctcatattgctggkgkggttctcaattgctatatcctcattgggggacaatctggcaaacacatgtcctgtttgacaaacttctaggaagtaactgggcaaatacacgtcacattgcaccattgcttttagttgtgcctgaaatgacctaatgtctatcaatggggggttgcatcaataacttattcacgcaatggaagactatgaatcttttaaaagaatgatgcagatctatatgttttgatatggaaccatttcccagctatagcattaagtgagaaatattttgtatttgcataaaaggagaaatgcttatacctatatgcacttgcttgaatgactagaatatccctgccaagacacagtagcaacagtggtggtccctctggagaggaaggagaagtctggatgtcgggagtggaagagagatacactctgcttggtacactccttggtatggttggtgtggacactctctttaaataagttcttaaaaaaaaaatagaggcagggtctcactatgttgcccaagctgggtcttgaactcctgggctcaagcactcctccccactcagcctcctgcaaagctgggactacaggtgtgccccagcatgcctggctaattttatattttttgtagagatggggtcttgctatgttgcccaggctggtcttgaactcctgagctcaagtgatcgtcccacttcagcctcctgagtggctgggactacaagtctatgcactgcacctaactcctttaaatcagtttttgtttgtttgtttgtttttgagacagagtcttactctgtcaccgagactggagtgcaatggtacaatcatggctcactgaagcctcgacctccctgaggtcaggtgatcctcctacctcagcctcctgagtagctgggactacaggcctgtgccaccatgcctggtgattttttttgtatttcgtttttggtagagatggggttttgctatgttgcccaggctggtctcaaacttctgggctcaagtgatccacccaccttggccttccaaagtgctgggattataggcatgagccactgtgcccggtctaaataagttcttaacagtcattctatgaaagagagaaagggagaggcagatagatactggaataaaaagaccccaggcctgcaaacaagaaaactccataagcagtggagtgaccaaggccatcagagtccactcttcatcttgccattcagctcccattgggcaaggctgactcggggattggagtctgcggcttacttgtgcttctgttgataggtttgcatgttctcagtgcccaatgaggtccacaaaggtcaaatttggagggagaaggggttcttggtaaatgaggtaaaattgacaggagtgtaatgggctaaatagactttggatagctgagtgactttccactaggctttaatacagttattgacatgcctcataggcctctaagcagcccagaaagatagacggtaatcttatctgtttgtattactgacaaatatatagttagtgtcctaatgccttgcttccagcataggttccataaatgctggtgtcttgaaattctctccccaaatggcaccctgtcctattaatccatacaaatacaaccttttttttttttgagatggagtcttgctctgttgctcggctggagtgcagtggcgtgatctcggcccactgcaacctcctcctcctgggttcaagctattctcttgcctcagcctccctagtaactggtattacaggcacacactaccatacccaactaattttttgtatttttagtagagacaggtttcaccaagttggctaggctggtctcaaactcttgacctcacctcggtctcctgaagtgctaggattacaggtgtgagccactgcagccggccagaagatacaaacacaacctttaatgtaactcctgaaatgaatgggataaccatgggaaaatctgggaccatgttcccttttgaaacaaacacccttttccataagctgcaccccattggttatccttggaaaaaaaaagatctgttctctccaagcctatggaaatgagaatattctcttaccaggtgcattcctatagaggtgaccattgctgtctcaatctctgttcccacatcttcgacgaagggatactcatcctgccgatggatgatcaccttagctccagtggaggacacgaggaatgggttgtattcctcttcgtttatgtacaaaatgacttgcagccctgggaggataagacaacctgctgtgatccaaggctaggaaaacatttcctgggggtaaaccacctctcccactgcttcaggagcttcaaacccaagaccaggtatttctagcaagtgacaggtggacgagggctagactggaagctcygtgagattggaatgcatgcctgacttgctctctgctgtgcccccacagcttagcccaaaacaggggttcaaacacagtattactgtcacagttcttgccaagcatacgtttttgccaagtgtaaggaaattgccactctgcctgagacatgaatctccatgtggtcctttgagatggggagctcggaacattcaaaagaagatgcattgctccggctgcttaacccctcagggtgggcactcagagaagagatgaatcactaatggtgtttctcatcactggcccaacttctcctcccactcctgctcttgccccctgaagtctatgcggacacagcaccagagtaaacacagtatcagtgcacatgggaactaagagtgaaaagttgcagagtcctggctctgccatggatcggctgtgacctccagcaattcacttcccctctctgggcttatttacaaattgtttgcaattgtttacaaatcatttgcaattgtttaccaattgcccttgtttacaaattgaatgtcagtataactctcaaaattctcttctttccatccgtagagaccctgctcattcatgtatgggctgaggtcctttgaaaattggacctcaggccaggtcactccctgaaacctgaaactcttcagtggcatctcactggatatatgggaatgccacagaataaacctggctgcatctatcaaggtgatgatgatacagccctgcctacttctccctcctcatctcctcccactgtctccccacctcaataagctccaagcacactggtcttatttctgtttctagaacacatctgattcacatccttcccagggcctttgcccttgctagtccctggaatgttcttgtgtagaccttaacatgaatcttttgctccttaaatagccctcctcttagagatctttctgggccttcttatccaaactaacccccccatcctgaccccagccactctgtcttcctactctgcctctttcttccctgaatagcagtctttaggatttgtaactagatcatgtctgtgtagttgtgtactcatttttcatctctctctccccacgaaaatgtaagtttcctaacagcagagaagacatctatcttttcactgctgtgtccctggtacgtagaagagggcctggcaaacaggagaaactccatgcttggtaagtggatgagtgaatcagcagggtctatatggatggaaagaagagaattttgagagttattctgacattcaatttgtaaacaagggcaatttgtaaacaattgcaaagaattggtaaacaattgcaaacgattgtaaacaattgcaaacaatgtgtaaacaacttgtaaacaattgcaaacaatttgtaaataagttgtaaacaattacaaacaaagcccagagaggggaagtgaattgcttgaggtcacacagcccctccatagcagagccagtactctgcaacttttcactttcagtttccagattacttcttccccatggaatatgtgcactgaattatgatttcttgcagacttagtaagagcacagactacacagggacaaaggccaggattccaagtgtggatttcctttatgacaggccctcccttgtcctggtgcgagtatatctacatatcacatcattttcaatttgcatgggacctttcaagaattccttttgggcataagccaggccaatctgttcagttcctaccttccctagaaatgtaatcatagtggaatagtagtgctggaaattgcagtggtattattttgagggtagtagcagcagcagcaatggtggtagactsgtagcaatgctagtaacggtaataatagcagtaataacaatagcaactagcacttattgtgtgcttggtatgtgttatggctgaattgttttctgcctcaaattcatatgttgaagccctaacccccaaagggatattattttgagataggactttaattaaggtgaaaggaagtcacaagcagggggctctaatctgataggattgatgtcctgatcagaagaggaagagacatcacaggcctctctctgttgacacaccacagaggaaaggccatctgaggacatggagagaagacagccagccttctgcaacccwaagagagaagcctcaccagaaccgagtctgcctgtgccttgatcttagactttctagtctccaaaactgtgataaataaatgtctactgtccaaggcacccagtctctggtattttgttatggcggtccaagcagactaacagagtgcagagcaggtcttattctaagtctgtatcttaagtcctgtcagtaatctcacatgggagatactattattagtcccgctttatagacgaagcgcagtaacttgcccaaggtcacacagtgagtggccaagctgggtttcggctccgtccagaatctgtcacctgaactaagataaatgtgcgtctacttccctaatctgttcagcatatctgggctcaactccctttggaaaccacctgtcctgcattactcaccctagctatgagtttaaaccagagtagttccctagcagaaggaaccccagtgatgtccctgtcgctctctcaaagatggaagaaaagtcaaaaaggaaaacaaacactaacttggaaggaaggaaccagcatgaacactgatggaaacactgatagaaaaaggggcatccctggtttctggccaagtgggagagatcccgcttttccagagggctcccgcatccccactgtsctgctgcccccatgtccactattggagggcctcaagatctccttggcacaggtttccttaccatattcgctgccccccatggaggtgctgagaatggtctcattttctctgttgttgaaagtatagcaattcccatgcatcgggtggtggaaaagcgtgaaattcctatggaggaagaaaatgggtcagaaagggatctcccccatgcatcttagctgaagttgggcagggcagtgctaatggagccaactctctttggggagaatgtgtgagagatgtgactcattttccccatcttgctcctgatcaaatgacaaacaaggcccctcatcctggttgacacacatggacatagaactagactctctgccttctgttttctctcggaatcttctcaccttcatctctatcctgacttgacattctttgtgccatgtctgtccccaaattcctccacttttgaatttctcagccaacacttgacattttccattaaaattctcagtcctagaaaataatccccagggcatcatctgtgcccttacatgactttggaacccaactcttagggagacatgattccagttatttacttttcacaagaaccaatctgtctgctaacatatacagataggtgaaagaggcttagtgttttattktattgtattgtattgtatttttatttctgagatagggtcttgctcttttgcccaggctgaagtgcagtggcgcaattatggctcactgcagcctcaacctcccagactcaagcaatcttcccacctcagcctcctgagtagctgggactacaggtgtgtgccattatgcccagataagtttttgaattttttttgtagaaaggaggttttgccacattgcccaggctggtctcgaactcctgagctcaagcaatcatcttcctcagcctcccaaagtgctggcattacaagcgtgagccactgtgcccagcccaggaacactttagaatgtctcacccactgctcagtcactataagggatctgagtgttatcataaaggtgaaaggtttgaaatctcacatatttgaacatgggcctttctcctcccatccctccctccatctcttccttccttccttagaacgatggttcttagtcatcagtatgcatgatggtaatatacaaggttaggttataggcacaccatatgacaaaaacagcaattacttttgtgccaatctaataccttgtgggttgggttttttttttttttttttttttttttttgagacaagagtctcactctgcagcccaggcttgagtgcagtagtgcaatcttggcttattgcaacctccgcctcccgggttcaarcgattcttctgcctcagtctcctgaatagctgggactacaggcatgcaccaccatgcctggctaagttttgtatttttagtagagacggggtctcgctatgttagccaggctggtcttgaactcctagcctcaagtgatccacccaccccagcctcccaaagtgctgggatttagaggcgtgaaccaccatgcctggccaactaccttgtttttaatgagtagtttaatgagtttaaggatattttgattttatgtcatgtatacctcactcactgactctagaacacagctcccatgtaagcagtttccaaaaggcagcatcagtgagaagagcaccttttgctcccaagacctatcatcaaggctgtaggttcctgcaaggggcctggtactcagagctgccagtccttagaggctgagagagcagcattctctcctgacctggcatcacaggacactccatcaaagaagcaggtcaccagcagctcctcagcagaatagctcatgttgattttcttctccagaggcacctgtgccatgatgttcatgtagtgtagcttataccactcctgaatggcattgattcccgagctgaaggtgtaggtggcacagtcggaggtgtcatttgagcactgtgaataagaggagatgcgaggctgaagccatcggtcctatcgctactcttcagaaggaccataagaatgagtgactgagactccaggccagatactcaggggaacaggttggatatctggggcaaggatgggtttcctctcacttctaggggttgggagtgatcatcctcaagcctcaaggaccaaaaaggggctgagtgagaaaggacacagagtcctactcctgcaactctgcactacttgcccaccaaggaagaagcaaaaccagctcttcagggtccctaggcacctaggtttcatccgattgatgctactacgttcctaacaacctttcccatttcctatcatatcaaaagtcaagacatctggattccagcccagactctgcaggagggggagagactacttctctgcaggatctcaggcaaggtattctgtgcccattatctcacccacaaaatgttgactgaaacaccatccttcccaaccacgtgtggtagctgggaggacccatgtttgaaatatacaatgagaactttatagagaagccattatacattccaaatgttcttatcacacaaagcttggaaacttttctaaatggacagatgtcaactgattttggctggttgcagtggctcatgcctgtaatcctaatrctttggaaggttgtagtgggaagactgattgaggccaggaattcgagaccagcccgggcaacacrgctaaaccccatctccataaaaaatagaaaaattatccaggtgtggtgatgcattcttgtagtccaagctacttgggaggctgaggtgggaaaattgtttgagcccaggagttmtaggctgcagtgagctatgattgcaccactcccacctgagtgacagagtgaaatcttgtttytaaaacaaacaaacaaacatctatataaagagttgattttggtatcaagaagagccttgcagatatcccatgaaaggacccaagaagactttgaaatctcaatgatttagaagaaggtccatttttcaggatttgggactatagctacaaggtcacacaattggcaatcaagcctataaggtatggacatagcccctgtcctccagaggtggctggggcatggagagggagagtggtgatagagtttgcccaggaaggtactagaattcattttcagtgaatggcatttctcaagagcccctcaggccaggtgcggtggctcacgcctgtaatctcagcagtttgggaggccaaggtagggggaccacctgaggtsgagggttcgagaccagcctgaccaacatggtgaaacccagtctttactaaagatacaaaaacttagccaagcatggtggtgcatgcctgtaatcccagctactcaggaggctgaggcaggagaatcacttgaacccgggaggtagaagttgcagtgagccgagatcacaccactgcactccagcgtgggtgacagaatgagactctgtctcaaaaaaaaaaaaaaaaaaaaaaaaaaaaaatcccctcaaatgggaccaaaagggaaaatgaagtcaagccaagcacctcatgaaggcaagtactgcacgaatattgatgtttctgctgtttattgtccgtctttttcttttgggtgcctgcacctcaattttgctttggaagaatttcctttccccctctggatacagcctggtgagattgtccatgaagatactccaccatccattagccaaagggtgattaggtgacccaagcttgaccaaccagatagtcccaagatggaatttgactcttaagcattaacaacaccaacaaaaactgaacatatttgatgcttctttactccagcagcaatatctgaaatgacttttcatcatttcttgctacccagatccctgcatctgccctaatttctgccctttgagaggcctccatgagttactggttgccttctaatacatttacccccactctgccccccactacttaaaattacctgaatcagtttcagttgtttgcagctgaatcatcccagctgggtgtctttcctttctttcctttcttttctttctttctctctttctttctttttttaaaaaataattttactttaagtgctgggatacatgtgcagaacatgcaggtttgttacaaaggtatacatgtaccatggtggtttgccgcacctatcaaccagtcacctaggttttaagccccgcatgcattaggtatttgtcctaatgctctccctccgtttgccccccaactctcccctttttttttttaacagagtctcattctgtcactcaggctggagtgcagtggcaccatctgggctcactgcaacctccacctcccgggttcaagcaattctcttgcctcagcttcccaagtagctgagattacaggcatgtgccaccatgcccagctaatttttgtattttagtggagatgggttttaccacgttggccaggctggtctcgaactcctgacctcaggtgattcgcccgccttggcctcccaaagcgctgggattacaagcatgagtcactgtgtctgaccccagctgggtgtrtttcttccagttggaccacaggggctagtggtcaaggagaagagtcctggacccagcccatcccatgcccctaagcagtgaaagaatgagaaggtgaaatcttaccagttggaatcccaccacttgcttggactygatgtgcatgacatttgaagccttgtgaatgatgctaccrcygactttccgcttcctccctgtgaagaagtccctggccttgcccttctcatcctgatcaaagatcagcagcggratccggtgggagaatctaggctgctttccctctgagacggagttccaggactccgcctctcggcgcttccgggactctggaaagccrtacagggacttcagggcctctctggtctcctgttccaagtcagctagaaggtggcgaacggtgctgtacctgccaaggtggggaggaaaagtcagggagaggggaggcggccctggcagaactctggtgctcctccaggctgttttccatcaacacgtgtcagcctcrtgcccacctttcccaactccttggcagaggagaccacgcctttcatgacttgacccatccaaagtgacccctggctctggcaaatggggaaaggctcatgggtgacccatgtgtgacttcctgtggcttcacctctgccaccactgtctgcttgccctcagggtgtgttgacaagtttgtcccaaccagcatttctgtagtggtgactgtcaggtgcctcccataaaccagccacagtgaggacaagtaaataactgccaaccaggagtctacctaatgggcaggctccttctccacccagctcactctgcctctgcccactgattgtcctcaaatctgtgctggggggaaggagggtataactgttacctcgatgacccccaagaacacaaaatagttataaaggagttgcctgcgtgaagcacaatataccatcttttaattttcacaaatcaaatggttccagcctcctcttaactctctccwctctcctttctcccacttgctctaggcataggcagcagagcatagcaattgagaatagaaacccctgggtttagccaaattacctgagtttaggttccccatcctggtactggctacctgaccttggacaaatgtcttagcctctctgtgttttagcattctcctttgtaaaacgggatttgctgggaaggttcaatgagtttattaaatataataaacacacacagacatacatatagataattaaatgccctctattattgttattattttagagacagggtctcactctgttgcccaggctggagtgcagtggtgcaatcatggttccctgcagcctagaactcctgggctcaagcaatcctcccacttcagcctcctaagttgctgggactatgaatgtgtgccatcacacctggctaatttaaaataaaatatttttagagagggggccttgctctgttgcccaggctggtctcgaattcctggcctcaagcaatcctcatgccttggcttctgaaagtgctgagatttcaggcatgagccactgtgcctctattgttagttatattagtgttattatatttattaagactttattcctccactacagtataagctccactagggcaaatactgtgtttgggttgttcagttctctatcccagaacctagtacagtgcatgacagtttatagatgctgagtaaattattatggaacaaataatggatggaaagaaggaaggaggaccagagagagagagagaaggagggagggagaaagaaagaagaggaagacatggagggcggagagagagtcttagacttgatcttgattttgagctttgcaccaactcactgaygattctggacaagttagtttcgtttgataatctttctcccctgttcttcttcccttctccccacccctgctctgacaaagtctgcctgattctgacctgcctcacggaccagttttccataatcctgagaaggactctgatgacccatttagaacaggtcctgccgaggatgatagggcagtcccaagggctgatcacacccagggcccgatgagctcaattaatggggctgggtttattcagatgagggtttggggcagctgaggtgcttacagaagtcacctgggtgtcacttctgagtcagccttgagctcacttatgctgcaggcagagtgaacatgtgagctyggagagccaggggtgcagatgcagatgggggttggctaatttgggcttgatatggggagtgtgcagagggggttagttcgttccaggcctcttctaagtgaaacaaatcctgcagcttcctctttctgctctctctgggctagcccatcctcagaagtcattgatggagtgggtgtggtggttcactcctgtaatctcagcactttgagagaccaaagtggcagcaccacttgagctcaggagtttgagaccagcctgagtaacatagcgagaccccatctcttaaaaaataaaaaattttagctggatgtggtggcatgtgcctatagtcccagctactcaggaggctgcagtaggagaattgcttgagcccaggaggtcggggctgcagggagctataattgcaccactgcactccagcttgggtgacaaagtgagaccctgcctccaaaaaaaaaaaaaaaaaaaagaaaaggccaggtactgtggctcacacctgtaatccaagcactttgggaggccaaggcgggtggatcacctgaggtcaggagttcaagaccagcctggccaagcatggtgaaatcctgtctctactaaaaacacaaaaaaattagcctggcgctgtggtacacccctgtagtcccagctactcgggaggattgttagaacctgggaggtggaggttgcagtgagccgagatcgcaccaytgcatcccagcctgggcaacaagagcgaaactccatctcaaaaaaggaaaaagaaaagaaaaaaaacaagtcactgatggtctgaaaacttggtacatacagatttagaactggggagggggctgtttaccagcgttagcaacaaattcaaatttctagaaagcacatttgtaggctggaatcgacctccaggctgccagtgtgtcactttcgggaggggctttggcctctgtggggggcctggctccctactcgcgtttccctgctcatgcctcttacttgtaggggttgatgttgcagatggtgactgcaggaaaatccagcttccggaagtggactttgatggaaactgagacagtatagaaggagaagacgaggagggcgcactgccagaggatgagggccacggcagtcagtgtgaacccgatccagaggaggcggcgcagacggcmgcgggacaccacgatgcggcgacagccatgggtgttggtgttgaggcagtaccaccgcatcagctctttaatggtcggcgcctgagggcccgtcacgggcagattcttcttgattttggctttgatcttctctccgggtgccatggcgaggatgggactttgaggacgggactcygaggacgggcgtgctgsaggggcaaagaagagaagcaggtgagctggcaggcactagccggctagtgtgtccctggagaccacagtytgggaaacaccagtccatgcgcccttagagacctccttcctctgttcctctgtggcttaggcactttgcattctgaatccttggccccttttccacgggacgtttgtttttggccaccacagctgccagagaagctgcctacttctcttacggcccccaggcctagccgtgcrggggctgggtgaggtgcaacctgcgaagcgctggctggacaggctgcaggacctttccccgggttcctgggcaggaactctggaagcagccccatcagctctcttatcaggcaggggtacccgtgccttatcacctccagtagcccgccttcctcaagggcagcattcctatctcattatgcccccyggttcctagcacagtgtctggcacagagcagtgctcggcagattgtaactgacagatgaaatctgccaagaaaatttcccggcagccaccttagatcatgttcctggctgcattttccccagccttttctctgaggctttattataagtgaaacgatttctcttttgtttcttctctttacagtcaagctcttaatgtttctagatcacctgatgtaacaataacctgcaactattggccacttagtgtttgccaggcattgtgccatatttccttgattctaagataccattaatttagagaatgcccttgatttaataacagctttgggggagagtaccagtattggaaggcaaattatcacattcatcaatgtrcacgatgcatctcaactatacaaactttacaatgagaaataattttagaaatgaactaatatactacataaaaactcatttcatgtttataatatatagtctcattagtctcataagtaaatttgtctctctctataaatatacacrtagcctacatatatttccttttgtgtttcaataattccatgaagtaggcatgctattattatatccatgttacagaggagaaaaatgggctcagagaggttgaatatcttgtgtaagatgatgcagctggttagtggaggagctggatggaaccctgcagccttcaccgctatggcatacgcctttgaggggcctggtagtacgctgggtgcagggagttaattaacaataccaagaactaaaggtaggaggaaagagaaggaacacagctatttaatttccaaactctgaacagtgcacatgaccacttcccaagacttgtgagcactagtattgggggtgggggatatatgaaaactgtgtcgtcctatgccttctacagtgacaaaggcaaattaggacatatcctagggcatacagggtggtccccaggaccagagaggacccrtgtctgtgacttcgaygtgccccatcaagatttttaggcagtattcggaacctgcagagttatgtctttttttcccaccctgaacccatgaaatatgggctaaaattggaagctggggcaaagctaggaggcttccaagcttatgatgckagtgggtttaaggcctcagatggaaaggaaatggagtgctgggcatggaggtgagatgtccagagcagmcaaactgctctaaaccctccatagattgatatgattttgctgggatgaagaacaccatcaaaatgatgctagtagcctctgggcaagaggaatataatttatttttttatcacttaaaatattgcctatccttacctcctccctcactacaatccaaaaaaataaaaaatgaaataaagaagaaggaaagaaagaaaaaaattagcragagtttgtttttaaaatctaggtccaggttcaattgcttgtcaaataaaactgcagccctcctctgtgartgttcaacagaagctgtgattctggaagctcctatccccagctctcaggggtacctctgccccatcagccccttccccagaaccgaccttgaccccaatggatcagtcgacaatgtcagaggagcccccaagtgaaggaagggaactgatcttgctctttgcaaaacagataaaatattcatataaataatatttcaacttcaaagcaaaacaagactgtagctaccattagattatgcagcctgagccaatgtgatacccttggtggaagaattactagctgatacccagcacttactcttctaagtactttgcagctgtcacctcatttaattttcacgataatcgtctgaggtaggtatcacaaccacctccattgtacaaatgaaacagacgctgacaggttaagtagcttgcccaaggtcacactagaaagtggctgagctgggatttgcacctaggagtccctttaacgactaactaggctgctcttcaatcattaataataataacagcagcagggaaagcagcaataatggcagctatcacttattgatccctttctgtactcccaggcatcccactcagtccttttcacacactacctgatttaatcctcactagttatatgaggtgctattacttggcccatttcacagagaaggaaactgaggcacagaggttaggtaatttgcccaagaccacacaggtagaaaggatttgaaggattctttagaattccagggccctggctcatcgcagcggctccgtgcaccccctcctcacctaccaccgactttgcctgtcccccatcccacagtgcaggaccccaaagcttggagagggatgagagatttgccccaagtctagcgttgggttcgctggaccggagagttcccgatcagtgcccgtcccgaagggcgagtcctgtgcagaaatcacttgaactcaacctcagggccctgacccgagctcctgccgagcgaccccgcagccctgccctccctgcgcggagcgagcgggcgctgtcctgtggcggaagccacgtctgccccgggggagcgccggctgaaggcgctggagcgaatccaaccagcccacttcaagtgtttgcttctttctgcaccaagtcaccccggagaaagcattccagagggtagaaggaacagtagcggacaggtccacgcgactcaccccggcagggaagggggctgaacaggcgctgggcggagaaaagaggccaggtgtggcccgggacccccagacccccggactctgagtggctctcgactggcttcgtgctccgggccacggcgtgggtagacccgggagagctggccgctaccgcccgggcaaggtgtcccagcatcccgggcaccgggaagccgccacysgctgatgctggctcggccacccaccgcgctgacggcgtccgacgccctggcgcycggcatccgctccagtgcccagaacccccgagctggtccgacccaacccggctgaactcacctttcggttccaaagggtccaaggctcgtgcgggtgcgctgctcctctgctcgctctcgggctagcatcccctggcagcgccaccgcgggctcttgtgggccggccaggccccgccccctagggacccgcctccccaggccccgcccccacctgcccaggtgctttccccaggccgccaggcacctgagaccgcccggagmgggccacgacttcacaacgccccctggcgccccgaagccgccctgcgccccagcccggccgcgctgcgycttcctgggccaccgcgcagtgcctgctgccgccccgaggccgccctgccatcctgcattcccgctgggtctctgcggcacttaccccaaggcgcctcaaagcgcctgctgccccctattactgccccgcgacttccttccactcccgtccagatggcaggtgcctgccctagcaccagcagtaatcccacgcagcctcgctcctcggactccctccagacctgcagcttcagtgcccaccagcgtccggctgtaggcagcaggggctgttcagccaggccactcatcctttgaccttttcagctgcttctttctctttctttcgttatttcctccttccttcttctttcttttcctctttccttctttttttttttttttgacggagtctcgctctgtcgcccagtctggagtgcaatgacgctatctcagctcactacaacctccgcctcccgggttcaagcaattctcctgcctcagcctcccaagtagctggggttacaggcgcgcgccaccatgcccggattaatttttgtgtttttagtagagacgcggtttcaccatgttggccaggctggtctcaaactactgacctcaggtgatccacgcgtcttggcctcccaaagtgctgggattacaggtgtgagccaccgcgcctggcctgtccttctttctctttctctctttctttcctttctttcctccttccttccttgcctgcctgcctgccttcccgcccgcccaccttccttccttccttccttccttccttccttccttccttccttccttccttcctttctctttcttgcttgcttgccttccttccttcctccctccctctttcttctttctctctctcccttccttccttcctccctccctccctcctttttctttcttcctttctttctttctttctttctttttctttctttctttcctctatttctctctttctttttttaacagggtctccctctgtcaccttggctggagtgcagtgctgcaatcatagctcactgtagctgccaactactgggctcaagcgagcctcccacttcagcgtctcaaatagctggaattacagaggtaagccacctttcctrgcttcagctgcctttttatagggactcagataactacaagaaacgagattagaaaactgcaattgggagggaccatagagacacagcccctttgtgccggggagaaactgaagcccagagagaggaaaggatctgttcttacctagagcttctcagatttgaatgtggttacaatcacctatggatgttgttaaaatgcagattctgactcgataggggtggagtgggtcttaagagtccgaatttccaaattcctaggagatgccttggttgctggtccaagggckgtttgcccaggtggatggaaacaggtccagcattattggagagaaatttaaagaaaatcctctaaaaaatctcagctgcttcttctaacaatatatgctcattgcaaagaattaaaacaataaactgtgcccccccctccccaaataagcatggctaacagtttggttattatttggtgtgtgtgtatgtgtgtgtgtccacacacacatattagttttatatatatacacatacatatataatgggattttgaaacacacactgttcaaattctatgtttgttttgaatgacaatacacagttatattctcactgcaaaataaagccagctttttcttctttttgtcttttaaawtatttatttatttatttattttgagacagggtcttgctctgtcacccaggctggaatgtagtggcatgatcatggcttactgcagtctcaacttcctgtggctccaaggatcctcccacctcagcctcccaagtagctgggaccccaggtgcatgccaccgatacccaactaatttttttttttttttttttttggtagagaaggggtttcaccatgtttgcaaggctggtcttgaactcccgagttcaagggatctacccatctcagcctcccaaagtgctggcattataggcatggaattaggctagattcaagttaaaatttatatacagtgaaacgcacaatttttttgtttgtttgtttttgaggcaaggttttgctctgtcacccagggtggaatgcagtggtgtgatcatagctcactgcagcctccaactcctgggctcaagcaatcctcctgcctcagattacaaaatagtagctaggactagaggtctgtgccaccatgcctggctaattttttatttttgtggagatggaatttcactatgttgcccaggctggtcttgaactcctggcctcaagaaatttgcctgccttggcctctcaaagtgttatgattgcaggcatgagccactgcacctggcccaaaatgtacaagtcaaggagttttggtaaatgtgtacactcctatgaccaacaccatctgattcttcagtacagagtggtattgcctctaaaccactcctgtcatcataagaccataggcaacgtcctctccttcttgaagcatcagtgttcagatttataaaatatacctagaatctacttctccccacctctggggccaccaccatgctcyaattgatcattgtctctcacccgaatcattgccataggctcctcactaatcttgctaattctgccctccacagcctcttgtcaataagccagtcaaagagattcttattgaattaaggttagatcatgccatttctctatttaaacccattcagtggcttcttgcttcatttataatgaaagccaaaatccttatggtcatctgcaaggccctccatcatctgaccctgttgtccctctgccctcgtctcttcctactcacactcgcatattctgcttcaccttcactggcctccgtgccatccttgcatatgactatgaccgaacctagccttagcaaagtcatttggtttcaggcaacagaaacagactcaaattagctcaagcagaatcaataaattattaaatggatgcaggcagggctcctttacagaatccaaagaaacacagagggtctcaggagaatgggaaccaggaaaggtctggatctctcaggaggaggattttgtgrtctttttttatttttatttttacttgagacagggtctggctttgtcacccaggctggagtgcagtggtgcgatctcggctcactgcaacctccacctcctgggcccaagtgatacttccccctcagcctccagagtagctgggaacataggcatgcactgccacacccagatacattttgtgggttttgtagagatggaggtctttctatattgcccaggctggtttcgaactcctgggctcaagcagtccacccgcattggcctctcaaagtgctgggattacaggtgtaagtcagtgcgcctggcagaggattttgtgggctttcttgaattttcaaagcctgtcttagtctcatgagtcctgaagataaatttgattggccactggcctgccaatgagctagtttctttggctcaggtgtattcattcctggtccaatcagctaacactgtgagggtaggaatgggtaaaacaaatatgactgaagagattcaccactactggtaaatgggaaattctcagatcatgtggctgtaagtgaggaagaaaccttaaaacaagtgaaccaacatttccctttgttttcaaaaaaacacttctggtccacttaggaaaaagcaatatagatgagacttacattgccccctaaatactaagattttagacttgcttgtcgagagcaatggtgtagaagccatttgcttgtttttctgccaatatccattctttttattctagagacatccctgaatttcctttggagaaccattcaatcctatccacaccccccrtcctcattcrtgtggttcaacttaggttgacccccatctctggctctagcaaatcagcttatcttgtcactcaggttatagtctttttttttttttttgagatggaatctcgctttgtcgtccaggctgcaatgcagtggtgctatctcggctcactgcaatctccgcctcctgggttcaagtgattctcctgcctcagcctcccaagtagctgggactacatgtgcacaccaccacacccggataatttcttttttttctttttttttttttagtagagacagggtttcaccatgttggccaggctggtctcaaactcctaacttcaggtgatccacccactttggcctcctaaattgctggaattacaggcatgagccaccatgcctggcctttaggttacagtcttttgctcaggagtgggcacagacagaaattcaatccaatgagagtctgagagtcacacccacccaagactttgtctagaatattgcaaaggaggatgtctctttttactgggacttctagcagaaaggactgtgtgatccaagggctgtggaaagtatcacatagggccttagagtgaaaccaacacaaagaaaagcagagcccagtgatggagagggttccagcaagtctctggacccagcactgcctacagctgggtctaccttctggaattctcagtcatatgagccaataaacttgctattgtgtttaggacattttgagttgtttatctcactcaaaaccaaaaaagtcccaactaatatagagaataaaaatcctatcttcccacttggatgtggtgatgycttcttctgtttcttaaagtgagtgtatttcatatctagtcccagatgaatatctacaaatctgggcaacatttttatatgccaaatgacaacagggagagccctgagctatttaaagggataacaggtaattagaactctgacagggaaatagactccccttgatcctagctctctctctctytttttttttttagatgttgtctctgtcacccaggctggagtgcagtggcgtgatctcagttcactgcaatctctgcctcttgggttcaagtaattatcgtgcttcagcctcctgagtagctgggattataggcatgctccaacatgtcaggctatttcttttgtatttttagtagagacggggtttcattgtgttggctaggctggtctcgaactcctgacttcaagtgatccacctacttcagcctcccaaagtgctgggactacaggtgtgagtcaccgcgcccaaccagctatctcaataagacccaaagtttaccaaattatcttcataggacctaaggctaatatgagtcaggtgtggggtcaaagggactcacatttccaggatcacatttatattatgtagtcggatgggagggttctaagaagcaatcaacaaggtcttccttgttgaagacaaggaaagtctttcttgctgggctgatgagggtggtggcatggtagaagaccattcttatttattaattggactctaattcaatgacctggatactatttctgtgtatagtcttagcttaagccaatagcatcagttgttgaaatagagaaatataagcttggttacattaattttctaggaccctttttccccaaagggtacacatatgtttctggcaaaagttagtaccatttttctagtgtaagagactttttttttttttgagacagggtttcactgctgccacccaggctggagcgcagtggcacagtgtcgactcactgcagcctccacccactgggttcaagctattctcctgcctcagcctcccaagtagctgggactacaggcacatgccactgtgcctggctaacttttgtattttttgtagagatgggattttgccatgttgcccagactggtctcgaactcctgagctcaagtgatccgcctgccttggcctttcagagtgaaaaaacattcttttactaattagacttttttatgggtcaagagaatgcacagattacccatggtgatgggggcttattgaaagcacaacttcccagctgtgtcggaggggcttttattgccctataccccatcgatttggcccttgtaaattccacattttatcatgcatcactcaaaacattctgcatccagcacttatttctaattcaggtaaaactctatatattgcagatatcagaatcaaacaaccgtgaactagcttaggctaaagaatgaaacaaattagctcatgtataagggagtctggcttcaggctcagcttacacttgaattcaaaagatgtcaacaggtcctggtttttctgcctttgagtcttggttctaattcatcagtgttcacaccattctctgtccagtgttgttgcaagatggctgcactagctctagcttctacatatacataatgctgagtccagaaggactgatagcttaagcacatattgtaggacaatcttgattgagctttattgccttgtttgaggcatgtttcaacttctttttttacttattagagatgaggtcttattctgttgcccaggctggagggcagttgtgtaatcatagttcactgcagccttgaatttctgggcttaagccttctgagtagctgggattaaaggtgcaagtcaccatgcctggctgtttcaacttccagttgaacaccatgattagaagaatgggatgcattgattggcttaggcttggattatatgctctgtctctgggtagattcagcttcactcaaaacacaagggctgagaatggggaagaagtggttctttccaagcaaaatcagaataaattctgggttgcaaaaacatctcatattgcataatttctctactgttgccttctttggcacttgcaactgataattgtctcagtgaaacactctyttctcttggcttctccaatgcattgctttccctgaaattctatttatactcctttggaacatttgtttttgtttttgttttgagacagaatctcactctgtcacccagggtggagtgcagtggtgcgatctcagctcacctcccaggttcaagtgattctcctgcctcaacctcctgagtaggtgggattacagtcatgtgccaccacgcccggctaatttttttgtatatattttagtagagacggggtttcactatgtttgtcgggctggtctcgaactcctgacctcgtgatccgcccacctcggcctcccaaagtgctgctcccaaagggctgcgtgagccaccacgcccagcgttggracgtttttgcaatacctctgtagagtttctggtccttagaggatcactgctggggttcagggtctcaggaggctagtcacaagagatagcaggagatctcaaaacttccatagagtcagaggagatataaagatatataaagtggcttagaaaacttggttaagctgctactaaggcttaggcatctgtggcacagggttggctaaatgtgggatccagaggagataagtaatcttgctcccaagtttgactctttccaggattcctacaaatctagaatgatgtccctcagttcttgtggatgttatcttgccccaccaagatgggattaatgctctctcttcatgcattcttaatgacttagtcttttggggcaacctactgtctttgacctttggggagtaggaaccagggtcctcagattcagttgtgtggatttcaatttttttgatgctgcttctcttgagagaagctggctttagatatcagcactgcggacagcagccatagtttctccttttatgcaggaggtctccagtggaagcctcatcgcccatgacatgcaattcacaattttggaatgaatagatgaaggagtgaaaggggcattctccagccagtctattcagtctgtgtggatgagagatatcatggtcagattacctttagaactggacatgtacaatcaattcttgctatttgggctagctatgttctataaagctgccacaaacactgaattagtgaatactgaaccattgcttctagaagaaatatagagttcggttcccgagagcctctggtcacaacgttgtcattaactgatcgatacgtaactttgttttatgtgtgttcttgtttaaagtcaccttgtttaatatatagttgattcaataacattgaaataatggccaacagcactatataactcatgcctgaataaagcttacctaacacatatattttttcagtaaggcacatacagccttcctgtgcttaggaatattagatagcacttcagcgctagggagcaaactcaccaacaaaacaaaaatgtgaaaattgtggcagcctatataggctgcaaaaaaggacatgagtttacagtataagagctgaaacaagagggtagagtgttgccttatttgacctcagctgggaacaagcacagtgggtgactaaaatttttgctgcttggcacatgtccctaaaggcattgcaagtattgattttagggttacaaataaattctagtgaaatatgaaatccatgaataatgagaattgactgggtttttttttagttttctttaagcccgtgggtttgttcttcatcttttggatttttctccaagtctcagaacacaaaagatactcagaggttatggaagatgatgtccttacaatggcccataaggccctacatgatttcattcactctcccttttcttgagtctgagagtgtagagttaggttattgatttgagatctttcttcttttttaatgtaggtgttcacagctgtaaatttctccctaataactgcttaagctacatcctctaatttttatatgttgtgtcatttttactcacctcaaaatattttctaatttctctgttggtttattttttaattttttaatttttttttttttgagacagagtcttgcactgtcacccaggctggagtgcaatgatgcaatctctgttcactgcaacttccatctcccaggttcaagcaattctacctcagcctcccaagtagctgggattacaggcttcygccaacacgctctactgattttttgtatttttagtagagatgggatttcactatgttggccaggctggtcttgaactcctgacctcatgatctgccctcctcagcctcccaaagtgctgggattacaggcatgagccaccatgcccagccggtggtttcttttttgatccaatatttatttgggagtgtcttaattgtcacatatttgtgaatttcccaaatttctttctgtcactgatttacaattccactaaattgtgcttagagtacaacggcccccaagtgtagtgcraagtgctatctagtattcctaagcacagcaagactgtatgtgccttactgagaaaggcatatgttagacaggctttattaaggcatgaattatagtaatgttggccatgatgtcaatgttattgcatcaactacatattaaataaggtgactttaaacagaaacacacataaagcaaagttacatattgatcagttgatgaaaatgttgtgaccagaggctctyggaaacctaactctgtattttgtctagaagcaatggttgaccttctccccattttaacctgagctgcctaatgcacagtggggctggggaggggctgggggaagcagggctgaatcttggatcctggggaaagttaaagatgcagaagtgatgtcagctctctgtagcgcagttcccttcctggtccttgccacacagcaccttctacagagactagctctgtgggtggcgggggcccccacaggccccactgcttcccctccccgctgcccgtgctgcttctctgtgcctgctgttggagctctgatgaaggagtagctggctgccttgtgagctggagggggctggggcatctgcctgggtctttgcggagagctgcttatgggtgtggtctgtccaggcatgttgtttcaaaggcggtggacgtgagcaaaagcatcctcacagttgatcaataacttttcttgtttttaaaccatcatgtcttcattttacattggaataaagcgagtttttgaaacctgccaaaaaaaaaaaaaaaaaaaaaaagaagaaagaatggttcagtattcactaagtcagtgtttgtggcaactttatagaacatagctatccacaacagcaagaatrggccaggcgtggtggctcatgccagtaatcccagaactttgggaggctgagacaggcagatcacctgaggtcaggagtgcgagaccagcttgaccaatatggtgaaaccctacctctactaaaactacaaaaattaacctggcatggtggtgagtgcctgtagtcccagctacttgggagcctgaggcaggagaatcgcttgaacccaggaggcagaggttgctgtgagccgagatggtgtcactgcactccagcctgggtgacagagctagactctatctcaaaaaaaaaaaaaaagaaaaaaattgtgcatgtccggttctaaaggtaatctgaccatgatatcactcatctatacasactgaataggctggctggacaatgtccctttcactccttcatcctccttactgtattcatttcaacattgtgaatggcatttcatgggagatgggcatcccattagagacctctggcactgcatgatttcaatcttttaaatgtacttggttgggcttgttttgtggcctgtcatatggtctatcctggagccttacatgatttagtaatgttgccagaaggctcaggaaggtctcccgatgccgctgaggcctcagtcctagccactggccagattctttacactgtcgggagaaaaaattcagggatgagtcagaatgaagcaagaagcttttattgcaaagtgggaacacacacttaagagagaagggcgggcatgcttgggagaacgaatctcacacgatggagtttgggtttctaattctatgggtgtctcttcaattaggggttggaataatcagtaggtattctgcaaaaggaggaaatttcagggaccccaattactgcctacgtgtttgcctggaagagtcatggacacgtcatcctgaccagggttttggccattttctctcccttcttttgtgttttcggttatcctgtggtttctttgcctagttcttgtttgagctgttgtttgggcttttccatcctcctgtgatcacccagtgctgttcctatctcggtaccactcaaacctcaaatcctactattcaccctgtgtttatttctctctagccactctggcctccttgctgttttgcaaactcatccaggcacgttcctttctgaaagcctttggagttggctctgctctgactggaatgctctccctcctgatttttgcctggctccctatttcacctccctcagatctttgctcaagagtcactctcccagcaagggaccattgctatttattcataaccacgctatttaaaatttcaaccccatgtacattttctttagtttccctgtccagctttattttctccatagtgccaattttctgtttaaattttttttgcttttaagtatatatatatatttctaataatttacatctatgatataggtttctttatttttatgtaatttttaatttttgttggtacatagtatgtgcatatatttatggggtacatgagatgttttgatacaggcatgaaatgtgagataagcacatcatggataatggaatatccatcccttcaagcatttatcatttgagttacaaacaatccaatgacactctttattttaaaatgtacagttaaattattattgactttaggccgggtgcagtggctcatgcctgtaatcctagcactttgggaggctgaggtggctggattgcttgagctcaggagtacaagaccagcctgggcaacacggcaaaaccccatctctactaaaaatacaaaaattagccaggtgtggtgacacacacctgtcgtcccacctacttaggaggctgaggcaggaggatcacttcagcctgagagacagaggttgcagtgagccgagattgtgccattgcactccagcctgggcaagagtgagatcctgtccccaaaaaaagttattcttgactttagccaccctgttgtgcaatcaaataataggtcttattcattctttctatttttttgtacccattaaccatcccaccccaccacccttcccagtctctggtaaccatccttctactctctatgtccatgagttcaattgttctaatttttagattccacaaataagggagaacatgtgatgtttgtctttctgcatagcatcaatttccgtctgacacaatgtatctattacttgttagttgtctgtctttctacattagaatgcaggcttctccagagcaggcatttctgccttttgttcactgctctatcctcaatctgaagaacagtgcctggcacacaatgggagctcaacacatattttgtgagtgaacaagtgagtaaaataatagaaccagttctgatttgggttatggtcatctcctctgtctccaaaagactgtgcttgagaaagaggttgtctcagacaatggaaatgcaggctggagggctgaatggaccagtcagagacagttatattacaatttgtatattccatgtgggctagaacttggttatgaatgataggcacaggaccaccttcatgggtatgtgacctgtgtggttgtccaaggccccatgcttagaaggagcttgggcttggtttgatgctttactgtcttgaaatttttagaaatttttgaacaaggggctctgctccttcattttatttcatttttactgggtcctggatatgcagattccttgcatttaagaacactgataggctgggcactgttgtcctagcactttgggaggctgagagatgaagattgcaatgagccgtgattgcaccactgcactccagcctgggcaacagagtgcgaccctatctcaaaagaaacaaacaaacaaaacaaaaaaacagaaaaactgaaaaacgttgataaaggtggataattgctagaccaaaccttaatagaatccaattgaacttggagcttttctagcaggaagagagccagtactcaggttgaaaacatgggctagacagtttaggctctggaggaaaaacaagtaaactgtaagctaacattcactaaatttaaattctatgagagcagagattttgtctgtttgtattggttaaaaaaagaagaatggatgttcaacatatgattatttcagcctgccttccttccttccttccttcctttcttccttccttccttcctttcttccctccctccctcccttcttccttccttccttcctttctttctttctttttttctttctttctctctttctttctttctttctttctttctttctttctttctttctttctctttccttccttccttctttctttctttctttctctctctctctttctctctctctccctctctccctccctccctccctcgcttccttcctttttttttttttttttttatggagacaaagtcccrctctgttgcccagtctggagtacagtggcatgatcacaactcactacaacctctctgcctcctaggctcaagtgatcctcctgcctcagcctcctgagtagctgggactacaggtgcatgccatcatgcccagttaatttttatatgttttgtagagggaagttttctccatgttgcccaggctgctctggaactcctgggatcaagcagttgcctgccttggcctcccaaagtgctgggattacagacatgagccagcacacccagccagctttttcatatgcttaaaaaacttcacaataaaaagtttagaaagtaagaagtagaataacatatgtggtaatacgtgtaatataaatatgtataatgtataaaatatactttgtggtagtatcaatgacataatatgtacatttgtaggttttttattcatttacagatgaagataatctgttgctccatggtcaaatcaatagctaacccgatgattgattgatcttttacaatgtttttaagcatcttttggtaaataatcaatttaaattagcaggagggaattttgctatttgaacaggtattaatggtttaaggactgtctgtttttaaatactttgaaatgtgcttaaattttgtttaataatatgttaagcaatatttaaatattaaaattttgctcaataatcactaaccccagacaaaaaaatttcacctcattgttaacaattttgtgtattcttttaggcttaaaaattattatgtaaatatagaaaactacatatatgacctaagtgggcttatatttttctgtaattttttttcacttaactataaattatggtaatctttccctgtaaatccataaagaggtatcttattctttttaaccagcctcacagtgtttccagtacttcttggtctatagatatttttccttatcccatttagatggcaagttttcatgaaaatgtgatataattatgcaaaaaamgtttaaagtttaaagtgaaaagagaatctttgaagagattccaggttttctccagaccatgctaatcaggtttcccccctcartttaattcaagatatttcatagaagccttcaaattttattttctaaaacactagatcatgatgttattggtgaccctctggggttggacagggtgcaatcaattaagattacagtcagctctgagtattaggagcccagattaatcgtgacttaaacaactaagtcggctcaggtggaaatttataactctaatgcatattttttttgtttatttgtttatttatttatttattttttagagggagtttcactcttgttgcccagcctggagtgcaatggcacgatctcagttctctggaacctctgtctcccgggttcaagcaattcttctgcctcagcctcccaagtagctgggattacaggcatgcgccaccacacctggctaattttgtttttttttttttttgagatggagtctcactctgttacccaggctggagtgcagtggtgcgatctctgctcactgcaacctccacctcctgggttcaagtgattctcctgccttagtctcctgaggagctgggattacaggcgtgtgccaccacgcctggctaatttttctatttttagtagagatggggtttcaccatgtttgtcaggctggtcttgaactcctgacctcgtgatcgtgatctgccctccttggcctcccaaagtgctgggattacaggcatgagccactgtgcccagctaattttgtatttttagtagagatggggtttcaccatgttggccaggctggtcttgaactcctgacctcaggtggtcctcccgccttggcctcccaaagtggggggattacaagcgttagccatcgcaatcagccttaatggatatattttaaaagaatatttcctggcaaggatgcagggaaactacatctctcatatattgagagattggtgggaacgtcatacggcacagccactctggaaaatagtttgggagtttcttgtaaaactgaacatacacttaccaaaaaacctagcaattgcattctcaggcattttccccagaaaaatagaaacttatgttcagacaaatacctgtctatttaagacatacataaatgagtgtatgttaaatacctgtacatcaatgttcataacagctttattttaatagacacaaattgggaataaaagaaatgtctttcagtgggtgaatgattaaacaaactctcgtgcaatcatacaatggaatactactcagcaataaaaaggaatgaaatattgatacatgcaatagcttggatgaacctcaagggcattgtgcttagtgaaaaaatgtcaacgttaagaggttgtgtacyacatgtctccctttacacaacattctcaaactgacaaaactatagagatggagaacagattggtggttgctaagggacagggactggggtaaaagcatatggatggaaatatagaggggcagcaggagggagttcctttatgatgatagaccagttctgtatcttgattgcagtayggttacatgaatctatacatgagtttggattgcacagacaccccwccccaccccacacataaatgaatgcatgttaaaactggcgaaataaaatctgtagtctagtcaacaattgtgtactaatgtcaatttcctagttttaacattttgctttagttatgtaagatgtcaccataagtagaagctgagtgaagggctcaagaaactctacgagggccaggcacagtggctcatacctgtaatctcaacactttgggaggccaaagtgggtgaattgtttgagcctaggagttccagaccagcctgggcaacatagggagatgcatcactacaaaacaatacaaaagctagccaggcatggtggtgtgcacctgtagttccatcaactcagttgtctgaggcaagaggattgcttgagctagagaggttgaggctgcagtgagccaagattgggccactgcactccagcctgggtgacagggtgagatcctttctcaaacaaacaaacaaacaaaacaaaacaaaaacacaccaagaaaagaaactctatgtactaattttataacttcttataattatttcaaaataaaaagttaaattctaaaaaattgaaaaccaatgatctaagcttccatctcaagctagaacaagaacagtaaattaaacccaaataagttggaatgaagaaaataataaagagtagggatcaacaaagtaatgaagataagttttttaatataaagttttgatctctggtagtgtaagttctcattcttcaagattattttggctgttctaggtatcttgcatgtcctcataaagtttagaattagcttgtcaaattccacacataaaaaataagcttgctgctattttgatagagaatgtgctgaatctacagatcaattttgtgagaactgacatttttacaatattgagtcatctaaccatgaacatggtatatcttgccatttatttagtgcttcttaatttctatcagcaatgttttgtagttttcagtgcaggggtcttacatgtttcttgtcagatttatttctaggtatttgatgagttttgctattgttacaaatgactgtgttttccatttcattttctttttctttttttagagatgggatcttgccctgtcatccatgctggagtgtggtggaacaatcatggctcattgcatgattgaattccttggctcaggtgatcctcccatctcagcctctcaagtagctgggattacaggcaccagccaccacacatcactaatttttaattttttttttgttaagataggagtctcgctatgttgcccaggctggtctcgaactcctggcctcaagcaatcctccctctctggactcccaaattattggaatttcaggtgtgagttatcacaccyggtctttaatttgattttctacttgtgtgttactaatacattggagttagtgcagctgttcaaggatgtcgtcaagaatcagcctcttgttttctgtggcttctccactcttagcatgtggttttcatggtcaaggtcacaaaatgactactgcatccccatgcctggaaaaccatttcccaagaggaagaagcagcaagtgacaaggtggaaaggagagcactgagattaagaaagaaaaactttcttagaagtcactacagatttctgttctatttcagtcattagaaggcaaactgggatttttaaatttttaatttaatttaatttaatttttagacagggtctcactctgttattcaggctggaatgcagtggtgcaatcactgggtttgagtgactggctcactgcagcctcaaactctggggttcaagtgatcctcttgcctcagcctcctgagtagctgggactacaggcatgtgccaccgcacccagcttttttttttttttttttttttaatagagacagggtctcactatgttgcctagactggtcctgaattcctggcctccagccatcttcctgccttgggttcccagagcactggaattacaggtgtgagccactgtgcctggatgaaaatgggattttaaaattaggtacatcgctgctccaaacaaaatcagcattctattggtaaatcgtaagaggggaatagatattaggtgggaaaccagcaatgtcagccacaacatggaaaaggatttagatctcatggcaccatgtactcctaccattctctcaataaggttaaggcacagtttttatttaatgttctatgttattatgactatgcaaatattattccctactgatctgtgtcaagtactatgattacatttcctcttttggtcaacttctgtattttccttggaattatggcttcttctttttgtttgctcagttttctctgtcactgtctctaattctttcttttttttcttttttttcaagatggagttttgctcttgttgcccagactggagtgtaatggcacgatcttggctcaccacaacctccatctcccaggttcaagcgattctcctgcctcagcctcccaagtagctgggattacaggcatgtgccaccacatccgaataattttgtgtttttagtagagacggggtttctccacgttggtcaggctggtctcgaactctcgatctcaggtgatctgcccatctcggcctcccaaagtgctgggattacaggtgtaagccactgtgcctggctgctgtctccaattctttctaagctctccaacagaattgcaaaattctgctaaaaatatttttttcatgtagtcaggcacatcaagtttctctttttttttcccctccctggacatatctctcctagggcctcctataattttactcagtctgaactgattgttctctaagcattctggaattttctttggcctctctctgtgttatgttttctgtaccctggctctcctgccgatctttatggcttaatctctcattttggttgaccatattttccaatagcttcctgacaaagaagtcataagaagtacattttttgaggcaatgcgtgaaaatgcctttattccatcctcacacttgattgatagtttggatactggaaatactagttcctccttattttgaaagcattatttcattgtgttttgcttcttgtgttgcttttgaaagtctgaggacattctgatggtcttttttcctgattgtcacatttatttatttatatatttacttacttatttatttattttgagacagtcttactctgagttagagtgcagtggcaccatctcggctcactgcaacctccgtcttctgggttcaagcgattttcatgcttcagcttcctaagcagctgggactacaggtgcgccaccatgcccagctgattttttgtttattttagtaaagacagggtttcagcatgttggccaggttggtctcaaactcccggcctcaagtgatccacccacctcagcctcccaatgttagttttaaacgtaactctgtggcctgtgctttttcattatagacatttcaaagatatatctgttttcggtgttctaaaatttcctattaggttagtgcaaaaggaattgcggttttgccattactttagcatcaaaataattcatgcttcggcataggtcttttaaaaatacattgtgctgggtgcttttaatctggacgctcatgttcttcagttctggacattttcttctattattttctgatggagattactgctcttcttgtataactcctgtcaggtgatttttaatgttcaatgaattatctaattttattatgattttctcttttctttgcatctgtttttttttttctattctacttttttggagatttctgcaagtttattttccaattcttcttccctcttctatcaaatctttagtcygggtgcggtggctcacgcctgtaatctcatcactttgggaggccaaggcaggcagatcacctgagcctgagctcaggagttcgagatcagcctggccaacgtggcaaaaccccgtccctactaacaatacaaaaaattagccaggcatagtggcacacacctgtaaacccagctacktgggaggatgaggcagaagaatcgcttgaacccgggaggcagaggttgcagtgagccgagatcataccattgcactccagcctggtcaacagggtgagactctgtcttaaaaaaaaaaaaaaaaaaaaaaaaaaaaaaaaaaggacctcatggggacttggtaaagagtgctgaagattacctgggcaaaaayaaaaatttggaagatgctgtcagtgaccatgtatataatgcaatggataatatgtacttgaattcaaaactttagaaatgaaatttgaggatagaggaggaattttttaaaaactggtgtgagttaaacatatcaattttcttctgctccacgccagaattttactaaaatcagagtaaaaaagtaaaaaagatgtagaaccacaacagagagctcagaagaggagaacccagtcaatgagagattgtgtaagtcaagattgcattggaaaagcagaaaccaacttgtatatttcaagtaggaaaggtttgaatatggagaatttcaggcttaccccaccattggaaggctggggaaatgaagggcaggcaagccactgccaccagtcttagacgatagcactgaagtgagtgaatctcacggcctcccatggaaactctgtgcgtcttttaagggctgggctgggactggagtaggactagtgagggagtcttctcaggtacaagttttaagggggcatcaaagaatattttagtgcaatatatacatatatacacatatatatacacacwatatacacacacayacacacacacacacacayayatatatatatatatatattttgttttggagacagagtgtcactctattgcccaggttggagtgcagtggcatgatcttcgctcactgcaacctctgcctcttggattcaagtgattctcctgcctcagcctcccragtagctggaattacacacacycgccaccacacctggctaatgtttgtatttttagtagagtcagggtttcaccatgttggccaggctggtctcaaactcctgacctcaagtgatccacccaccttggcctcccaaagtgctaggattacaggtgtgaaccactgcacccagccatgcaatatatttttaagcattatttatttatttatagaggtgaggggtcttgctatgttgcccaggctggtctccaactcctggcctcaagcaatcctcccacttcagcctgccaagtagctgggactataagctcgagccactatgcccatcaaaattttttttttcattgacaaggaataattatgtgtttatggagtaccatgtgatgttttgatctatgcatgcattgcagaaagaaccaatccagctaattaacatttcaatgcaatattttttaaaaacaaacaatgtgaaaaaaatccatgatcaacaaaatgtccgaatttttagtaaaaacaacatccaatcctgcacttgcacaaccctctctcactcacgtctccctcatctcatctctgctcaagagctctgtgaagactgagttactgtcttcttggcaacccacagccctgagatgggtcatttgcaacagcatgcctgaaagccaatgagacctcaggtctgcagttttattcatccagtctgcccacaactgctgccaaagaacagcttttccttttgtcttccaaatctttgcaagtacctctcattggcaaactctaagaaagagattcttgaaaatgtaattctgtgatgccgagaacactgtagaagagggagggaatgctgtcaggttaataacagacaatccagcagagagatgtcaagaggtttcaaaaagctggaagtcaggtaaagatattagtagtactgagaattgtgactctcaaatacttgcagagaggaagccaacagcatgcacattgacagagcaggagcatcgccatcttggacaagcactgccattctaagtttccccttgatcaaaaactgcctgattttaaagggcatcaacctaatggctaaggtcaccacgaacataaaccacaaatgacttctctgaccagaaacattccaaacccctcctcgaccagagatatgccagccctgagataacctcccctctgaccacagagatgttagccccaagataacctcccctctgaccagagaaattccagccctgccatgaacttctccccacaagcctataataagctctcaccctaaaactgaaaratgctcttagtctgtaagagagagcgctcctgacagaaatcagccagaagcccctcttaggtttattctccaaaataaacctgtctttgtcgagccacttttcgtgtttctttcctctttctttaactcttacacacatcttcatagtctctaacatgtcagcgttatggactggattgtgttcctccaaaatttattcatttatttttctttatttatttattttgagacggaatctcactctgctgcccagggtggagtatagtgacacgatcttggctcactgcaagctccacctcccaggttgaggcaattctcatgcctcaggctcctgagtacctaggattacaggcatgtgccaccactcccagctaatttttttgtatttttaatagagacagagttttgccatgttgcccaggctggtctggaactcctggcctcaagtgatccacccgccttggcctcccaaagtgctggggttacaggcatgagccaccacgcctggcctcctccaaaatgtatatgttgaagtcttaacccctggtaactcagaatatgattgtacttggagatagtttttaaagaggaaattaatgttaaatgaggtcatttgggtgagccataatccaatatgactggtgtccttataagaagagagattggggcgcagacacagagggaagaccatgtgaagacatggggatgagaaggtggccatctacaagctagggagagaggcctcagaagaaatcaaccctgccaacaccttaatctcagactttcagcctcctaaattgtgaaaaaataaatgyctgttgtttaagccacccgatctgtgatttttggttatgggaggctgcattagtcagggtttttgagagggacagaactaataggatagatgtgtatatgaaagggattttattaagaattcactcatacgatcacaaggtgaaatcccacaataggacatctgcaagctgaggagccaggaagccagtccaagtcccaaaacctcaaaaattgggaagctgatagtgaagccttcggtctgtggcctaaggcccaagagcccctggcaaaccactggcgtaagtccaagagtccaaaagccgaaaaacttggagtctgatattcaagggcaggaagcatccagcacgggagaaagatgaaggccggaagactcagcaagtcaagtccttccacgttctgcggcctgcttttattctaaccacactggcagctgactagatggtgcccacccagattgagggtgggtctgcctctcccagtccactgaatcaaatattaatctcttttggcaacaccctcacagacacacccaggaacaatactttgcatccttcaatccaatcaagttgacactcggtattaaccatcacacagccccaactaacatagtcgggaattggaggcatcagatgcagcaaaagctgggtaagcttaagcatggggcttaacatagggaccctagttgaaagtctgtatgtttagacccttagggaacctcacttatcacacacatccagacaattacacttctagccccagccctccagcatgaagtgcagtcaacaaagacattaaactagagagctccaagttcagagaagcaaggctccaaattcagcaagcaagtcctttacctagcaaagggctggaaagaaaaataattctgaaaactggggaaccaatagaagattgcaacctaaagattaagacatcagcccctacctaatctatttctgccttttggtcccagactggtgtaggcgacagcaggaaattgggcattcttttcaggagaaatagacaaggctctgaaaaggtctgcatgcggtgacatttgaggatctgacacaaatggctggcttccttctgaacatcttacatttggtcctctgagttgaaaagccccacctcacgagcacaaccttttagtatttcactgttaaagataatagcccacagccgggaacagcctcccgagtagccgggattacaagtacctgccaccgcaccrggctaatttttgtatttttggtaaagatgggttttcaccatattggccaggctggtcttgaactcctgacctcgtgatctgcctgcgttggcctcccaaagtgctgggattacaggcgtgatttatttttatttcttgctctgtctgcaggctggagtgcagtgcgatcatagctcactgaagcctcaaattcttgggctcaagaagtcttcctgcctcagcctcccacgtagttgggactatagttttttttttttttttaattagccgccacacctgactaattttttcaaatctctttttcttgttttgttttgttttgttttgtttttgcctgccaggcatggtggctcatgcctgtaatcccagcactttgggaagcggaggtgggaggatcacttgagctcaggagttcgagaccagcctggcaccatggcaaaatcctgtctctacaaaagaatacaaaaaattagcagggtgtggtgacatgcacctatagttccagctactcaggaagcttaggtgggaggattgcttgagcctgggaggtagaggctgcagtgagccgtgattgtgccactgcactccagcctgggtgaaagagcaagaccctgtctcaaaaaaaaaaaaaaatttagaaatgggggttttaccatgttgcccagggtggtctcaaactcctggaacgaggtcttacattttctgatcctttgcctgtctcctccacctcatctttggccatttcctgctttgctcagttcatggcagccactctgatctgcttgttcttcttggwacaggccagacttatttccaacttgggccttttgcagttcctctttcctctgtctggatggtccccagatttccataggtgcttgttgccacacctcattcagttccctgctcaaatatccttcctcagagaggctatcttcaacattctacataacacactctctgcccaccacttcctgtctcttttcttggttttgtttttcttccaagcaattaacagtagctgaaattttattacacacagtatttgtgtgtttgcttattttctgttgtcttcccctagcatggaaaatactttgtattttcactgtgacacccccaaaatctatttttttttttttgagataggatcttgctctgtcgcctaggctggagtgcagcygcgcaatcacagctcactgcaacctgtaactcccggcctcaagtggatcctcccgcctccgcctcccaaagtgctgggattacaagcctgagccattgcgtccagcctgtccccagctttgtctcccactatggaagctggaggaaggtgatggttccttccctactttccagctgctggtgaccagacctaggacctagggcccaaccaaatggatgcttccattttgagctaagaatgctgaaggtattatattggtccattttgcattgttataaaggaatacccaaaactgggtaatttacaaagaaaagagtttcttttggctcatggttctgcaggctgtacaagaagcaccgtgccagtctgatgcttccacttatggcagaaggtgaaagggactcagctgtgtcacatggcaagaaagggagcaagaaggaagggaggaggtgccaggctctttttaacaattggatctcctgtgaaccaacagagtgagaactcactcattacttcgaggactacaccaagccattcatgagggatctgctcccgtgactcaaacacctcccactaggacccgccttcaacatcagggaccctttcctcccctctcctctccctcctcccctatttctcctttcctggatctcttttcttttcttttcttttttcttttcttttcccttcctttccctttccttcccttcccttcccttcccttcccttcccttcccttcccttctcttctcttttccctcccttcccctcccctcccctcccctccccttcccttccattcccttcctttcccttcctgtcttcccttcccttctcgactcttctattctcttcttttttgagacagggtcttgctcttgtcacccaggctggagtgcagcagcatgatcacggttcactgcagccttgactacctgagctcaggtgattctcccacctcagcctcccaagtagctgtgcctacaggtgtgcaccaccatgcctggctattttttttatttttttgtacagatgggatccctctatgttgcccaggctggtcttaaatctctgggctcaagcaatcttcccgcctttggcctccaaagtgttgggattacaggtgtctgccactgcacccagccagggatcacatttcaacataagatttggaggggaaaaatatctaaactctatcagataggaaagcaaaagttcagagacatttggaagttattcaaggttacacagtggctacagcagaactaagaggcaagtggtgcggctaccactgtctgaaggtggcgccagcttcaccgacggcgccaacagtgacatcttaagcagcattttctggagcagagtcctggctatgtactgtcttccttggtttcctaagtctgattctgaagcttttctagcagttatgtgagctgttgatatccttctaaagatctccttttctgcttaagttagcaaaagtcatttatgttgtctgcaactaagaacttacgatgggtatacaggtcaaaggagaaaaatgcaaaggctcatctctgttgatgcccagaaggcatttgataaaattcaagaccaattcctgataataacccttcctgaagtaggaatacatggataccactttaacgcaataaataatatatatctcaaaccaaaagcaagcatgcttaatggtaaagcactggatgaaatgctattaaaggcagaaacaatgcaggctttcctactctccttactattacagacaaaattctggaagggcaattagacaagagaaaaaaaaagatgaggtacaactattataaacaaagtggcgaggtttttatctcatgtgttgatataaattcctgagaaacccaataggatcaactgaaaattatgagaaagaactaaagtacatcaaggtggctggttacaaaaatattttttttcctgtagacaaacaacagaaaatataatgacataaaatatcccattcataatagcaaccaataggaataaacttattagtattatgcaagacctatgggaggaaactatagtactgggaggggcattaaaagcccttgtataattttttgaagacagactttattctcagatgagaagataaatattgtggtgatgccagttttccctcacttaatctatataaattaacccccctaaaggattaaattcatttgagagaataagcaaacagacagataataaaatactaggagataatgctctatcaaacatttcagcatattctaaacctatgctatcctggaatacagaggcttatcaatgggatagaacagaatttttaaaaatcttaaatatacggggcatttaataggtgataaaagcagcattttaaagtagtgggaaaattacatttaaaaatggtgctgagacaattggctagccatgaagcatgcagaaaaggcaagatccctatctcatttctcatgcaaaaataaattccagatggagagcataataataagaaaaaaacccagaactgcactaaattaaaatacagatgaatattcttatgatcttggagtgggggaaggctaagtatgtcaaaaatattgtaaatctttatgaaaaagactaatctgtttcactatataaaataatttaggctgggcttagtggcttacacctgtaatcctagcactttgggaggctgaggcgggtggatggcttgggtgggtggatggcttgaccctaggagtttgcgaccagcctagataacgtgatgaaaccctgtctctgctaaaaatacaaaaagttagctgggcgtggtggcatgcacctgtaatcccagctactgaggaggctgaggtgggaggatcgcttgagcccgggaagtcaaggctgcagtgagccatgatcacaccactgcactccagtctggatgatggagtgagaccctgtctcaaaaataataataaaataaaaataataatttaagttctgtatatgatatgaaaacactgtaaacatggttgaaagggaagtagggaatggtatagactgaaaaataatataatttatatagaaaataattttatggaccaggtgtagtggctcatgcctgtaatcccagcactttgggaggccaaggcagacggatcatttgaggtcatgagctcaagaccagcctggccaacatggtgaaaccctgtctctattaaaaatacaaaaatttggctgggcgcagtgtctcacgactgtaatccagcactttgggaggccgaggcgggcggatcacgaggttaagagatcgagactatcctggccaacatggtgaaaccccgtctctactaaaaatacaaaaattagctgggtgtggtggtgcgtgcctgtagtcccagctacttgggaggctgaggcaggagagtcgcttgaacccgggaggcagaggttgcagtgagctgagatcgtgccactgcactccagcctggcgacagagcaagactctgtctcaaaataataataataataataataatagtacaaaatcagctgggcgtggtggtacatgcctgtaatcccagctacttgggaggctgaggcacgacaatggcctgaacccaagaggcagaggttgcagtgagctgagatcatgtcactgcactctagcctgggcgatggagtgagactccatctcaaaaacaaaacaaacaaacaaaaaacttctacgagataatatctataaaggaatacaccgaaaagaataatgggcaaatggtgtgtgcaggtgaatcacaccagtaaaaataaaatcgctaattaaaaggtattcctagttgttttcttgattgcaaacagcagaaactgacactggtttgtttccccaataaaggatttacaggaaacctatcaggttagctcacagaaagaacagagccagagaaacaggcttgggcagaaacccagggacacagacaccagtaagaacttgccactagagtagcagctggacacttgctgctaccacccccacactgtacaccaccgtactgccacactgctaaatatatagctgctagattcattaattcactgcattatctccaacgaaccgtgtatcaatacttctagagccaaagtctaggtaggaacatatagttggtcttgctctgtcacccaggctggagggcagtggcacgatcatagctcattgcagcctccacctcctaggctcaagtaatccttccgcctcagcctcctgagtagctgggactacagaagtgcaccaccacaccaggcttatttatttatttttttagagacgggatctcgtgatgttgcccagcctggtctcaaactcttcccgtctctgtctgcctgtgctgagattacaggcatgagccactgcacccggcggtggtcttttttaggtcatgttcctgggctctagcttccaggggtaggaaggggaatacctgctccctgccaccctacccagttttcatagtgggatcttgagtggtcctgcctaatttggtatcccttgcagacaggaagttggttgagatgttggatagcagagagactggcacatgatgttcaaccttactcatacaaacaaaaagtgcattaatatgccatcttttgttcatcaaacttgtcaatgtgaaaaagactggaaaactcaacagtatgttgggattgggaaatgtgcatttcccattagttgctgacaggataaaacctttctgggggtcagcttgacaataggtgtcatatatggamtacgcataccctttgatccaaggtttcagcctaaggagatagctacatgatggacaaggtataggtcatgataatattcactgcactgttgtttctaatttacgtttcccgagcttaggggtaaggggtggtacagagagggacaatgaaagattcactacagaatgttcaaggtgagtctttaagaatgatcatctgaacattccaatgaggaattttttcaagcctgtgtcaaactttgaggctcagtggagacctataagacctgtaagcttagtgagaggggcccagactgggaaggcagttcttaggtatcccaccaagaagttcagatattgtttagaggccgggcgcggtgcctcatgcctgtaatcccagcacttcgggaggctgagacaggtggatcacttgaggtcaggagttcgagaccagcctggccaacatggtgaaaccccgtctctactaaaaatacaaaaattagggcaacacgctcgggtccccttctacgctgtggaagctttattcttttgctcttcacaataaatcttgctgctgctcacaaaacaaaacaaaacaaaaaacaaaaaacaaaaattagccaggtgtgctggcaagtgcctgtaatcccagctactcaggagtctgaggcaggagaattgcttgaacccaggagatgggggttgcaggtgagctgagatcccgccactgcactccagcctggttgttagagtgagactccatcacacacacatacacacacacacacacacacacacacacacacacacacacacacgacattgtttaggtataaagttgccaaataatcaacctgttatataatggctaccttactgggtaccgaataatgagtaagatgggtctctactgggttgaagcccacatattagtgaaggtgatgattgtaaactgaattgcaatatggtcaagtcagtgtcatgaatgagaggtgccaagagggcctgtggaagggacatctcctggagggggtgatatctaaggtgggactttaaggatgaggggaagttagctaagtagaaaggttctaagttagctaaggaaaggttcaagggagagggaacggctccagcaaaggccctcgagtctagatcaaactgcccagaagttgagggccattgcattcacattttagtgtgaataatcagatggctttcttcctggtgtccagataagaattttgactaagaggagagtggagccgattagggacagtgcagagcaccctggagatgtcatcatagagccctacttacattggggagggaggtcaaaggtaaaaaccatttactttgaaacgtggtgtaaggtggccttcatgttttaaaraggaggaagggctctcccttctctgatttctctcttctgcctcaggactcagactagcccttttagcagaggggagcctatagagaggaggtcatatactagttgattttggactaaaggcatcccaaagatgtactattttttgctccctgcactattttttttttaatggaaccaaygtttaaaaataggatttctgccttctcttaaaacatcagatgatctggtaacgctgagctcctgttctcacatgggaacaactggctggagctgagtggcagccacctctttagaaagatgttaatttgaagtctgctatagtccccatcattccttatatttcccccaacactgagacccaagtcacttgaaagtcaatatgatgattcaaacaccaggattcttcactcatttgtgggtttgtgacctgtgatatttgtggattcgtgacctttggtttagaggtcaagtataggggttgtaaataaaacttgggtttgaatcagataagaactgtaccaatctcaaagacggtgaattaaagattaaagaaaatattgcatgyttggcataatgtgtggaacacaacagctattgtaaacacccagtaggaatgtaagctgcaagagggcaggtagaaaccgtgctaatttaatccgctggggatatgacatttgattctaatttaataggtttaattctttgcaatatccccagtaactgctgaatgaatgagtgagtgaatgaatgaatggaatgatgaatgatgggagagcccggaggagttttaaaggctggaatgaaaaggaaagtagttatgataacagcgtttcgctgggactccaaggtgcagccaggaagaaaagcccgctgggacgtgccagggtctgtgactgcgctccgctggcacccagagggtaggtatctgcaacgtcccttgggagccagacagggctgacttgcccaggacctgtcagggccatgtccaccagctcttgcacggtctggtaactgacagcatcctgattcctgcacgttcccgcctctgccatctgaccagcaaagacagagacccaccccggggatccaccatccaacgggagcccagccttttcctccaagccgggacggcgcccacactagacatggcctccctcgggcttcacgcagcaggaccgcgcccgcagcctccaggcatcgcgtccggctggagaggcagctaccgtcccacagtgaacatggcggccgaggcggcttcagcgccgggcgggcggcgccgggaggcacgtcacgtgagcggctcagctgggcggaccgcgcgcgcgcccgctggccccgccggccgccgctcgctcgctggctcggctgcgctttgaggtgtgtggggcgtcgagcccccgggcccggtgaggcgcggcgctgcgggatgcggcggcggccgtggcggggccgcgggccgggcgggcgggcgcggtgatgagtgtctgcggccgccgccatgtccaaggtaacggcgcctgggtccgggccgccggcggcggcgagcgggaaggagaagcgctccttcagcaagcggctgtttcggagcggccgcgctggcggcggcggcgcggggggccccggggcgtccgggccggccgcgccttcctcgccctcctcgccctcctctgcacgctcggtgggcagcttcatgagccgcgttctcaagacgctgtccacgctctcgcaccttagctctgagggcgccgccccagaccgcggcggcctccgcagctgcttcccgcccgggccggccgccgcgcccacgccgccgccgtgcccgccgccgcccgcctctcccgcgccgcccgcttgcgccgccgagccggtgcccggcgtggcggggctccgcaaccacggcaacacgtgcttcatgaacgccacgctgcagtgcctcagcaacaccgagctcttcgccgagtacctggcgctgggccagtaccgggcggggcggcccgagccctcgcctgacccggagcagcctgcgggccgcggcgcgcagggccagggcgaggtcactgagcagctggcgcacctggtgcgggccctctggaccctggagtacaccccgcagcacagccgcgacttcaaggtgagcccgcgcgccgccgcgcccccactgcaccccgagcccctggggcacctgcccgcccaggtcttccttccctcggttcctcttggcccggcaggcttctgcattggttgctccgagtggtctgggcagtcgaccagtgattttaaggagattcattcattcattcatttattcactcactcactcactcaaacatgtatttattgagaacttactacatacgtgcccatactctgtgataataggcaatgggagtgacgttgcaatgaacaagactatccgccttcatggaacttgcatttttgtggggtgggagtgttgagcatgggttcaaatcctggttctgccacttactagcaatgtgacgtcgggtaagttaagcagcctctctgttcttacagtttcttcatctgggggacctactttgtaaggtggttgtgagctgcaaacaagttaatatattaaatcgaacactgtggaattacccatatttaaccgttttttatttacagattggcacttttatagggttcaacctgataagtaaaatacttccatatcatgtgtatttgctgctattatttttgttattaaagacttgaagaagttaacgagataatatcagatagtggtttgaagaaagaaaaacctgctgctgtgattgatgtgctgacaggctactttttatttttattttatttttagagacagggtcttgctctgttgcccaggctggagtgcagtgctcacatagcctcaaactcctgggctcaagcaatcctcccgcctcaccttccagagtatttaatagctgggactacagacacacaccaccatacctacctattttttatttttaaaacacttttgtagagacgggggttttgctgtgttgcccagactggtcttgaactcttgtcctcaagccactctccccgctttggcctcccaaagtgctgggattacaggggtgagctatacatccctgggggtatgtatggcccttggccaagccctcctttgctgtttgctggtggggctgcaagtgtagtgagagggtgagatttgagagccgagtggtgggctgggaccggatggtatgggaccatttaggatgcactaagaaattgggcggttactctaagcagaaggggaacatgatgtgagattgtgtaagggatactttcaggtgggacatgaatatggtattaaacagcatggaatcgggcggggcgcagtggctcatgcctgtaatcctagcactttgggaggccaaggcgggtggatcacctgaggtccgggggttcgagaccagcctgaccaacatggagaaaccccatctctactaaaaatacaaaattagacgggcgtggtggttcatgcctgttatcctggctactcaggaggctgaggcaggagaattgcttgaacctgggaggcggacgttgcagtgagccgagatcgtgccattgcactccagcctgggcaacaggaaactctatctgtaaaaacaaaacaaaacaaaaacagcgtgaagtcacacagggagaaggttaattcctttttttttttcctatcctaatcttgcccaggacgaagtctcagcttgatgttagcctgtttttaatacctcttgttcaccccccacccwtttttttttttttttttaaacagaacaagcttcaagtctagaagcattggcaggtaacagtagctagaatttaataaggttatgtttttattgggtttccatttgtcttcaattcatggcaaaaggtactggtttcccattggtgctataaagcttctttataacaacatttaagtaaaaggagatgattttgttaaaatatgaaaaggtcatctagctgaggatctgctttgttaaggtcctgctttcttgctgacgaactacatggccagtgtgcatctctccccgtttaatactttttacttacatcttatgctgctcaatgctgtttttcttggaaaaaaatcgttgctgtttgatcttggcaatttgaatggaagtacttgactgagatagggactggaaaaaaagatctatgtcagtgatctcaaaattattattattattattatttttgagatggagtctcactctgtcgcccaggctggagggcagtggcctgatctcggcccactgcaacctctgcctcctgtgttcaatcaagcaattctcctgtctcagcctcccaggtagctgggactacaggcgcccgctacatgcccagttaatttttgatccacctgcctcggcctccccaagtgctgagattacaggcgtgagccaccgtgcccagctgagatctcaaaattagaaagggagaatgatcaggagaactgactactgtaggtccaccccccgccccccaccccacactgcccctctttgcttacaattgcctgtaagtagccacagcatttgtaaacttttcgaggtcagagcctagtatttaagtttggttttctcctcttttccaaaatgtgaaaatcagtttctacagcatctttgtatgtgaacatttccattgctttttatgagtttgtgttcacttttttatccattaagctgtgaacagaaatgggtcaataattctagaagtacagagactgatttataggcatgctttggcagacatgaacagattcttagaggcctggctttttaaaagtaatctcctgaacctttagtaggtttcactctacattcattcattcacctcccatttattgaaggcttacttaatcagttaggaatgccttcagcccaagaaaggaaaatccctaatgatagtgccttaagcaatgaaaacgttgcaattggcaattggcacacacagtgattccggaggtggatggttctatggttcagtggctcgttgggcccaacaaggattcagaccatttctgtatttccacctgttgtctttttagctatcattggctttttgttcttaggtttgtcacctcatggttgtccagtgatggcagccactgcacctggcattctacccaggacggcaggaagtcattagggaaataaaaattcttccagaagccccctcagcaggcttctgctgatatttcattggctataaccatgtcaattggctgtcacggaggctggagggtgggcatttgggttttcctgtcttcacagaggagatgagtaaaggaggggtttacctcccagggagctatgaagagctgagtcgagtaggatctaggaagttccctgagacagcgcttctcatgcgtcagtgtgcacataattcacctggggatcttgctacaaaggaaattgagattcggtagagctggagcggtgcccaagattctgcatttctaacaagctccctggtgatgccagtgcttttggctcaaggaccatcctgtgtatagcaggcatcaaggaacaaggaaagcattaccaaaaaggtggctcctgagcagtgttctgaaagatgaatagaaatttgcrgggcaaggaagtggtggagttgcatgaaagggcgtgtggttttggggaatagacatttagtggctggctgcaccatagagagcagtggkggtgcaggaagcctgggagaagagtgttggaaactcactgtgaagggcttcgtgagctatgctggtttggatttcatcctctgcaagttgaaaatccagaggtgatttttaagcaaggaagtgatataattagattcttttcccctttttattcccccggttaggtaactctggcaaattgattactttttaaaaaaaggttttattttagctaaatttgatgggtattattttgaatataaagaaagttgaatgctaaggcaggacgcagtggctcatgtctgtaatcccggcactttgggaggccaaggtgggtggatcacttgagaccaatagttccagaccagcctggacaacatggtgaaaccccatctctactaaaaaaatacaaaaagtagccgagcgtggtggcacacacctgtaatcccagctactcgggaggctgaggcacgagaatctcttgaacccaggaggtggaggttgcagtgagcagagatcatgtcactgcgctccagcctgggtgacagagtgagactctgcctcaaaaaaaggaaaaaaaaaaaagaaaggtaaacaccagaaggtggacctgaggcatacctcactgtgcttcgcctgcttggggtggacatcgttatttcattcagatattcttcactttcacatcgctcacattcagccttagaatcctgctcagttctagaagggctccaggcagccaccaccacctagttgaagttggcagaggagataaaaccaatttgccatcttgagatagttaccttgaggttagaaaagcacttactatgtctttgtgcttttattatcttaaaactttaagttactaatgcttttctttgtaagtttttcaattagagttctttcttcctttttaaccacattgatttgagttttaggagcttgccaagtagatggtttttggttttggatgggctagatggttgttaaagttgggttttcatttcccaggatgaaatgagttgactagctcaaccttgatatgctgtaaaaaatgtctctagccattacctttatcctttctcttttcacacagattttttgtttgtttgtttcctactcttagagcactggttttcaacacgggcacttttgcctgtcctcaccccaccctgcccccaccccctgggacatttgtcgatgtctggaaccctacttggttgtcacagctgggatcagggtgctactggcatgtggtggtagattccagggatgctgctaaatgtcacacaatgtgcaggacagccccccttactaaagggttttcaccccaaagtgtcagtagtgctgaggctgagaaactgtttggaggaaagtttggagactcagcgcaagtttccttttacttccccagcctttaaaatggttaccttgttatctctcgcgctctctctttctctctctctccccccccccaacctctccctctctctttctccttctctgtctctgagtgtgtatatgtgtttgcagcagcactagggtaaaacttgggcttcactggcaggacccttgcatcactttcctagtaaaatagtgagagtaaataaatcactttgaatacataatatgccattttaaagggaatcagcttattgctttcataggagcatgggtgccccagattcttacaaatgctttctgagttttagagctcagagccgttttgcagcaagtaaaaagatggatggtcatctttcaagcaagaaagataaattttatggcagcagtttttaaattgtgctggcaaagaacagctagcacagagtgatctattgataaaagaattgtggggactccttccagatttgcagtgaaacaaatggtaattgatgaatagaattctctctcccatttttttttccttgaactttggtgccttgtggtgcttatttattagtgagaattctcaagtcacaaaaggaataaacttgtataagagactagtggtgaacaacctggcaatcagaggctcacacttgctgagtttcccagcctgcttttccatgcactcatgctgggggttctggtgctatgctgcaaacccatggtacacagtttttttctkgttagtgtcaagctctttagtatactgatacttcagtgttttccacaaagcacactgacttcagggtgtcccttggaaaaaatgaaattgtgtaggtcacatttagctttgtgacagagtataaaataaaaagtacatcccttcctggtcagttctctggtccatcaaatgccatcacttgagttttagcaaagctccacacctctgagggagaaagttgatagaatcatgaagttttagacttggaagcagacttggatgtggtgtgagtagtycctagcctttcaggatgtgggaactgagttcmcccmctagctagaggttgagggagcagaaccagaattctgacttccactgactgtgaactctgtgtacccctgcactgctggtgcacaaactgggtcctgggcctgggtggccttatcagtacaagcaatgaaacgacaggtctcaacataacacgtacatgggcagaggggacgtgctgaaacgtgtaacattttttcctctgagactgtggtgctgaattggagtgaaaataaggtcatctgcagctagcttcacgtttgtgccattgctcctcaggcttaggtgtttttggaagtctttcttaaaacacattcctttcagactgtttcaacacgtatatcaacacatgtggatctctctccagtaagctttgagctgatgtttaccacatcttaccaagtttggtaaaagtgaagtgtaagaattacaataaattttccatgaggactaattgaggaataaaaatacatgggataattatgaactccatattttggacctgaatcacatttgctgcacagttattgttagtttaggtaaaggggctgggaatacaggattaagtacaaaggttataggactaggttcatgccgtcagagaacttagctgcttatagagaagctgttttaagttgtactgatgaggaaagttcactgggagctgagagagaggtgagatcattgtgtatgaaagtgtaagtagaaagatttcatttattcatccttttatttgttgtcagcaattaagcatctacaaatttgattttctaactccatgccacatattgtacaagtcatttgtatatagtggaaaacaaagtgatatgataatggtaaaaaaattgtaaaaggccatgtggtcccttcctttacggaacttttattgccacagaggaggcagatattattcaataaacactggtaaatatgaaattaaaaattacagtaggccagacatggtggcatgtgcctgtaatcccagcactttgggaggccgtggtagacagatagcttgagctcaggagttcaagaccagcctgggcaacaggcgaaaccctgtctctccaaaaagtacaaaaattagccgggcgtggtggcacacacctgtggttccagctacttcggaggctgaggtgggaagatcacctgagccaagaggtcaaggtgtggtgagccgagattgtgccactgccctctggcctgggctacagagtgagaccctgtgtccaaaaaaaaaaaaaaattattgtataaatgctaaagagaaatagataggtgtatgagagggaataatgggtgtgaccaggcaggaagaataaaatgcagaaggcgctatagttggaaagagctgagggtacacttgaaagtctgacagatcttgtttgcagctagagagccaggaggagagcgggatggaggaggtggagaggcaggggccaggtaggcagaggccgagtctgccttgtgtagctatagtgccttacagaccaaggtaaggggtttagattttattccaagagtcatgggggctgttataggctttaaacagagtcctggtatgatcttgtgaaaatgtgaagtggttattctgggcactgaatagtgagtagaatggaggcagagaccagtcaggaggcttttgtgatggactgggtaaaagggatggtggagggaggtggagaagtggatggatttaagatgtgtctggaggtagactcttgacagaacttgctaatggattgatttgtggcaagacactggagcagagaacgttgaggagagcatccagaataactcccacctgttttcctgagcaactgggtgattgctggggctgtatacctatttgaggagaaggagttttgggggagtcaggaattcaggttcagatatgttaaatagtacactcaggagatgtctagtaggcagctgggtaaggaactcagaagataagataaacattttggaggcgtcaccactggatggtatttaaagccatgggctatagacttagaatgggatttgaagataaataaaacattgatagttaaggggaagagagacgacattctaagttgctagggaaatattctgagcagaggtatagatatagcatggtctggggacagagagccttgatttggagcagattctcggccttggcactcttgctattttgggctggctaattctttgttgttgggggctgtcctggcactgtaggatgtttagcagaatccctggccttcacccactagatgtggttgtactcccccctactccaagtcatgacaattaaaaatgtctccagatactgccaaatgtccctcggcagcaaaattgagaaccactgatttggaatgaaggggagataaatttagataactggggagaggagagggggcacattatggatggctttgagagtctgtcacaacagtttagccttgaggctgcaatcagtagtgattcaattgagccttcttgagttgtgcagagagattgatttgatgaaaacgattttagaaaaatgggtctgatggtgagtgaaaatgaatcaaatggaggagaaaataaatacagcgagaaaacaatcacaggaatgaagtgaggaaaaggaggaggaaaggtgaatccaagtgacattttggaggacattggacattattaagaaaactacaagaggcgtagtggtaaagggaatactgaggtttcaggccaaggtgataaagaaataatagggatatttgatataaatttaatagctgatagaaattgagcacttagaaagggaagtggtttgtggagcatgaggagcagaaagattgtgcatttaatttgaatatatggggttgggagccataggatatgaccttcccacttaagagaggaagccttaatagacagttggaaatcaggtgcaatttaggactagctgtatagacttggattcagctgcatagaggtgataattgaagccaggagcatatttagaaggtctgaggcccatgactaagcctttgagggaaactaaaaatgagaggacaggaggagagagaggacctcttaaggggcagtcagagaggtagcaggaaaaccaggaaggcagagtcatgacacctggtttgctttacagtttgactacctgctcttagcgctgaatacagcgtagagctgcagaaatatcagtttattttactttattttttatttcgagacagagtcttgctctgttgcccaggctgcagtgcagtggtgtgattagcgtgatctcggctcactgcaatctctgcctcctaggttcaagtgattctcctgcctcagcctcctgagtagctgggattacaggtgggcatcastgtgcccagctaatttttgtattttagtagagatggggtttcaccatgttggccagggtggtctcgaactcctgacctcaggtggtccacccgcctcggcctcccaaagtgttgcgattacaggcgtgagccaccgtgcctagcctgaattatcaatttatgcccattaagaaacaaatcaggttggtattttgcagacaggatatatagatttattaagtctacagatttatttagcacattttctgtgctggtcctgcattagaaggcactggggatatgaagatgagtgaagtggcccatgccctcaaggaattcagggtttagaagggaagacaaatgggtataaaaataattgcaataggataggacgagtgctgtgcaaacctgggggtgaggtcacctgagggaggaatggggcctgtgaggtgactgaagaaacaatacctgctccgtgtcttgaaggatttggtaggaattttctaggtggatagtggaaaggtgggaaagtcctttgcagggcagcaaaccctgtaagtgcaagggtttggaacctcaawcaacatggcttcttcagaaaatttcaaggtctagggtggttgtagcagaagggtacaaggtacaaggtagratgggaggaggcccactgagtgatggtttgagcagggctggatctggaagtccttcggtgccatgttgcagaatggcattctgcagaggtaggcaccaaataattttagacaagcttgtggtatgattgtcttttttcttttatttttaaaagaatggtcactcagactagggacatggaggatgggttgagtgatgatgagagaggggaagggacagaacctggttcaggacaaacagtatgtatcttagcctctttgaaactggttacatttgggaaactgaagcaatttagaactgttcaaagatgataacttctattttagacatgttttatttgtggtcccatggtaattcatgaggggaaatatttggtagtttaggatagagttttggctagagatttctatttgttataacactccaattctgagatttttaaaaaatgtcttcccaaccaacgatgtaaactagcactaaatctgtcattctgatttgacctagtttggttctttacacatttgcaggggcagagcttcaacttgaacttagggcagtgtgacatacatgctcttactctggaacacgttgccctaaggtgccattgatttacatttttgtacttcttgtccgcttacgatattttatatggttgttattctggtcagaccactttggattatgatttttaaatgcaacttgtaaaacattttttacatgtttctaaagaacatttgtaatactgtttaatgatttatatgatatcactttgctaagtgataatttacttattctgtcctcttcctttggacgttttcctccctactcttttttttgtttgtttgttttactataatgaacatgaatcgtgttaataactttttgctttgttggattgtttctttaggatacatttccagacatatacttagaacatcaaaaacgtatggacatctttttgatttctcatgtgttatattatgtcgcatgtgttatgttatatgtatatatatatatgtataacacatatatatatgtcatgtgttatattatgtagggaggaaaacgtccaaaggaagaggacagaataagtaaattatcacttatcaatgtgataccaccatataaatcataaaacattaaacagtattacaaatgttcttgtttgagttcttgttttcttgaatctgtttgagttcttgttttcacttttttcagatcatataattctatgtttaactttttgagggactgtcaaactatcttccactaactgcaccattttacattctcaccaataatggatgagggttctgatttttctgcatcttcaccaacatttgttagtttccatttgtttttgattatagccatcctagtgggtgtaaagtggtatcgcattgttttttttgtttgtttgtttgagacagggtcttgctctgtcactcaggttggagtgcagtggttcagtaatggctcactgcatcctcaacctcctgggatcaagggatcctcttgcttcagttcccctgagtagctcagactacaggtgcgtgccactatgcctggctaatttttgtgtttttgtagagatggggttttaccttgttgcctaggctggtcttgaactcctgggctcaagtgatccacccgccttggcctcccaaagtgccgggattacaggcatgagccaccacactaggcctcattgtggttttgatttacattctcctaatgaataatgatgcacttttcaagtgcatatagttcatttgtatatctttggagaaatgtctattcaggtctttgctaatttttgaattagttttttgttagtggtggtgatgaattgttaagagttctttatatattctagatgttaatttcttatcagatatatgaatagcagctattaccttccactctgtcattcactctcttggtagtgccttttcaggcacaaaagttttttttttttttttgagatgaagtcttgctttgttgcctaggctggagtgcagtggcacgatcttagctcactgcagcctccggctcctgggctcaagcaattttcctgcttcagcctcctggttaactgggattacaggcgcccaccaccacgcccaactaattttttgtatttttagtagagacggggtttcaccatgttggccaggctggtctcgaactcctgacctcaggtgatccacccacctcggcctcccagagtgctgggattacaggtgtgagccgccgtgcccagccaagtttttaattttgatgacgtccactttttctagtttttcttttgttgcctgtgcttttgttcatattcaatagatcattgccaaatccagtgtcataaagcctctatgttttcttctgagagttttatagttttagttcttatgtttaggtttttgatccattttgaattaatttttgtattaatttttggtaagggtccaactttattcttttgcatgtggctgtccagttttcccaggactataccctggttgacaaaattgtgctttccctgttgaatgatcttggtacccttgttgaaaatcaattgatcatatatgcgagggtttatatcttgactctgtgttctattccattgatttatatgtccgtttttattaggcattatctttatgtatctttaccccactgttctcattgctgtagctgtgtacagtagtaagttttgaaatcaggaagtgtgagtccttcaattttgtctttttcgagattgttttgcttcagtgtcttgagattattccatattaattttaggatggacttttctatttcttccaaaagatgctgttaggattttgacagagattgccttgaatatgtagattgatttgggtaatattgtcatcttaacaatattaagtcttttaagccatgaagatgggatgtctttccatttatttatgtctttaattcctttcaactatgttttgtggttttcagtgtactgtttttttccttccttggttaaatttattcctaagtattttattcttgttgatgctattgtaaatggaattattttgttttatttttggattgttcattactagtatataaaagtgcaattgatttttgcatgttgattttgtatcctgcaatttgctgaatttattagtgctaacagattttggtgtggaatctttaggtgtttctacatacaagatcatgtcatttgtgaaaagagatcatttttcttcttccttttcatttttaatggcttttgtttctttttcttgcctaattgctctggctagaacttttcatactatgttgaatagaagtggtaaaagtaggcatccttgtcttgtttcttgagcttagaggaaaagcttttagtctttgaccattcagtatgatgttagctgggggcttttttatatggtgcttctatcatgttgaggaagtttccttgtattcccaatttgttgagtgttttttttttttttttaaatcatgaaagagtgttgaattttgtcaaatgctttcttctgcatcaactgagatgatcatggtttgcttttttctcattattttgttaatgttacgatcaattttcatatgttgaacgtcctttcattccagaaataaatcccatttggttatgatgtctatttagattttgaagactgtttttgatttttaaactttataagagctctctatagaatatgtgtgtgtgtgtgtgtgtgtgtataaggtaacaactttaaacatttggtacatttgataaaaatatttccctcattctcttcctcttttagtttggtacttttgtatattacagaaagttttaatttatattttttaacctgaccttttcccttactgcttttgttactatatagctgaaaatggtattcttgtatataggataatttttctttctttctttcttttttttttttttttagctttgtttctactgtgttctaaaatatttacctctttagaatatggagtttactttggtgaatgtgtacagtgaggatttcctttaaggtttggtatttcccatctcgtgtagtatagtgagtggttagtgttcaaatcctggctgcaccacttgctagcctcgagacctttggcacttaactctttgggcttaatttcctcatgtgtaaagtggagataagagtatatctgtttcataaggctgttttgaaaacaaatgagagaaaaacttggcagggggcctggcatgccatcagggctcactgagagctaactgatgttgttaccattgttactccaaccttatgatcatcctgcttatttacaaaaggtttctctgtatttagagttacggtttatttctgaattttgtattctgtttcatcaattcttttactggtgctgtttagtgttattgttgcttattcttctttctcatgctacttaaagtttctctaaattttagaatcattttgtcaagtttcaaaaacaaagtaatctgttcgatttgtgtgtgtgtgtgtgtgtgtgtgtgtgtgtgagagagagagagagagacagggtctcactgtgttgcccaggccggagtgtagtggcatgatactggctcactgcagccttgacctcccaggctcaagtggtccttccacctcagcctcccgagtagcttggactacgggtgcatgccaccacgcctggctaacttttgttatttttttgtagagatgggttttgccatgttgcccaggctggccttgaacttctgggctgaagtgatttgcccatctcttcctcccaaagcgctgagattataggcatgagccactgcgcctggccaatctgtgtgaattttaattttaaatatatgcattaatttggggcaggtaaccacgtttgctgaatgcctgcctgtcactgataaaatcaacaactttccacaaaatatcaactaaaaatgctatagtaggaaagcctgaattgaccgataactgaggaagaaatggaaagctattaaagaactgcctgttccctcaaagggtagcaggattggatggattttttcatacattcttccaaggatcagataatccccatgttgtatgaactgtttaaaaacatataaaaatcagtctcagaggcaaaatgattcggtttcctaaatccattgccgtctccccccaactccctcatgtgcagtgattatgtcttattcaacatcgaatctctgtgcctggcttgtaggaggtgcacaacgtgttgattaatctgagaggaacgtggcacaaccaaagacagcttgcagagcagccagccccagcctctgatgttataaatgtagatgtgctggtggtgggccagttctgtcgtgggcttgggtcagacctcacttgaggactgtgattactcttgggctttaagctttgagaggggagaggagaaattagaaaaggaaatggcgggcctcgtatacaggatttatgagcaggttgtctgaaaataggatgagttgcctcacataatagtatttttcctatcatcacacaagcttaagcagagtcttgggtgatactgtaggggggcagtcacatgcttcrtagtggattgggctggattcacttactttcttttctttgtctcttgctgctttcttctgacttttgagcttataaaaatgtatgttagaagcagtgttgacagtgtttggcagctttatgggtgtgtgaagagtggataaggaggaggagatgaaaataacgtagaggttttaaaacggtgtttggggatggcactcttgacgattggaaaaataaaatggaaagccattctggaggtgggtggataagtttcgttttggttgggtcatacagtatttgaacctaagaatcccaagaaaacttttattaaaagctatatttattgaatgttaccattttcaggtactgtgcaatgtgaatcatttaagtttttggtgacccatgtagaaaggaactgatctagtctaaacatggaactatctcttaaatcaagataacagctgtaatcatatagatgcttttcctgagttagttgttttaygtcttcctttgtgtgacttaaagtttttagtttgactctgctacttttgttctatttgtgcgtggcttgatggatttttcctgtccccatctatacactcgtcacaatgaggggctactaaataaggcagtgttctctgtttgtgtagtccccmcagctgtttcctatagtaaagactctggaaaacaatgacctcatagtttccacaaaaaaaaaaaaaaaccttttatatttagtaggggaaaataaatcattcaaaattcagtaatttaaagttatgtcctctgttgcttcttccttcaaaaatattattgtttgctctgctaattaattgttcattggctgttcctcaaatgaccttttatgtttaacaaacaacatttttgcagtggagcacgtcgggatatcttgtctttcgtttgattgtgatctttctctatttagaaatcattgttttaagccatggactgtggcagttcctagagcaattggccagtcactgaacatctgttgcttcttccctccagctgttgggttcggatggtagcaaacagtgtgtccacaaataaacagttgacgctttagaagatttcataggactggtcaggaaatgcctttgttggtatctgcttctactggaaggaccccttctttgtaaacacatcactagctcagtatatgttttggctttaattcttggtattcttttgatcttgaagagcaaggcagagagccatctgattgtcaggagatttaagaaacaataataatcacagtgatggaaatgccgcttatttgtgtagggccatatcatttacaaagtgaattcatgtacacaagcccagagagaaaagcaagctgatgatggcaggttccatgtgccttttatggttcattagagttcttcagcatcaaatgccctcccattcattgctacactcattttactgcttgctcatttcagtcctttggtactctagtgacacaacaggtttctgtgtttgatcctgtccccaacaacatttttgcctgtgagttggatgaggacctaacctaggtatattaattgaatttgtaaatgtcttctacaaaaatttggctgggcatggtggcttatgacagtaatcccagcactttgggaggctgagggtggaggattgcttgagcccaggagttcaagaccgccagggcagcataacaagatcctgtgtctacaaaactaaaataaaatacaactttaatttgttactatttttagacagtcttgctctgtcgcccagcctggagtgcagtggcatgatcatagctcactgcagccttgaattgcagggcttgagatcctcttgcctcatcctcccgaatagctagaactgcaggtgcacactaccatgcctggataatttttgtatttttttgtgagatggggtatgttgcccagactggtctcaaattactggccttgagtgatcctcacaccttggccttctaaagtgctgggattacaagtgtgagccacagcgcccagctgaatttctaaatgtcttgacgggtatagcgtatactccaagttagagaatgcaggtccgttaagatctttaattaaaattaacagctaaaatggaatagaatcctgcatcttgcatttggatccaaaaatgaactaactaccccatagcacctatgtgaaaggacctgggtgtgttactagcacgtgacttacgctgatgtatctgccaaaaatgtttaaggtttttatgctaccttcaaagaagtatcttgatctggggtggtgggtgatagtgctgttcctgtcagaccacacctaggattttatgtttacgtgtcattctggaaacctaggatatcatgtaatttctgggctgacaaactgtagtgtgtctagagttggtggtggaagactccctaggggagtctttcagcagggagaggggattgctttgagagaaagcatttgtctttgcacataattccaactcctgtagttccggccctcattatgtctcagtcacacaattgcagtagccttctagcccctccgctgttgctaaactctgtcctttctaattggtagtttttcttttttaaaattttattatattaaaaaatattagttggggggggggtgtcactttgttgaccaggctgggctcgaactcctggcctcaagtgatactcccatcttggcctcccaaaatgctgggattatgggcgtgagccaccacgcctggcctaattgatagttttggttgctgccagatgaatcttattaaagtttacttgaaattacatgttttccttttcaaaaattgccattgcttttttatacagaaagtaccatgtaaatttcttagcttggtatttaagctttctcatgatgaaatcttatcttcccccctgtcccggaaaggcagaggaacacagggaaagagctgtagcatcagagactttggttcagattctgagacctgaggcaagtgatgcattcttcataggactgataatcaggaataggtgagaaatgtatgtaaagtgcctaatatggtgcctggtatagagaaatctgttagcattattatttcacagtcccctgactactttgctggctattgtttgtgccctataccctcccacttgtagtgctttttctgttttctccttcctgggtccagagtacatccccactttactagttttagaaattactcttasattaaagttcccctaacccctgtagttggacgttatggcttcctcctttgaaagcagataacattttacatggaaccatgttaaagtacttgtacacttctcacttagttatgtttaaataatagtaataatagccaaatgttcagaaaacctttctttgtgaacatttcaactatatataactaagaggggagagcagtacgatgaacctgcatttccctgtcacccagcttcaacarctaccaatttgtggacaatcttatttcatctgtataacctttgcctttattctccccaaacttttgaagcagcttccaaatgtatttcacccataaatatttaagtatatatctctaaaagataaggatgctttagaaaaatgataatgccattgtctgcctaaggaaaactaatattccttaattagtgttcatatttctctgatattgtttctgtcacacacatatatatgtacacatatatgtgtacaactgtgcatatatatttcctacactttatgtaaggatccaaataagtttccaaaatttcaatggattgatacatctgttgtcgctcacaacctctctctctcatttattttatttttcctctggcagtttatttgttgaatgcgtgtttgtctagtagagcagagctcttcaaattatttgtggtttaggactaatttttaaaatttccaatctattgtgggctgtttgtaaaatacaatacaaatgaattaatagaaaagtgacataaaaaaggcatatgtaagaccagccccattaaaaaattgttaaattcagaagacataaagttatggtttaatttgtaaatacttctaaatgcttactctcaatttctataatctcatcatggactggcaacggaaacttcatagtcttgattttttgtattatattccagtagcttcaattaagatgttcctctgtccatgtatttcctgtaaaatggtagttagagctagaggtttagagactcaagtttgaggtttttttctcctctttttggcaaaactttctgtcgtggtgttataaacttccatcagaaagcctgcactgtttggttytatctcttgtggtgccaagaatcactggtagttgttccctgacccgttaatttattaagggttgaaagtggtgaaattataattctaacattccttttttacttgttagctggaacacttctacagagactcttgtccagttatttggtttccctgaagtaaatttttcagaagaaaggctagataaaagcttgatttttccccctcctttatttttcagttttcaaaataattacttgatttccaattgtgtttagtgaatttttataaccttatgagctcatgggtttaagcatatttgatgtattcagtcagttatagtttttaaccttattgatgctcaaaattgtcccatttttgtccagtgggacaagtcgactctcaagtcgttttgagactgtactagtagcctggcatgtcaaacgagaatgcaaggatcttaagatgttccaggctcatcatttcttgcaccagatctggaattagtcatttccagatactggaatcaggttcctttggtacagcggtactgagagaccacagttgaggcatgagggatgcacatggtttctaagaaaggagtgatttcttttaaagctaaatcatgaattcacattgattattccaatacagggcttcggggttttattgaccctcattggtcttgtatctgtggcttgttcctcccatgctgaaaatcctacttgtaacaccagcgtaaattctcatttgccttatcccacagtatgctcctaagtctcagaataataatcccagtactgccaccaacaatgttagtatttgaaaatggcttaagacttatttggtagtttttttgtccatagcatatattctactaggaccgtatggtacaaattactgtgttttaaagttacttggaatagttctctatgtggttttgtcatcactggatatatagttaatattagttgtttcggccaggcgcgttggctcacgcctgtaatcccagcactttgggaggccgaggcgggtggatcacgaggtcaggagttcaagaccagcctggccaagatggtgaaaccccgtctctacaaaaaaaaaaaaaaaaaactacaaaaattagccaggcgcagtggtaggtaggtgcctgtaatcccagctacttgggaggctgaggcaggagaatcacttgaacccaggcggcagaggttgcagtgagctgagatcgtgccactacactccagcctggacgacagagtgagactccatctcaaaaaaaaatcagttgtttcttttttaatcttttttaaaatgaggttttcttttttttctttgagatagaatattgctctgtcgcccaggctggagttcagtgatgcgatcatagctcactgcaagcctacctcccaggctcaagtgatcctcagtccctggagtagctgggaccacaggtgctcaccaccatgcccagctagttttttattttttgtagagatactgtttcactatgttgcccaggctggtctcgaactcctgggctcaagcaatcatcctgccttggcctcccaaggtgctgggattacaggagtgagccaccacactagtcaatttgtttctttttttgcttttgattttgatagattggttcctatcctaaatttgattttgttgcatcataattatattaaaaaatacaatatatggctgaagtcaaatctgcaaaacaagatctattcagaaatctagctctgtctctgatccttccactctattgcctttctccctaaattttatgatttattctttcattgtttaaatataaggcagtatgtataggtatatattaatatatgtgtgtattcatatatgggtgtgtattcatgttctctcttatttagataaatggtagcacactatggataattttctcctcttgcttttcttcgtgtcgctaacgtatgagtgcttatcacatgccctgcacagtggattattttatttgctccttataatgttgtaaggtagatgcatgtgttacaatttctgttttatagttggagacagaggtatttctgtgtagacctttacttctctgagtcccttttttatttcttttttttttttttgagacagagtcttgctctgttgcccaggctggagtgcggtggtgtgatcttggttcactgcaagccccacctcccgggttcacaccattctcctgcctcagcctcccaagtagctgggattataggcgcccgccaccatgcccagctaattttttttttttttttaagtagagacgaggtttcaccatgttagccaggatggtctccatctcctgaccttgtgatccacccgcctcagcctcccaaagtgctgggattacaggcgtgagccactacgcccagccttttttttttttttttttttttaaagagacagggtcgctctgtacccaggttagagttcagtggtgcgatcacagcttactgcagcctcaaacttgggctcaagcaatcctcccacctcagcctctgtggtagctgggacaacaggtgcctgccaccactctcagctaattaaaactttttttttttcttgtagagacagattcttggtatattgcctaggctggtcttgaattcctggcctcaagtgatcctcacgtctcggcctcccaaagtgctgagattataggcatgaggcactgtgtatggctgctatgattccctttaacccccatagtaactagtcgtgacccttgtgtgcatattcatgagcaaatgaatgagcagggaattaacttctctatttactttactttgagcaatgatgggagcagagaaaggctgtttccaaactctagagaaggaaattcaacgctttctttatttgaaggttatggctctctgtagctggagaagaataatagtaagaacttattccctgaccagagttgctcccagtaattacacagatacattaagttggaaagttctttaatcttctaaaaataagagttcctttataacagtacagtgacaacttggtaaatcttcctcattttagagtctttgtgtcatgaaagttataataaactagggtagctaaggaaaaggacaaactcctttaaaagcaacagctcgtggaaaatatctactagttaatgatttcacaattttaatagtgacaggaagaaaggagagtagcttcatttcccttcagatgggaaagaaaggagtattggctgctttttattttatatccagctggaggaaggrgttagttacccttcaggctctattgtgatgtcaggcagctggttaagctgttgtagctgcccccaccccttcccggattctgtcaagcttcagagggtakwgctgagggaggtggagggcatccagggtcagaggctactcttttccttttgaaaatctgtgagcctatgagttttgaatgtagtgagactcctagtgcagctgagatcttgggcaggtcactgagcctcagtttccatattttccttttcattgccacatagtaataccatcctcacagatcgtggtgtttaacaaccattgactcctttacacctgagtggtgaaaacattttagcaagaacaaccaaccaacacaccaaccaacccagcctgtgacagcaggtctgggacataagaaagggatgctggtaggagagaggtgtggaaaggatcttgcaaaatatcaccatagttaagtgctgatgagaagtacgttccacctctacactttcactgggtctagctttgcaagtctgattgttttatagcttgcctttgatgcgtagatactctagggttttttttattttcttatttttgtgagacagagtctcgttctgtcacccaggctggagtgcagtggcatgatctcagctcattgcaacctccacctcccgggttcaagcaattctcctgcctcagcctcccaagtagctgggcttacgggcacccaccaccatacctggctaatttttgtatttttagcagagatggggtttcaccatgttggctaggctggtcttgaactcctgaccttcggtgatccacccatctcagcctcatgctggggttacaggcatgagccaccatgcccggccatgatgctctaggttatgaccacttgaatttcagactgttttagaagaggtggtatttatttatatctccagtgttctagtgctggatgactcactgacgagtatgtcccggagagggcactcacttctcagtatgatacattctgtgccattgtatcgtcgttgaataacacagtgataatccatgtgcctggcgttttggggaatgagtcttttacgtaagtgacttctgaggtaactacttatttgaacatcagatccttacaattttaaccttttcttttgattagatggcttgatcatattattttgtactctttgccagggtgagaatcctagacatactcagttgttccttggtgacttagggttgttatgaacatcattgattgatctccttttaggtaatgtggaggtttcttttggggctagtgggactacataggccctattgagtggttctggattgctatattgttcgaattcttatttctgctatgatatttcctttcattgctccctaccatcttcatgctagttttctcttgctttatcctatttctgggatcctgtacctcctacttcctcctgtacttttcttctttttttttttgagatagaatctcactctgtctcccaggctggagtgcagtggtgtgatcatggctcactgtagcctttatctcccaggctcaagtaatcttctcacctcagctctctggtagctgggaccacaggtgtgcgccaccatgcctggctaatttttaaatttttggtagaaaccaggtctctctttgttgcctgggctggtctcaaactcttggccacaagtgatctttctgccttggcctcccaaagtgttgggattacaggcatgagacaccatgcccgactattttgcagtttctaatctgctttttagttaagtaactagataaatagaatcggctctaaataagacttaactaaactgagttagagtctgagcatctgactaaattaagaaactttagygtttttcctttttaatgtcaactttcttattttttattttatttatttatttatttatttgagatgcagccttgttctgttgtccaggctggtgtgcagtggcatgatctcggctcactgcatcctccacctcccaggttcaagtgattctcctgcttcagcctcatgagtagctggaattacaggcgggcaccaacacgcctggctgatttttgtatttttagtagagacagggtttcaccatgttggccaggctggtctcgaactcctgacctcaggtgatccatccacctcggcctcccagagtccgaggattacaggcgtgagctgccgcgcccagcctaatgtcaactttttgaacgaagtatgccatacatacagaaaaatatatatggcgttagtgtacagcttgatgtattatcctaaagtgataatttgtcacccagatcaagaaataggacatctctaacactccagaaggtaccctttctggaatgttagactgtcttctaacaccatccattagatcgtcttctaacaccattgattaaacatagactgtcttctaccaccatggattagttttgtctgttgttggactttattatgagtgaaataagtatatattgttttaaaaacagctttattgaaatacagttaacctacgatttaattcatccatttagtgtacagttcgattatattcttggagttgtgcaaacatttatcacagtcaattttagaacatttttaattatcccccccaaaaaccccatactcattagcagtcactccctatttccctggaatattccagccctacatgaacactaagctacattgtgtctctatctagtctgggtatttcagataaaaggaatcatatatgtggccttttgcatctggcttctttcacttagcatgrtattttcaagattaatcatgttgtagtatatatcgtactacatttctttttatagctgcaaaatattctattatatgaatatttcacattttgtttattcatctgctgatggacatttgagttgtttctactttggctattataaataatgctgctgtgaacattcacatacagatttttatgtggagatatgtttttgttcctcgggtatattttagagatggaattgctgggtcatatggtaactgtgtttaattgtttgaggagcygtcaggcacttttccaacattgctataccattttattcccacgagcactgtgtgagggttccagtttttccatatcctcatcaacacttgttaacgtctgtctttttcattatagccatttgagtaggcgtgaagtggtatctcattgtggttttggtttgcaataagtatatattcttttgtgtctgggttcttttgctaaaatttgatattagataacatctatttctgtaagagtagtgtctaaagttttgtagaaaacatggaaaatatatgcaagttgaaataataaaattgacttacttgccttcccctcccctgtgtgtgcataacataattgatatcaaaccatatatccagattttcatcatgtgatctttattttgtattgtcttatgagtaattttcgtcataaagacttctcagatcattatatgaaggtactgtaacctatttttggacatgtagatggcttctggttgtaatgaatgtattttgtacataaatctttcacttttcattatttcttgaggctatataaaacgaggaaattcctttcagtagttacctatttcaaaggctcttaaatcatattattaccttatttacagaaggattttaccactagcattgttaagaatgtgtggtaccccactgttgtaattaaaaaagaaatctttaagttgttaagtagaaaatagcatttcattgttttaatttgcatttctttggttagtagtgagggagaacagcttgatctattctttgaagttactatatgatagtaacattttgatactagggaattgccgtattttgatttcacactcttctctttgtttgctgtctgtatattcacacactcatccatttagcatccacataagacaggcagatgaccaaggcctgaactgactagaattggtaaagattgggccgggccaggccaggcctaggctgggaaggttctaaattgtactttgctaggagaagactggagccaggatgagctggaggtgtctgtgttggtttttaggagatctgattcttgtgtccaggattgaaagaatgggcggaggctgtgattgattggaggcctaagagtcagcctggcttgcctgtcaagtatccatagggttggctgtgtagagtgccacagcaggtctgtgacttgcaagcrtctcaggcagttaaaatttactgggagtactctgggtttatggcgatgtgaatgcataatttatagtgaaacttgctggatctgcttatgaataatctcccttagttactactaagtgatattgcagttataaaaatgcaatagcagaatartgagtcaatgcaaggttatttccagaatattttggatcyccttataaaatcggctgttcagttaaaaacattttaggtctsttataataaaatgtcagtgtattcaaaatcaagaggattttgcctcttgtgtgtgtatatataatctgtgtgtgtttatagaagaaatatatggatctttggcttaggggtagttcaaggccttatctcatttttcctctagtccttgcctttcccaccttattctgcctcctgggatgtatargtcactttacttccacttcggagaggagcaccactcagcgaagaacattgattggctcttgtgctgtgggcagggtcattgtgctgagttcgtatgtctgtatgttcctcctctaccttcttttacttgctcagaaagctgccactgccattctttttttctcttcctaggtttaagcattcatctcccaccacctggcaagccaggatggcctgaaaaggccgctggatgtagctgtagggatacattctttttctctctctaatttttctttgatgctggctgctgtctctttccccagtggttaagatccagaggttggtttgggctttgggtttagagttactataaatggaaaactttcgtttaaagctccataggtctgtctcttgtttttaaacagcctgagatatcattgacatataaaaattgtgtatatttaaagtgtacaacttgatgctttttaaaccctcaaccatttgtaatgtttcatgacaggaatatataataatttattagatatttagatggcttttcagttttaactttaactctttcagattatcattcttcctgtatgatgaccaacttgcattgggactggacgtttgcttttttgtgttgattgtaagtcaaaatttccccccttcctccttaaaaaaagggtttgttttactatagttttgaattgtagattgtgttggaaaaatgagaaagagtccaaaaagaagatacatttgagttacttgagttagttgattgggtagttaaatacattttggtgacctgagctgactctaaacttggagtcagcaagtcttggccacttaagttgtgcggggaaggatggactattggtggaattaatctccaccagaagagcagcttgagcatttaaggtgaagaacaccccctttacattactgatgaaagacagatggagttccctaaagccagatctttgtctctggtgtgtttgctttctctagcatcctgggacacttgggcaggacatagttcttcacatgctgcaacttgatctttctacatcatctgcattcctccttatttctcaaataacatgccaattagataaacggcatttttgtttctgggccatatttcagtcataggaagaaatacaaattgcaacaaaacaaaaactgctaaacaaggagttatttaagagcagataaattccctgaagcctcaaggttggtgcagctgtagctcagtcgtgctttatgtctaactgagaattgacatttagaatgaagaacctgagccctgtatgatgctgagtcctatatggggacaaatcattttaaggtactttgttgaagaaggattatgggcaaaaatattttaaagcttttttaatcagctgaggttgaacaatagtggtaattggccgggcacggtggctcatgcctataatcccagcaccgtgggaggctgaggcaggcggctcacttgaggtcaggagtttgagaccagcctggccaacatggtgaaacccatctctacaaaaaatacaaaaattagctgggcatggtgatatgcgcctgtaatcccagctgcttgggaggctgaggcagaagaatcgcttgaactcgggaggcggaggtcgcagtgagctgagattgtgccactgcactccagcctgggggacaaagcgagactgtctcaaaaaaaaaaaagaaaaaaagaagagtgataactttgaaaagttactttctttctctgaggctaagttttttcatctataaataagaatacagcatagggaatttcctaagggtgaatttatttattttattttattatttttttgagacagagccttgcagtgtcacccaggctggagtgcagtggtgcgatctcagttgactgcaacctccgcctcctgggttcaagcgatcctcctgcctcagcctgtagagtagctgggattacaggcatgagccactgcacccagccattaagggtgaattttatagaaaataacatctataagcaataagcgtaatgcctgatacagtataagcactcaataagtattaactgttattgttaccctttgcaccaagcactgtatttgctaggtattggggaagtaatattgagtaagacattattcctgttcactgtctagtgatacatgtgagatggtatgtcctagagatatgaataaaacgtaatgtaagaagtcatataatgcacttatgacaaaggagcctcccataagttttggtgcttttggaagtgaaactccggagcttttccagtgtggctgtgttcgttctcagacttggcttcacattagaaatagtcattaaaaataagtcacacttgaaaaaaaaattagcagtgggctgctgccaggacatggtttttatttttaactttccccaggcaattctaatgtgcagccaggattgagaactaatgctttagatattttctcgttttctttatctttggcatttttaaggattatgtagtatcatagggtgattcttttctttttttattctatttttcaaaactaacataatagcatctgtacagagttttagactttacaaaatgcttttatgatctcattaaagccttacagtaatccttttagaaaagcattcctatcaccattcccattttgcagaaaagatgactgaggctcagagaagcacatgttaagtaaaaaatggtagaaagttcgggtgcagtgactgacacctgtaatcccagcactttgagaggctgaaatgggaggatcacttgaagtcaggagtttgagaccagcctggccaacatggtgaaaccccatctctactaaaaatacaaaaattagcaggacgtggtggcgtgcacctgtagtcccagctacttggaggctgaggcagaagaattgcttgaacccgggaggcggaggttgcagtgagctgagattgcactactgcgctccatcctgggcagagagagactccatctcaacaacaacaagaacagagagagactccatctgmacaacaacaacaamaaaaaaaaaaagaaaaggaaaaaaatcaaacgtagtagaatgagaacttgaaccctggtattcataatccagtctttctttttctactgcatagtttctagcagaaagtttttaccattgtgtaagtacttacttggagtcttctcttgctacttgtataatctgttgggacaacttttgctccttgtttgtctggctgaatccacttataggatattcctttcactatttctcccttttatcctggctcttgaccatactttaacccttagttttgtggtttcacgagtcagttataatttcttgaaatgcagtaaccattaytcaacccctttattayagccttttcttttgggtgaggaatgcrtactttactagtcgttattcagcaatgaatccttgccaccagctctttgtggtacatatgaatttgcttaaaatctgacactaatcttatagcagtgcagatattctttgctatgcaaatctgtttggttcctgagtttggatcctgagaacatggatatgatggacacctatacttgagttatcctatgcttggcccttgtgcctggaaggatcaggagctctgtacaggttgagtatcctaaatctgacaatctgaaatctgaaatgctccaaaatttgaaactttctgagtacttacattatgctcaaaagaaatgctcattggagcattttggattttgaattttcaaatttgggatactcagctggtaagtataacacaaataattagaaatcgaaaaaaatatgaactctgaaatacctttrgttctgagcattttgcataagggatactcaacctgtaccaggaataacatgcttttctctgtggccaaatgtgaacagagtccaaggaatgtgtgtggcatttgctcctgtcctcatcaggttgtctttccatcctggatggaagccccctttccctgtgcctcatttctttctcctctcccaccagggtcccctgcttatctttctgaggagggagagtggtttgaaggrtgtggtggagggcattccagccctaggggaagtacatatgaaagcctagaggccttagggtccctttcaagggccttttgccccagccagcaaatattaggggcctctcagtcttatttgtctcctctcccctcagaggagaagataaggaggaagaatggatgaagggcacagaaggccctatttattctgtgtcctagtatgtcatactattgcatggacactatattaccattttttcatgagtcgtatctgtttttacagtgttcatctatttgtacaaattttatcccttatgttttagctaattattcttcatcaacttagtaggcgtcctgaaagtaaaattcaaaagatgaaacttttctcaagacaagtgcttattattttatttccagcagcagcccataaaccagatttcacttttagataccacccagctgtttgcatttcatctatttctttttctaaaaatgtaaatactattgtcytcctgagttcttctgttttttttgtttgtttgtttttgtttttgtccatgatcactggaaacaaattttgtgtttcttctggcatagaatcaaagaaagtgggcaatgattgggtttgatgagtcttgcaagctacccttcttcccaaaagaggagcccaacttccagtcattcatgtcagaccagtattgccacatccatttcccatgggtggaaatcaccagtgaccgaccattgctttttcttcttcttcctggggttaggtgaaggatgtcttggatcagtcagtatcttttccctggagcctgggatgcttcgacctctttactagggctctacaggaagaaagaccctcatgtctaattttatggctcttttctgacccatgtttccaactcttttttttttttctttaagggaaaaaaataaaaacattctctctttgaagggtaaggagaaattttgtgaaacttgaaaacccggtaagtgttttgccttttactttattatttagtaactatatgctaaggatcatcccaagtgaggggataataggagcaggggtcaaatgtgtttatagtaggatgtataggatttaagtcaggagaccaagagactcagtttaatatttttttccaaacagaaacactatacccacattctgtaaaatagacacaaatatgtaagattaattttaagaaggtgcatgttctattttttcttttcttttctattttctttttatttattttaaatagagacagggtctcgatatgttgcccaggttggtcttgaactgggctcaagccatcctcctgccttggcctcccaacgtgctgagatcacaggcataagccaacacacctggcccacattctattttctatagaaatgacatacttaaataatttctcagattgtagcaatgcttctatttacagaggacattgataatcaactttttcaaaactgcaaacatacagaaagattaatttaggacatcaaataaactaaggtttaattatgaaaaaaaatcgtaaaaggcaaatcaaagcaacatcagatgtgaccaaaaacgtataccagatcactttccgggactcttggagaagggcttgggtgaagatttgggatgcaggggtcttatctgctcatttgatgaaccaggattcgaatcacaggttcagtgagttgcctcttgataaccagtggtttgtggcagagccggagcttgagcttaggattcttgactcctactgcttttcttttttctgtgatacatactaaaggattggccgttagattcttctatgttttgttttgtctggggagtatctgcagtgggaataagttaccattgtgaggggtaaaaagaggcagaaagaggaccttttgtgtttgtgttattaagattttcttttccttaaatttcctttagggtctgatatagtgatttagggtggggttgacccagaatggtttttgccctagttacgagtattgtggacgttctgttacctgttgggtcgtgcccaacaaacatgttgttgagcagccttggcactctgccttagaacacagcagttggtggataagtgtggatgagttgaagtgatcgtggacagaagcgtaaacaaatttaatgcagtcttgataattgaacgtagtctccaccctgaaatctgaatggatgctgtgtataaaatatctgctttgaaatacaatgaagagtttgatttcagttaatttgtttggaatgtctatgttgaaactttcttttttttttttttttycctattttttccccattgggagtcagttaagagagaggattcaggacagaagcttgctgtacttctgacagtttgtgtggcccaactctatgccatgagattgtcattacccctgttacacctaagagctcttcttggcagttgtcctctactttctttacaaaataaactcaaaaaaccaggttccctgccttcctgtctctggcttatctgcatgcaggactatctttacctccttctcttccatctctcctaccgaccttctgtttaaggccagttcctctgcagcctcttttaaatcaatctctccttttccccttaccaaagaatcaccatttttttttttttgagtaagggtcttgctctgttgcctaggctggagtgcagtgatgcgatcttggctcactgcaatctccacctcccaggttcaagcaactctcctgcctcagtcgcctaaatagctgggattacaggcgcctaccaccatgcctagctaacttctgtatttttagtagagatggggtttcaccatgttggccaggctgatattgaactcctgacctcaggtcatccacccgcctcagcctcccagagtgctgggattacaggtgtgagccactgcacccagcctgaagaatcatctttattcagatatctcctttctgttagctcttcccttagcctgtgggtccctctgctcctgaaggtcccctccagatggtcacagcatctttcctccattctgttataactgagctccttggtgatgaagaatgatctctggcagtcattcaaacccttgccttgtttcttttaaccctctctgataaatattctgcttcattgagattatatgagcaagcaacctcttaatttgctattctggaggatctgcctcagagcctgcctgacttgccttttctgcggtagttttcattattgcttccgcctccatggaggtttgtctgtcctcacttgtatgatgccactctctctctcctggctgccacctctttgcttcttcacgggcagcttttccgtgaccttttccagtgttcaagattctgtcccagctgcttcctcttctcaccatatgttccctgggttctgtctcatgtgataggtgtgtgctgctctgattcaaatttccagctcrgatctctttcctgagcaccagatttaacctcacttgggatcatgttgatacctcaaatgcaacttgttcaaaactgtggtcccctaatctcttcctctattcctggttcattatctacctaagtcagaaatgggagaccttggtgtcatctgctttcctctttcgatccgtcagtatagtgacacctacatgtttgtcttccatcccgagtcaaccaaggtttcattagtgctaatgatgttttttttattaattcttttttttttttgggacggagtttcgctcttgttgcccaggctggagtgcaatggcaygatctcggctcactgcaacctccacctcccaggttcaagcgattctcctgcctcagcctctcgagtagctgggactacagacatgcaccaccgtgcccggctaattttgtrtttttagtagagacgggatttctccatgttggtcaggctggtcttgaactcccgacctcaggtgatccgcccacctcaacctcccaaagtgctgggatygcaggtgtgagccaccacacccgcctattcatttttttaaaattaggaaatcttctcttctgtaggtcacattcttccattatacatactaatgcctttggttttgattcttctaaatgaggggaacataaggccataagccaaaccatttcaagatggaataagatttttttttttaaattattattccttttattgagatggagtttcactcttctcgtccaagctggagtgcaatggcgcgttctcagctcactgcaacctctgcctcccgggttcaagcatttctcctgcctcagcctcccaagtagctgggattacaggcatgtgtcaccacgcctgactaattttgtgttagtggagacggagtttcaccatgttggtcaggctggttttgaactcttgacctcacgtgatccacctgtctcagcctccctaagtgctgggattacaggcgtgagccaccatgtccgggccgtttatatatatataatgctaaagggagatagacatgaagactgagaaaaaagcacttgaatttggtgatttagtggggaggttttgtaccatgatgaagacttcccatcatgcctgttcctccttgtgtacctgtttctgagatggcatccagtggtcccttccaggtatttgaaactttgttgctatcaggatccttctcccttgttcattttattcagtaagttgtgtcagtgacacctccatattctctgtgatatccctttgtttttttcctcccgaatctgaatctcaagatctataaatgaatattttcttgttgattcagatcaaactgatcatcagattgtgatgcaaatcgcaaatctgttccttcttttcacctctgttatcgttgtcttaattggaatatagtagacagtttttagttctctggcctcctttatcattcttcaacatttcacactgttgatcacccttttcttcatgaagctctcttcatttgactcttggacaccattctcctgattttctcacaacatctttgatggtttttttcttgggcttctttgagcctcccacctaaatataggttacctctgcattctgtcctctggctcagtctctcatagatgatgtctgagcactctcagccttagttgaggtttctaccaccaccccccatctgttgaattccaaatctttgtccttagcatagactcctgcagtgagcccacagatctgtatttttcagttgtttaccagataacttccattcagagcttctgtagaacttcagctacaatggattcgaaaggggggactcattccgsgaactctttcctggacttcctccttttttattttctgtcttgatgcagggtactaccagttgctcatcatctaggtaggacacctgagtgacattaatgcctccttcctccctctccacattcattaggtcacaaatcctattgattctaccacttgaattcctaaatctctcccaaatctgccttcccattctgtcctcactgctttagcttagactgtcattatttcttgcctctttagtttgtttcctaactactctcccattgtacagttacctcccctgctttctgtcttttttatttttatttaattawttatttatttatttatttttgagacggagtctcgctctgtcgtccaggctggagggcagtggcacgatcttggctcactgcaagcgctgcctcccgggttcacgccattctcctgcctcagcctcccaagtcactaggactacaggcgcccaccaccacgcctggctaattttttgtatttttagtagagamggggtttcaccatgttaactaggatggtctcgatctcctgacctcgtgatccaccctccttggactcccaaagtgctgggattacaggtgtgagccactgcgcccggccccctgatttctctttactcccatatataatatggctaaaatttgagtgctggttatatctcatttacaagtgaaatgtttggcatgcattctcaaaatctattcatcacactgagtcattattatccattttactttggaggagagtagtcccaggcctcacaaataggaagtggggcaacagagatctgaactcaggctgtatggtccagagcccgtgatcttaatttaccagttcatttacggctccctgtgccatgtttgactggcctttaaaatctttcctgagctggcctctgactttactgtttcatctcctcctactctgcctaatctgtttactgtttgatctcctcccattctgtctaatagacctggaatttcaggcctatttctaccttgttggtcttccttgaaggtgtcatattgtatctttgtttgtgcatgttgcttcctcagccttgaatccctgcctcttaatcttcaaggcccagctcaaatgacatctcctggaagggtttcttgtctgttagttaacaccaccgtcctcttcttaattagcctctattcttttcccatgatacacatatacacaactgccatatttatatttatagaaagtttgtaaatatatatattcgtatttaaataaacttttaggatagttttagatttacagaaaagtggcaaaggtagcatagagtttccacgaagcccaactcagtttcccttttgttaatatcctatgtcactgtagtgcatttgttataactaagaagctaacattggtacattactattgattaaatttgatactttattcaggtttccccagttagtctcttgtgcgttttttctgttccaggctcccatgggataacacattgcatttagtcgtcacatcatcttagtctcttctggtctgttattgtttctcagacttttcttatccttgaccttgatagttttgagaagtaccagtcacatttttttttttttttttttggtagaatgtccctcagtttgggttttgtctgatgttttccttatgattagactgaggccatgggtttttgggaggaagaccagaggttaaatgttcttttcatcacatatcaagtgcacatgctagcaacctgacttaccactggtgatgtcaaccttgctcagctctctgaagtagtgttagttactttgttagtaactataagttactttctactcctctttccattctcctgtctttggaagtaagtcactatcacaagccacattcaaggtgtaggggtggtaagctctacctcctggaggggggattattgatataaattatttggaattcctctgtaaggaagatttgcctcttctccctatttgttcattcagtcatttaattatatcaatttatacttttttatactttgggttataactcaatattgtttattctgttgatcagattgttccagctttggctgttgggagttcttttagattggttcctgtgtccctttgacatgtcccgtgtcccagtgtcctcgaaagggccatttctccaaggagccctagttttatattggaaaatggtattagaaaccaagatatgggcactggatgtgcacgttgttactggggtgtcactacttcttcgcctttcagtgtacagatatatggatgtgaacccaagtttatataaatatctgtaattatttatctgttcatctctatgttaagaaaataggagtttataccaacttcagctgattcattgccttccctccttgcttatctgtaacttccctctctgactatgagaaacttggcatccatcaccaccatcccattagctacactgtaagcgtggactttctccctgtccccctcactaggctgttagtatcttagacacttattaagtctttgttgatgagtgatgaatcttgaagttgttatgtatcttacataataaaagtttagcattttagcaaaagcaatgtaaatcaatcttgtaaagtttgaaacaaaacttttaactgctttgttatgtaacatgtattcattgtagaaaatatgaaaagtgagaaggaaaaaaagcacctgttattctatcacccagagataatacttaatatgtaggtatgtgtttagaactttttctttgtatrtatatgtctacacccccctaaatgatttttacaagaatacattcacatttcacactacttatttataaccttttttcacttatatagtatttcttaaggatgtcatgtagttgtatcataatttaactgtttttactgtttcatctcctcctactcttaaccaattctcttttttaagatgtccaagttattaccaattatttgcttttataaaccttgattaatattttcttagaagtcttgacaggctgttctgatgatgtctttagatacactcctaaaagtaagattgctggattaagtgtattttaagggttctggtacatgtttctaggggtgaggtttttacactggcatctgtttttactttgcactccttctgggaagtattctctaacacccttgagatcttgcatcccttttgcgattatgaataaatagtttttctttaaagccaggaactcacagctgttcatggtgatttatttacctgcatagactattgtgtcaaagaatgcactgcagtaccggggaaattcccaacatgatgcccaggagtttctgctgtggcttttggaccgagttcatgaagacctcaaccattcagtgaagcagagtggccagcctcctctgaaggtaaggacgcatgctgccctagggcagtcagccagccatgagagtgtgtagattcttctactgaggacttgttgcattgcgttaatacaatgaaattgactaagctctgggtgagtataagattcagtggctacttaaaggacatttcattttgtttactactgtgctggcagtgtaagatacaagagctgttgtccgcaaggaatttatagtctaatgagaggggaaacatttgcatgtatgatgagcttcagattaaaaaaagtgattccatttcactaaactgtttttaaagcagaatatgtttgctttctattctagtaagacacatactctgtagttcactggaatgaatacacaatcataaaggaaacgtatggattttctctgctgttgggattggatttgaccatagtagccccagaatgttcttattgagaaacatagcaattaattcttaattttatacatgtagtcttacaaatatgggtaaaatgacttatataatggaaaaaaattagactaaagagttgcttcccttgggcagcttttaaagtttttgataattcttctctgtacttcaaattttaaatttctaagtttggtaagttttaaattattctgattcaaggtccttttgtgcctgaacactctattctgtcatatgactatatgcgtgtggctgactctcccaccaaattgagacatcctcaaggtcaggcactgggtcttattatctttgtatcctaatgttctgtacagtgctctctgcatgtggtagcaggtgctcagtaactaattgttaggcggagggacatgaaaagttaaatacaacatgaagtagagtgtgattaggcaccaacatacagagcacaggtaataggtactagggaatttaggcatgggaagcattagtactttttttttttttttgagacggactttcgctcttgttgcccaggctgaagtgcagtggcacagtctcggctcaccacaacctctgcttcctgggttcaagtgattctcctacctcagcctcctgagtagctgggattacaggcatgcgccaccacagccggctaattttgtatttttagcagagatggggtttctccatgttggtcaggctggtctcgaactcccgacctcaagtgatccgcccacccctgcctctcaaagtgttgggattacaggcatgagcccctgtgcctggccaatattagtacttttaaagtggttggggattacttattagaggagattgggatgggggctttgagaattggaggggaactggagcatcctggggaaggggagctgcccggctgagtgctgtgcagagacgattgctggcagagtctgtgtgaggggatgagtccacgtgacccacatcctactgctgtgttctggctcctttagcaggtgcccgtcactgaagtatctgcacttgatgcatagcttgtaaaggaagtcaagatcatatgtgattctctagcttcatcttcaaccaagaattggtctttctagtctgtgaagttgtactttcttttttttttagccaccatcagagactgatatgatgcctgagggaccatctttccctgtctgtagcacttttgtacaagaactctttcaagcgcaatacaggtatgagaaaatcggatgtttccacttattttgtttacctgacatcgttctgggtgattttaatgtcaagcgtcttacctttttgttttgaagatcttctttgacgtgtcctcattgtcagaaacagagcaacacttttgatcctttcctttgcatttctttgccaattcctctgccccacacaaggtaagaatggatttagtaaaatgaagactgtattttcttatggtatccctttgcctctgtaggctcctattaggtcttcttacttatttagacaggtaatgggattaataatgggattgaatacagtcattgctacaaccttacaagaataaatgccctcctgagtttgcagggtgagcaggcacatgaggcaagcaggggctgtgtagtctggcccagttcgtcatccacacatagtatcggggttgggggacgggggctgctgagtgacttcaggattctctagagaccttactttacatttcttgtttcttcgttgctttattttgaacaatttctcaacatttccaggagttatgctgttctaaagaaaatacaaagcacagaatcaagtgtagatatatttttgtttgcttcatagaatgttcattttatgaagattgccttttccaaagatcttgatgattgtttgacagttctgcttagagccaagtgaaatttttccatttgggcttccgagtaacagtgtgggttagctttagttttttgttgatttcgtctcaggtttattttgcatcttctatattttagttgaaataagtgactaatgagaagatctgactttgatctgtacaggcctctctatgtcactgtagtgtatcaaggcaaatgttctcactgcatgaggattggtgtggccgtacctctgtctgggactgtcgccagacttcgggaagcagtgtctatggaaacaaagatccccactgatcaggtaataagtctgctaagaccagttacacatgagccacaaaagtattgctttctgttctcttagaattttttacagttctttgccaagtatggttggatagagatttaaaaccagttgcatttagagtttagggaaaaaaatcaaggccccaaagactaaaatgtatatagaaacttttcatgtttcatttaattgtgtatataattttaaaagaagctgtgactttacaccaagaccttcttgtagctttgttcataaggtataattacttaacccttcttaaatcattcctgtggatgtgtatgtgggcagtggagcgtcctcgcagtgtttgagatagtcaaagaggctttgaaaacttgagcagtgacgctagaaaaccccttcccattgtgatgataagagtggatatcttgctagtacaatgttctgtacgtaatagatgctcaatacgttttgttttctcattacggctggaccagagtctcttaccttgtttagagaagagaaaggaaagttgtgcccatgccgcatccctttttggggtaaatgtttgataagcagttatgttgaaattgaccaaaaatacttttgacctgtttggacttgacatgtttttgcatatagcttttactcaatttactattattattttatttggaaaaacattccttayttaagatttattaaggaaagatgactccgtagctaaattgctttccctagatagtagcttctggaagctactgtgtaatccctggaataataaaggtgttttgtactttggcctcatgtggcctcatttgggaagttaccacagtaaaacaaatacagccagcagtgttgccctaatatggcaaatatctcatatttttgcaggccaagtactggcatgttgataaaatgttcatattctttcctactctgaaaagcccattggctctttcttctcttcaggatgagggaaaggcagaaagggagggagcgaggcttcggtggtgtccagggcaaatctggttgcatctttagagcttccagcactgtctggctccttttgcatgtggtttaaattggtgaaataattacaagtttgctgttgacctcagtttgctgaagagagtgaattttacttgcttgttcaccggcagaaaaacaacatggtcattaaattcattagaaggaaaatgtgccaggaacatttttgctggactatttgtggaatataccaccgaccccttttacctggtagatttgcagaatgttagtgctggtagaggggacctcataggtctagtccaactcccttatttgaaagaggctcagaaaaggcatgtgacttgttcaggtttgcagggctggttgatgacaggccggaccrgaacctgcatgcccaatccagtgctttttcactagacagcgtggctgagcatataatgaagtctttaaatgtctccagtgttctcctctccatcttttgtttttctgttttgtttgtttgtttgtatgtatgtatgtatggattgattgagacagggtctcactctgttgcccaggctggagtgcattggtgtgatcatggctcactgcaacctcaaccttgtgggctcaagcagtcctcccacctcagcttcccaagtagtggggactgtaggcgcatgccaccacacccagctgatttttgtatttttcgtagagacgaggttttggcatgttgcccaggctggtcttgaactcctggcctcaagcagtccttctgtcttggcctcccaaagtgctgggattactggcttgagccaccatgcctgtcctgtttttctgttttattgtaaaataaccatttcagaaatataacagaaagaggaagtatctcatactaggtatcttaatgcgaagggttactgactttaatactrtgttatatagtatccatttagattttttccatgcatatatacattattttatataagtagaatcatttacacatattatttttaccttgctttgtatttacttagatttttgcatgttagtgcaaatatatatagtttattctttttagtagctttataattccagtaaggctatactacatttaactagttagtatttttggacatttgagttgattttttttttcaatacaaatatccgtggtttaggcttgaaaaatagaaaattaaatgatatgggagaaagcctcagagtcagatgtggactctgtccttgacatgaggctgaatcgttgtagaactttaggcaagtctcttggcttctcttctttcagtgaaacggaggttagacattatgatctcctggttctcttctacactaaaacttagagaaactctggagttagagtcatagagttctgcatcagagtacaggtgtccctcagtgtccatgtgattggttgtaggaacccttgcactaggataccaaaatccacagtgctttaatcccttttataacatggcacagtatttacatagaacctaagcatatcatcctgtatactttatttatttttactttttattttatggatacataataattgtacttccaatatactttaaatcatctccagataacttacaatatttaatacagtgtaaatgttatgtaaatagttgttatgctatattgtttagggaataatgacaagaaaaaatagactctgttcagtatacattcaatcatcctttttttttcttctgaatatttttgatctgcagttggttgaatccacagatgtagcacccacagatatggaggggtgactgtatattgttatataattacagagggtactgtgcttccaggattctctcattaaaggcaaataaagtgggctctgcgagatgtctctcagaccactgccagtcctgatggtctggagaagttcatagaattgggagatcaattagtatcgaatttccagttacccacctgtttacatttttcctatttttagattgtgttaacagaaatgtactatgatgggttccatcgttccttttgtgatacagacgacctggaaacagtccatgaaagcgactgcatttttgcctttgagactcccgaaatatttaggcctgaaggaattctcagtcaaagaggtaagggagctcctgtttccataatgccacctgggtttgcaggtttaactatagtctacctttttagttgtctattatataatgatatacatttttttttaaattgtggtaaaatacacatgattttttaatgatggtataatggtaaaaatcttatagtaatattttcctagaagaaggcagctcttactgttttaggcaaagatatatccatagtttagttgggaaaacctcttattgagatttaggactgactgtgacctctttaagtagcctttttggcatcttatcatgacattcaggaagatatactatgccataggtttttttttttttttttttttttttaaattttgctatcagctcttaagattstaacatttttgctatagaatgttttcttggtacctgcttttaagaaatttgcatgtaactcttcattgataggcagcaaaatgaagtaaagccctggacagtatttttcctcttactgcggtttgggctgtgatttggaacttagcttgtctccccactgtgcctggagttacagggttattctgattttaagagttaccaagcaactcagactttgctcctcgccacagcattcttcagggttcctcttagggctcctcttcttttgctctaccccagtggttattaatgcatcagtattacctgggaactggttagaaatgcaaattcttggtccctactccacaccgagtaaaggagaaactctggtaaacaagccctttaggtaggtgatcgtgatgcaagctaagtgagaactgccgctcttatcaggattttccacgccttgattttttgagctgaattcccccactarcctccacttttcttttgattccagttccattccttgacttccacctccctactggaatttctacttagaaatcctacaggcatcttacccttagcatttctttcttagattggttgctcctgcattttttctagaaataatggcactactatcctcctcttcactcaaactggatccaagcttgataacttctccttcaaaattctcatagagctgttgacacacactgcatttttcccctttattctactgccactgacgtagttcaggcgagtcccaactgagcctttccagtaagtttttatctttaccactgaactttctcctgtctagttatttctccacagacttattctaatacacagttctgatcatgttacatgctattgatttaccagtggttccccttttctaagatcaaatctaaacacyttgaaaggagcataaccccctcctcccctgccatgatttggtccttgcctttctttccagtctctctactccattttctctccttcctcggttcttctctttcaggttactctgtttctcagacatgccatgtgcttttccatgttccttaccatttgctgtgctgaggattcacttctccagcttctattctcgttagctcctgctttgttttcccaaggtaccttccagtctccccatcctgccaagctctaagcactcattattcgactttctctctctctttttttctttttgagacagagtcttgctctgtcgctcaggctggagtgcagtggcatgatcttggctcaccgcaaccttagcctcccgagtagctgggatcacaggcgcatgccaccacacctggctaatttttatatttttagtagagatagggtttcaccatgttggccaggctggtctcgaactcctgacctcaagtgatccayctgcctcagcctcccaaagtgctgggattacaggcatgagccaccacaccyggcccactattctgctttgtgtttctacagatttccctagtctagacttctatataaatggaataataaaatacatggtattttgtgactggctttacttagtgtgatgttttcaagattcattcatgttgtagcatatatcatacttaattcctttttgtggccaaataatattttattgtttgaatagatcacattttgtttattcattgttaatgaacatttgggttgtttccaccttctggctaatgtgaataatgctcctgtgaacattccacacaagtttttgtgtggacttatgttttcgtttctcttcatacctgggaatagaactgctgggttgtgtggtaactttatgtttaatcatttggggtacttacagacttttccaaagtggctgcaccgtgttacatttttatcagcagtgtttgagggttccagtttctctacgtcctcgccaacacttgattattatctgactctttaattttagctattgtagtgggtatgaagtggtatctcattatggttttgatttgtgtttgtcactgacatgatgttgagcatcttttcttgtgcttgttggccatttgtatatcatatttggaaaaatgtccattcaaatattttacccatcttaaaattgcattgtttgctttttgttgttgagttttaggaattttcacatatgctgaatactagacccttatcagatatatgatttgcaaatattttctcccattctgtgggtggtcaaaactacctgataatgtcctttgaaacacaaaagttcttagttttattgaagtccagtttatctatttttttttgttccttgtgcttttgttgtcatgtctgacactttatcaaatccaaagtcataaagatttaccccataatttcttttaagagttttatagttttagctcttatattatagttttttgaactattttgagttaattttttatgtgcatgtgcatgtgtctttttagtagcatgatatataatcctttgagtatatacccagtaatgggattgctgggtcaaatggtaattctagttctagatccttgaggaattgcaacactgtcttccacaatggttgaactaatttacactcccaccarcagtgtaaaagcattcctatttctccacatcctctccagcatctgttgtttcctgactttttaatgattgccattctaattggtgtgcgatggtatctcattgtggttttgatttgcatttctctgatgaccagtgatgatgagcattttttcatgtgttttttggctgcataaatgtcttcttttgagaagtgtctgttcataccctttgcccactttttgatggggttgtttttttcttgtaaattcgtttgagttctttatagattctggatattagccctttgtcagatggatagattgcaaaaattttctcccattctgtaggttgcctgttcactctgatggtagtttcttttgccgtgcagaagctctttagtttaattagatcccatttgtctgttttggcttttgttgcctttgcttttggtgttttagtcatgaagcccttgctcatgcctatgtccctaaagatactgcctaggttttcttctagggtttttatggttctaggtctaagatttaagtctttaatccaccttggattaatttttgtataaggtgtaaggaagagatccagtttcagctttctacatatggctagccagttttcccagcaccatttattaaacagggaatcctttccccatttcttgtttttgtcaggtttgtcaaagatcagatggttgtagatgtgtggtgttacttctgaggcctctgttctgttccattggtctatatctctgtgttggtaccagtaccatgctgttttggttactgtagccttgtagtatagtttgaagttaggtagcgtgatgcctccagctttgttctttttgcttaggattgtcttggtgatgcgggcttttttggttccatatgaactttgaagtagttttttccaattctgtgaagaaagtcattggtagcttgatgggaatggcattgaaactgtaaattaccctgggcagtatggccattttcacgatattgattcttcctatmcatgagcatggaatgttcttccatttgtttgtgtcctcttttatttcattgagcagtggtttgtagttctccttgaagacgtcctttgcatcccttgtaagttggattcctaggtattttattctctttgaagcaattgtgaatgggagttcactcatgatttggctctctgtttgtctgttattggtgtataggaatgcttgtgatttttgcacattgattttgtatcctgagactttgctgaagttgcttatcagtttaaggagattttgggctgagacgatggggttttctagatatacaatcatgtcatctgcaaacagggacaatttgacttcctcttttcctaattgaataccctttatttctttctcttgcctgattgccctggccagaacttccaacactatgttgaataggagtggtgagagagggcatccttgtcttgtgccagttttcaaagggaatgcttccagtttttgcccattcagtatgatattggctgtgagtttgtcataaatagctcttattattttgatacacgttccatcaatgcctagtttactgagtttttagcatgaagggctgttgaattttgttgaaggccttttctgcatctattgagataatcatatggtttttgtcattggttctgtttatgtgatggattacatttattgatttgcatatgttgaaccagccttgcatcccagggatgaagccaacttgatcatagtggataagctttttgatgtgctgctggatttggtttgccagtattttattgaggatttttgcatcgatgttcatcagagatactggtctaaaattcttttatttgttgtgtctctgccaggctttggtatcaggatgatgctggcctcataaaatgagttagggaggattccctctttttctgttgattggaatagtttcagaaggaatggtaccagctcctagaatttggctgtgaatccgtctggtcctggactctttttggttggtaggctttattattgcctcaatttcagagcctgttattggtctattcagagattcagcttctgcctggtttagtcttgggagggtgtatgtgttcaggaatttatccatttcttctagattttctagtttatttgtgtagaggtgtttatagtattctctgatggtagtttgtatttctgtgggatcagtggtgatatcccctttatcatttttattgtgtctatttgattcttctctctttttttctttattagtcttgctagcggtctatcaattttgttgatcttttcaaaaaaccagctcctagattcatttatttttttgaagggttttttgtgtctctatctctttcagttctcctctgatcttagttatttcttgccttctgctagcttttgaatgtgtttgctcttgcttctctagttcttttaattgtgatgttaaggtgttgattttaaatctttcctgctttttcctgtgggcatttggtgctataaatttccttctacacactgctttaaatgtgtcccagagattctggtacgttgtctttgttctcattggtttcraagaacatctttatttctgctttcattttgttatttacccagtagtcattcaggagcaggttcttcagttwccatgtagttgtacagttttgagtgagtttcttaatcctgagttctaatttgattgcactgtggtctgagagacaagtttgttgtggtttctgttcttttacagttgctgaggagtgctttacttccatttatgtggtcaattttagaataagtgcgatgtggtgctgagaagaatgtatattctgttgatttggggtggagagttctgtagatgtctattaggtctgcttggtgcagagctgagttcaagtcctggatatccttgttaaccttttgtcttgttgatctgtctaatgttgacagtgggatgttaaagtctcccattattgtgtgggagtctaagtctctttgtaggtctctaaggacttgctttatgaatctgggtgctcctgtattgggtgcatatatatgtaggatagttagctcttcttattgaatttgatccctataccattatgtaatggccttctttttctcttttgatctttgttggtttaaattctgttttatgagagactaggattgcaacccctgctttttttttgcttttcatttgcttggtagatcttcctccatccttttattttgagcctacttgtgtctctgcacatgagatgggtctcctgaatacagcacactgatgggtcttgactctatccagtttgccagtctgtcttttaattggggcatttagcccatttacatttaaggttaatattgttatgtgtgaatttgatcctgttattatgatgttatttggttawtctgcccgttaattgatgcagttttttcctagcattgatggtctttacaatttggcatgtttttgcaatggctggtaccggttgttcctttccatgtttagtgcttccttcaggagctcttgtaaggcaggcctggtggtgacaaaatctctcagcatttgcttgtctgtaaaggattttatttctccttcacttatgaagcttagtttggctggatataaattttgggttgaaaattcttttctttaagaatattgaatattggccccattctcttctggcttgtagggtttctgcagagcgatctgctgttagtctgatgggcttccctttgtgggtaacctgacctttcactctggctgcccttaacattttttccttcatttcaaccttggtgaatctgacaattatgtgtcttggggttgttcttctcgaggagtatctttgtggtgttctctatatttcctgaatttgaatgttggcctgccttgctaggttggggaagttctcctggttaatatccttgaagagtgttttccagcttggttccattcttcccatcactttcaggtacagcaatcaaacatagatttggtcttttcacgtagccccatattttttggaagctttgttcatttctttttactcttttttctctaaccttgtgttcttgctttatttcattaatttgagcttcagtcactgataccctttcttccacttgatcgaattggctattgaagcttgtgcgtgcatcacaaagtcctcatgccatggtctgcagctccatcaggtcatttaagctcttctcttcactgtttattctagttagccatttgtctaacctttttttcaaggtttttagcttccttgcgatgggtttgaacatgctcctttagctcagagaaccaaccttctgaagcctacttctgtcaactcatcaaagtcattctccatccagctttgttccattgctggcgaggaactgcgatccttggaggagaagaggtgctctggtttttagaattttcagcctttctgctctggtttctccccatctttgtggttttatctacctttgatctttgatgttggtaacctacagatggggttttggtgtagatgtcatttttgttgatgttggtgctattcctttctttttgttagttttccttctaatgatcaggtccctcagctacaggtctgttggagtttgctggaggtccactccagaccctgtttgcctgggtatcaccagtagaggctgcagaacagcaaatattgctgcctgatcctttctcyggaagcttcgtcccagacaggcacccgcctgtatgaggtgtctgtcggttcctactgggaggtgtctcccagttaggctacatgggagtcagggacccacttgaggaggcagtctgtccattctcagagctcaaatgccatgctgggagaaccactgctctcttcaaagctgtcagacaaggacctttaagtctgcagaagctgtctgctgccttttgttcagctatgccctgcccacagaggtggagtctatagaggcagcaggccttgctgagctgtgaggggctctgcccagtttgagcttcctggctgctttgtttacctactcaagcctcagcaatggtggatgcccctcccccagccaggctgccacctcgcagtttgttctcagactgctgcgctagcagtgagcaagactccgtgggcatgggacccaccgagccaggcatgggagagaatctccttgtctgccggttgctgagaccttgggaaaagcacagtatttgggcagaagtgtcctgtttttccaggtacagtctgtcacagcttcccttggctaggaaagggaaatcccccgaccccttgagcttcccgggtgaggcgacaccccactctgcttcagctcaccctccgtgggcagtacccactgtccaaccgtcccaatgagatgaaccaggtacctcagttggaaacgcagaaatcacccatcttctgcatcgatcatgctgggagctgcagaccagagctgttcctgttcggccatcttggaacggatccacttcattcctttttaatggccgaacagtattccatacatacatatgcatgtaccacattttgtttatccactaatctattgatgggcatttgtttttttcctaccttttgtctattatgaatagtcctactatgagcatttgtgtacaagtatttgtttgaatacctgttttcagttcttttgggtatgtacctaggaatggaattgatggatcatatcataattctatggttgtcttcttgggaattgccaaactgttttccacaggagctggatcattttacgtttccaccagcaatagatgagagttctaatttctccacatctttgccaacatttatttttcatctttttgattttagccatcctggtgaatgtgaagtgttacttcattgaggttttgacttgcatttctctaatagtaaatgatgatgaacatcttgccatgtgcttgtttggccatttatatattctctttggagaaatgtctattcaagcctttttcccattttaaattgcattatctttttgttgagttgtttttgttgagttgtaagaattctttgtaaggatgtataatactagacccttatgggatatatgacttgcaagtattttattccattctctgggttttttctctttcttgatagtgttctttgacgtacaaaagttcttcattttgatgaagtctgttttttcttttgttgctcataattttgtcgtcatatctaagaatccgtcaccacatccaaggtcataaagatttactcttgtgttttcttctgagttttgtagttttagctcttacatttaggttgttgatacattttaagttaacctttataaattgtatgaggtagggaccaaactccattctgggacaagtaaatatttacttgtcccagcaccatttgatgaagagattgtactgtcctcattgaatggtcttggtgctcttgttgaaagtccttattttaattcctcttttactttaccctctacttccagaggcctctggcacctccagtttctgattctttcggtgatcctgtatattgggttggccagctttctccaatgccagcttacaattcagttttctctggtctactcatatttacaatattttctagatagtctattatttcacttattcttctttgacccaggtgcttgtttgtgtttcttttccagttgttacgtttccctgtatgtgtttttgtttggattgtttctagttttattgcattacagtaaaaaatacctaaattatcttgtccagagagcctttcctcactccctttacctgcaggctggctggcgaactcctgctcttctgggcagttaacttctgttaatctctcacaccagcgtgttatgtggaaatgatttgttttcttctctgtccttcccaccacactgtgaagttctctggagctggggccacattttgctttatcttgttatacccagcagtgcaatatagttcttaatatgcagcaagagcccaggtaatgtttgttcaactgaaagtttctcaaaatcctgttcccaccccagttgcttagggttaacactaagcttctatttataagtgaatttggtgaatccaaaggttattgtattctagccagagactgccttattgagtctgcgttagcctctatcctaaggccttaacagatgttttattcaatatataatgaggctactgctttccccacattactggtgaggaagctgagacttggagatgaagtaaccactcccagctcacacagctggcagtaaatgggtccacagtttgaacacagagcttgatttctgtgcagttgacaatgtggcatccccttatctcgtcaggagtccacatctattctaggagaacagatcttcccacccttacctctgccaagaacctgggaaacgagtttattgtctcaacttcagatatctattatttttattttctcataccagagtttaaaatggttaggaagtaagatctactcctgttccttttgtgatttctttatggtgtttaagcttaaaaagttttcttccctctagtggcttgacaaagattcagcttttttcttatttctagtttgtatgtgttgtttttttaaactctatctggaatttatattggcattaactatgtactttgtcattttaaattgttataatgttgaggtatcttaataggttcagtgagtcttagattgctgagtattgaggttattgccagcattctgctataaatacttttgtgtaggccatttgtattttattctctttctggtggtattattattaatggtggtggcaggaggggtttcttctattttccagctgggatgtcatttccctaggctgtgcttccaaaggattaaaggaatgaacaggtagtcaggcatttattggggttgtgctgggtgctgagttgctgggtactttgattgacagggagctctgctttggggcatttgggaggatcagtactgtgcctgtcaaatatatatttttgttaactttaatgtggattgatccagtctagtagactgtattccaagttggaagattctcctgatggctctgagtctagtaggtgtagtgtgtaatttaccttttatttcttataagtctggctctttaatcagggagaagaaactgctattgaatattgaagaacattccacatctttattttttaaaaatttgtttgattactggttgcatgacctcactaaattttcttggtgaatcatctcagcacacatgcccttctaaaactgtatctaaccttcactgaagtgcagttttaattttcagtttttaagataggtaaggctagtttaaaggaaataataatggatgctaaagaaattctctaacggctagatgagtaatctaagtaggatgtttctttttttgattgcagtttaatttacataatgacatttttaaaaaaaattttctctgttgggtaaatttcttcataacgagtgaataaaaataattttgaagagataaaatgagttgtttttattctgtttcaggaattcatttaaacaacaacctaaaccacttgaaatttggcttggattatcatagactgtcttctcctacacaaacagcagcaaagcaggggaaaatgkattctcccacatcaagagcaggcagcgacaagattgtcctgttggtgtgtaaccgagcctgcactgggcaacaagggaaaaggtgagaaccagattattttccagtaagtacctagactgtaacagttcagtattttcaaacatgttaaaaagcatgggcaaaaagttcttacttttagtagttaatttttgattctgatatttagaaagaatacatgtacaagttgacctgatttggggggttggtcgggggagagtaaaattaggaatctggggttttttgttgttgttgttgttgtttgtttgtttgtttgttttttgatatggagtctcgctgtgttgcccaggctggagtgtagttgcgcgatctcggttcactgcaacctctgcctcccaggttcaagcgattctcttggctcagccttccgagtagctgggattataggcgccagccaccacacccagcggattttttatatttttagtagaaatgaggtttcaccatgttggtcaggcaggtctcaaactcctgacctcagacgatccgcccgccttggcctcccaaagtgctgggattataggcgtgagccactgcatctggccaggagtctagttttaaaagtcccatttcatatgtgtattttcagttcaggctcctcttggggctctagacccatttccagctactttcctgacagcttttttatttttatttttttaattgttaacatgtctacttggatggtgcatgtccctcagtcttctgtcccaaattgaacttatgtcttatgtcccaagttgaattgaagtatgtccaaattttctttccttttaaaactggctctccagtatttcccatcttggcaaatggcaccacacattcattcaggtttctaagtcagaaatttgggagtcagaaatctctctcaaatttgtctaatgccctctgtaagagtgtatgggtgttttagactatcttttaaagtaactctgtcacagtaggaatgtaacctgagtattaacaagagacagatatgtttcaaggagaaaggactcagtgtttcttaacatttgttagaatagcctttatgttagcctttgaaaattttgctttgaaataagttccctgcatagtaaataacataaatgtaaaatgtgttgatatgcatatttatgctattcattgacaggtattttagtgtttacagtgtgttgggcatggttctaaacactggggattcagcagggaacaagacaggcaaggtctgtgtcctcatggagcttccatcctagctaggacagaccgactatgaacaagcagacgtctttaacttcagacagtccgtaccacgtcgaaggcattaaaacagactagaatgatagagtgtgatggtgggaggctggcaagacracattaggaagggaggtcagggaagrcgtccctgaagagaccgcagccaagctgagccccagtgtgctgtgtgaacatggggggaaaggatcccatgcagagggaacaccyggtacatgcacacaagactaggaggagcttggtgtgtgtcaggcacagaaggaatgaagtaaagaacctgtggaattcccttcatgatgctagtctcttaaagagtgaagtcattattttaaaaaaatatggttgggtgatttacatgtacttgtaactcatttcacctcacagtagtttttaggcagattggttcactgttaagcaccactgtgagcgaacagtttgatagttgttggaaactggtttcttggtgatcttagcacctctacttccctctgggcctgagtcagagttaatctgttagatcatttgttcattcattcattcatctattttctagacattgtctgtttgcgctactaagataaataaatcacagtgcttgctatcaaataactcacagcctattggtggaggcagaaaaataagcaggcattgtttatagcacagtatacacagggaacaagccaacagggtgcctcctggaaaagaatacctccactgggtcttcacatgagtgagtaggagacagcctagactcagaagggtggggagggtattttaagcagagggagttccctgacaaaaagacatggatgtgtgagagtaggacacattcagggaattcaggtttgactgactgggcgtggatgagagttgaggctaggatagtggtcctcaacattggctgcatattagaaccacccagagaggccctaaaaacatctcagtgctcagatcatattccagactgatttcatcagaatctctccgggggctggacttgggcatcattattttctaaagctcctcttgtgattttggtcttcggtctgtgcagctgaggccaagaaccacagtactgcttggactctgtgggacatagctctggagctgwctttcactgtcacttgcttgccagtgcctcccttgttgtcagagactcaagaatgtggctgcctgtctgtgagaccttccagccctatctagtcctctggcacccaacctcttatgagttcgacctgtgctgtttgccaggctcatgtccactcccaccccctgtgctctccatcttcactgatcctgccccgttgccacctgctgwcctagcaccatactcccctagaagccattttggtgtattggctattaaatttcatttagaaatccaagctgttcatctccttatgaagagttaccattaaatttcctgtttcttttattttgagaactgtcctaaagccaattatattgtgattccgttttaagagatcgagaaaaaaagataacagtgttaaaggaattaccgtactttaaaggtgattacattgttgatgtgtgttagatttggactgccttttgtgctgcacttagagaagacaatagcttgggaccttctgcagaaggaaatcttggagaagatgaagtatttcttgaggcccacggtttgcattcaggtttgtaagcattttgatattccagcatagcatgggtatatactcagtgaagaaacaaacattacaatgaaatttgagtttcttgtgtttagatttccaggactgagaatttatccctcattttatgaaagagctagccactgcaaggttttccttgaactgctgcatattcctttataatatttatctaataacgttcaatacatgatcagcttggaaaggatttagtagaatgtctatctgtatatgttaaaaattattactatgttaaggtatccgtggaagaccattaagctgatgtttagtaaaggcaatgtgttacttgtcttgcataacatatttgatacgtaaatcgcatttgggtaaataatatttaaagtgtattagagtggctcaacaaccttatagaatcttatagtgaagcattttgcagaataaacagtttactgtaactctaatctgttttggaaatgccactgtgaaacagatgcccttgaagaaaaatttggcttaattctcatctaacatctgatgcaggtgtgtccattcagcttgcgtgtggtcagtgttgttggaataacatatttgctgccccaggaggagcakcccttgtgccacccaatagtagaaaggtaaaaaaaatttttttttaaattaccttttagaatctcacacatattcatgtgtgatttcaagtgatgtcttatataatttccacataagtgtgcagggttctttaggcttatttcgaaattaagtacttattttacttttgatttgtgcttgggtatatgtttgatgatctttcttgaaataagaaaagccctggaggacttgggttaggaaagcaaattaacgtatgtcctaggactgtagataaattacactttcatattcaccaggaatgaagttttgtaaagtaacgttctaatcaggccacattcttccttaaaacccttatatggcaacttgtggcctaaaaaataaagcccgtgttccacaatgtaagaagttcttcacagtttgaattccgcttacttttgtcaggctttgctcttcctctccccactatcccaacctttcagcagcattaaagtacagatgattgtttgaacaggcgatactattttatatgcgtgctttgcatgtgtggtttcctccgtccgtaattcctttcctttaagcccttttttatactcttcctcctcccacccccagcaacctgccccatagaattagtcactctactctgctacctctgtgctgtctaaatctgttataatactctattgtattaataaaataatatacatatatacacactatgtatctatgaatatataatatacatgtgaaaactcaaattttttataataaaaattattataatgattttttcaacaaatattgtagtgcctatatttcaggattctaaaaaagcatacaatatggtcctgcttgaaagcttactgtttgggtttagagatgagagttagtagacaacaatccaaaatattgcataacaaacaagatgagataggtaatattaactgagttctgggtttctcaggagatggcaaggagccagtgaacttgggacgggggtagctttggaggaaggaggaagaagggtgcagtctagagcaggcatggcatgttggtggagaggtggaaaggtgcaaggggcgactttgttcccaggggactaccgtccagtgtctgtttgggtgggtgaaaaattgggcaagaaattgggaaggtcataatgactatctgagagtgatcatcaaccttatgacactaaatttcttccaacctctttattattartactgtattgggctttttartttaagggtttttcagtttagttgaaatgtagttattaaatcagtggttatagtggtcttgctgaaaacttttttctgatggggaactatgatgaagattttcattaatcacctgaaattatgattttgggtaggacataatcacattaagtaaaatcatttgtttagaaaataatatgtggcttccctctccacttccctggttctatagggcattaaaatcttgtggaccaggtggcactrctcatgtgaaattagtagtcgagtgggacaaggagacaagagatttgtgagtatttttaaagttagtgtttatagaaacattgttttaattatcatttttatagcacacctttgatatgttaaatgagctgaaacacaaatctctcttctctttagctaagtatccaggtgtgttgttaaccctttatttaagcagtttattattcctttcctatacattctctcttcccaatcccagaaccttagaacatttgttcactgctgaaagagaagctgtatactcattagctactatataggttcaatttactttgatttttattacaggcccattaattctagaaagcaatgtcagatgcatgttcttagatgtaaaggacaggaatatgtggtttaaccagtacagttcatggccaaacccagaaaaatcaagttagttctggaaataactttgtatacagagaacttttcaagaacattttggaatatagaaaagttgggtcactacttttgttttcttacacattgattttttttttccttcggttatgagtttgtagtcacttcatgaagccataattgtatttttccttctgttttgcaagacattccctgatagatgcttttccccctaattgcagcttatttgtaaatactgaggatgagtatattcctgatgcagaaagtgttcgtctgcaaagggagcgtcatcatcagcctcaaacctgcactttatcccagtgtttccaactgtacaccaaagaggagcgggtaagagactgggcagcatttcttggttgctcagggcagtggggagtggggcatggcaaggtgatagtggagaaacaaatcacgccccagaagtcgccgcaggattttgcatatatgtaagtctgcacatgtaatgagcatcttaatgctcttgcttttaggactttaacaagaagttgtaagtttctagaaaaccgtgattaattgaagtactctggaaatgaaccttcatagttctttttaatggttaatgatcaagttttggtgattttctttctcaatttagaagttttaagatcttttccttagtaacttaaacagtgattcttgactttttggtactaagaacataagtgccaggacctatttaaatttaaattaattaaatttaaaaaattaattaaaattaagtgaagtaaataattcagttccttcgttgcattagtcatgtttcaagtgctcagcagacacatggtggctagtgggtcccatattgaacagcgtagatatagaccagaaagtagacagcaaggcttcgcaggtagtagggacccagtaagtatttaaatgaatggatggacagagagatggataaataagcctctttgggtggggcccaggcctgtgtgatttttatgcaccttataaacattgactagagtacttggagtcatctaaccttgcattgatatctaggatcataattttgactactagttgtaactcttcactcttaaatggagtcatgcaatttcaggattgaaggggactttaaaactcttttattctggtggttgggttcttcttctgcttaatttcaaataggtgattgcttagcctgagtttgagtatcttttgttatgaggtagtttgcctcgttaagacagagatagaccatgttttctctggatggctctgatggtgactgaagttaacctgaaatatgtccactggttactatagccaacagttgttctctgtcttaaattcattatgactcagaagtcctaatattatttttgtctgttgttcgaatatttgaaaatagcttttgtatttccagcgagtcttctctcccccacactgtttttagctagtttctttaataatagtttttcataagacatgggttttttttttcaccccttccccccctcccccccgccaggtttgcactcaattatgaaatagttggctttggaattggttgactgtaggttctctatgacaccttgccctgtttagctttttttttttttttttaatgactttggagatgtttgataatggcacaaagataatggatgagcaaatctactagatggcagcactggtattccacaacacatctcactgatctagaatggtagcaggataccttttaacaggggctcattcattcagtaggtgttttttgagtacataccatgttaggtatcgtactggtactgaagaagtagcaggggccaacataaacaacatttttgccttcatgctgtttgtagtctagtggaacaagtaaataaaggaagcaaagttcctggaggaggaagcaaaagccctttggcaagactgtcaaacagaaatgaagccagtatggctggaggacaggaagtgagggacagaattgagacagtatatgctccatgagagcaggtactccatctgtcttgatcactaaataattccagtatccagagcagtgcatggcacatagaaagtgacatctggccgggcgcagtggctcacgcttgtaatcccagcactttgggaggctgaggtggacggatcgcctgagttcacgagttcaagagcacctgggcagcatggcaaaaccccgtctctaccaaaaatacaaaaattagctgggtgtggtgatgcatgcctgtggtcccagctactgaagaggctgaggtgggagaatcacttgagcctgatgggtggaggttgcagtgagccgagatcacaccactgtactccagcctgggtgatagagtgacactctgtttcaaaaaaaaaaaaaaaaaaaaaaaaagagagagaaagaaagtaacatatttamcatttatacagtatttaccgatttagtcgttcctctttgagggataatctattcaacaaaccagaatctgtttagagtttgggtgccagctctggctrcttttgattgtgttattccattgatgcccagcatctgcggtttacagagagattttgagttgcaccatgccctggctaaggcattagtccagctgtaacacagtcttgcattaagtggcacttaacgggagtcatgcttctgttttcagcttgcccccgatgatgcctggcgttgcccacactgtaagcagctgcagcagggaagcattacrttaagcctctggactctgcctgatgtgcttattatacatctaaagagatttcggcaggtatggaaatcctttatcctcaggaacaaacaagttgtgacaagtttcttatgccccctgctgatgggctctgtgagggttctttggtatacctgtttgatccagtgagtcctgtctgtgtatgttatagacacacttttgcccctgtgtttagggtaatgttttgttctttcccaaggcaaaatttgattttagttcagattgcagatattttacttgacttgtaaatgtcgtgcctaaattttgttaagtgtactctgggatttaaaaagaactaagtagagatcctttctgggggaggtagaattctgtttctacctaatgtaatatgggtgttctgctcctgagaagctgttgtatggttggggagatgagtcataaataaatacaaagaaaatctgctttgaattgtattgctttgtgagtcagtttttccaaaaaggctgtctattccctgaggttaggattgtctagacagtctcattgtaagaggtaaatgggaagtaaacattagcggactccacaaggcctggctcttagtttgtatctgaaagatgagcaagcttttactaggtgaggtggaagcagggatctcccacacgggggcagagagagcagtgtgtgcaaagcccgacagtggagaaagcacagcctgcacgagaggctgggagcaggccaggtgggcaggcagtccagaggggtgggcagtggcgggagttgatggaagacgtgggtggatgctggttgtccaaggaaccctttgggggcggagtaggattccgatgaagggttataagcagagaagcaaccttactaaatctgtattttgaaaatattattctggatattgtgtagataacagattagasgctacaagaatgaagatggggagacctgaaggaggcccttgccttcatccagggtgggctgctagtagrtgggataggttgtggcagtagagacggagagatgttgaggactgtctgaggaggcggaggtatcaggggcaacacacagatggtccccaggtctggggctttcacacagaggtttgaggttcagctcctatgggagtgaagagtgggcatttggcacccactgtgtattcygttgggatctgcaggtggaaagctggctgagggtttggatcccagcctgctgtttctccttccccagacacagagtaatttcctgggctttctgttttcttttgaaggcatgtcaccacccttccagcaatccagaggcaaacctgcagtgtcctctttgactcttctttcttgtccctctcatctaggcatggccatgcctcttcatygactcctgtgtgtcccctccccattcttgctgtcagacagcgtgctggttcagacattttgttgcttttcagctggtcactgttgcaatgattttaattgatttttcacctccattactcctatttctaacatgttctgtgcactgcttacacagttcttgacccacaactctggtgacatcaccttttccataaaagccacagaggatacactccagattcttcaggctggccttcctgaccacccaggacccatcatccctttctctcatgaacatttttcttcccttcacagacctatacgtagctccttagggtggacatatctatgcctggttaattttttaaagttcccatagacacaggaaacattcagtcattatctcttcaactgatggttggatttcaaagcatttccctataggtttaatggaaaatacagattactaaagattgccactgagtggatatattaagctaagacagtgttgccttgtgatgtgcctgttggaggatgtggaggggaacaggcactgcttatcaagaggctcttctgcaccaggcgctgtggtttgcccttcatggagccatcacatcattagttttcatgtctctttgacagaggtatcaggaagagccacctgatactgtcatttttttttaagtcaaatgctttaaagccctttaacagataaggaaaggaagactcagagaggctcatwtaccccctctatatggatccttactggttccaccttagctgatattaaaacctgttcctctagatagctaaaactatcatctgtttccctgatttgtatgtcttgggaaacatcagataggtaactcacaccgctttgtctgataggatccacattcccctctaaagtgatctgccatctgcttgcattaaaatatcaccagaacttgtttttcttcttgcaacaggaaggagacaggcgcatgaaacttcagaacatggtcaaattccccttgactggcctggacatgacacctcacgtggttaagaggagccagagcagctggagtttgccatcgcattggtccccgtggagacggccctatggactcgggagggaccctgaggactacatctatgacctgtatgctgtgtgcaatcaccatggcaccatgcaaggggggcactacacaggtctgcagtgtgagaggctgcgtgtctgtgctggcgagtccttcagacgggtttgcttgtggcagggtgacttgactttagagcctcatttcccctccggtaggcagtgtgccaactgtgagggcagtttccatcctctggatctctgcccaagagcaaataaacgaacattcttcctccttttcctgagttgggtcgtccagtaggtagctgactgattggggagtggtatgtgcagatggcattgtctggtcaactgaggatttgctctttgtttacctaacctgcrctccccatttacggttttgctagatagagttccttgagttctatcttctctctcattttaaatgattgtgaactactttttttttttttaattaaagatgagctgttgctgtgttgcccaggctggagtacagtagctattcacagatgtgattatcacacactacagccttgaacttctgggctcaagcaagtctcctgccttattctccagagtagctgggatacaagtgcatgacacttttatagtgtctttaaagtgacttagaagggtttttctttttgttttaaggttaaattgaccttgtcatttataaaagcaactatgttcatcatgaaatttagagtctagaggtggaaagaataccatcatccatgggcttatcactgagataaccactggtaacattttttttaattgcgataaaatatacataagaaaatgtaccattttaaccatttttaagtgtacagttcagtgacattaagtacactcacattgttgtgcaaccattatcactatccatctctacaagttttttaatcttcccagacttaaactctgtacctaataaacactaattcccattttctctcccttcagccatgacaagcaccatactttctgtctctgtgaatttgactactcttggtacctcttttaaatggaatcattcaatatttgttcttttgtgactggttatttcatgtagcataatgtctgtaaggttcatccatgttgtggcaggtatcagaatttcctgcctctttagggctgagtaatgttccactgtatgtaggtaatattttggtatgtagtatatacttgacgtgtttttctcttaagtttttgccattattttccactgttgggattttactggcattttgttgttgttgttcaagtgawcatttattgagcccctcacatcctgcttgccctgggctctatcacagcagagatcagtaggtccccagcctctgtcttctgagagtgtaatcaagtagagggagatgtgggtacagatatggtttaaaaaggagtcccacatcatgggttctgtggtggaggtgtgagcagtgggcagagatcagagccagaggagagagtggccagagcgtgctggagggggagggtcagctgtcggggaaaggagcctgccgcctcacctcatgggctagagtggggtggatagacaggtcacaaattcagaagcacagcagcacagtgaggggtgagtggcgcatgccttctgcatcctcatcttcacgcctagtattgtaacagaagtagcttgatgtggacacttaattttttataaatactttttttttttttttttttttgcgacggagtctcgctctctcaccaggctggagtgtggtggcgtgatctaggctcactgtaacctccgcctcccgggttcaagcaattctcctgcctcagcctcccgagtagctgggactacaggcacacaccaccacacccagctaatttttgtatttttaatagagacggggtttcaccatgttggccaggatggtctcgatctcctgacctggtgatctgccctccttggcctcccaaagtgctgggattacaggcatgagccactgcgcccggcctataaatactttttaatgaccacagaatgttctgttgatagatctctaatgttatctaacccttccccattgctgaacatctatattgtttctggtttttaacttttcgtgtaacattgttgaatatctttatgctctttcactttttttgaattttaattctgtatttccttgagattgagtcttggaaatggaatcattgggctaagggcctgcwtgagccttttgggagccaggcagatttcagggctttattcgttgatgtgagggttgatgtgattaatttgattatccgtgtgagtgkctaggatttggatttctgcatccttcacactcagtgtgttatatatgtatacttctcagggactttctttattaattcagtggtttctgcaacaagaccccgagtgctagtgctgaccattgatttataaaggtagggagagatggaggaggggtggggtctggccaatcctgggtactattaaatctctgggactcttttctctagtatttagccgtgaacctccctccccatcagccaaggcagaggagtccgttggccttgctacctttcatactcactgtttcagtctgctctgttcccttccaggagggccggggttggggaagattactggacacaataatcttttattcttgaaacccttttagttcaagttctttaaatagatatttttctttttttcaaactcattttactgcctgaagttctttaaatatttaaatgctgcaggcagcaattgtttgtgagaggaatgatcccaactttgagcgcatcttgtgatggaatggcttggattgcctctgcctgctgtaggaagcgctttcaaggagagaaagaagctagagaagtttgaaagatgctctcacttcatagaagacaaaagttaatgtgaattaaatgtttagatatattttgccttgtactttggtttaaaccatatttcaatgatgataatagtatatttggtatcttacatattttaggtttctattttatgggggccatgtatacaaatattgtgtcttgttggatttttgcttttgtggcattaccagtcatgtctgtgttctttggtactgagtgatggaattctatacttgtggactggtagaatggaaagggatgtggaggtcatttaacttcacaactcacccggtgttgtaacacctttgccagcatccttgattggcgttcaccagctcagctttggtaaagaatgtgttttccatttataacactatttctcaagaaaatatggactgkcttgttacatagtttctgggaagaaattgttgggaagaataagacagggctagactttagcatcktgttgctctttatatatagaatagatcttggaaaatgcctggaaacctccaactaccttagaggcagtacagtttggtggaaggagcttgggttagaagccagacacatctttctagctctgtgtcctggggcaggtagctgttcactaatttggctaccatgttagtgagccaggaagaggtcatgctgacctcaaggaacccattacccaggatgtgctcagatgttttctgtattatttcccctttctcatgctgagaccctaccaccacttttctagtatatgagatgtttagagtcttagtttagagaacattttaaatattcttcgcattgttgaatgaaagatactctgtttttaagttttttcttttttttttttttttaacatcaacttttaagttcaggtgtacgtgttcaggatgtgcaggttggttacttaggtaaacatgtgccatgatggtttgccgcacagatcatcccatcacctaggtattaagcccagcatgcattaagctattcttcctgatgctctctcacccctcatccccatttttaagttttcatttggaatgtttattttatgttttgagacagggtctcactttgtcacccaggctggagtgcagtgtgtgatcgtggctcactgcagccccagcctcccgggctcaagatcctcctacctcagcttcccaagtagctgggactacaggtgtgcgccaccacacttgcctaatttttaaatttttttgtagagtcagggcctatactatgttgtccagactggtctcgaactccatatctcaagcagtcctctgcctcagcctcacaaagtgttgggattrtaggcataagccaccatggccggcctggaatgtttattttgatgtaatctttattttgcactgtttctagctataatcgatggtataatgatataatcgattgtgtaaggattctagaacagtgcctctcacaccatctgtgatgaagaacttggttttttctactttaaaatttccaatcctttmtcaactagtgcatttgtaagaatacaataaaaatatcacggcagtatcagattgctataaaagttttttaaatgctkttctcctttttggtgcttctctcgtgtgggctcgtgtcagtccgtgagccataattctagtagcactggcctagagaatacttcagaaagtagttctaggaagaaaagcaagtagaattattttgtaattaatgagtttgctgtgctgtctcagtttccacactgtgactgagaagaggccattctgaagaggagcaggctgaaaggaggcaaggctgttctgtctccttctcttgggcatgtccctcacagctctgctcccactcaccactccagaagagcagctactccccagctgggtcatgtgtgcatcaagcctgacctgacgccactggccaattgctgtttccttagagctccatttgctgcttacattttaagttctttcccttctggttccggcaagttctcagctgcaaataacttccctgcctccgttcataggtccttattctgctctcattttgggggacttgtctggtgtagccctttctcacccgcgtctcttttatcccttaagtctccatacttgcggaaatggttatggcccattgaaggagtcactcctggtgcctctcaggaccttatctgccccatccctggggccatcctgagtctgttccagcattcagctaaatattctagcactcgtttattctcaccccaaataaatgcatatttttagaaaatgtgatcataatgtacttttctggatcaagcttataacaccctttgatatatccttgcaggatgactgggtttgtgaactcttaagttttygtctgtttttgctgctacttgaatgttctttatttctagctcaggcttagaatttggactgaaagaagtcctcctgcgttcatgrgctcatgtgttctcagtctgccagggaacttccatggagcctggtttgtgctcctccctgagggaagcagggcaggatagggcttcaagtgcaagccaaggacttgataagcctgaaatgagctgggctcctgcctttcaccagctgcacgaccttgggcaagcagattaatctttttcaacctctggaaattgggagtaataagagaacaaatctgaggattaaatgagatgcttggcacataataagtgttacatattatatttatctgctatcatatcattatattgttatttctattcatattatttgctatttctaatagacactaaaatgttgcaacacactgaactcagggtttcttcaccctggcaccattttggtcggacagttttgtcttgcagggggctgtcctgtgcattatagaatgtttagcagcatccgtggcctctacccactagatgccagtagcacctctcccttgagttgtgacaatcaaaaacatctccattcattgccaaatcccactccccccgccacagacacagttccctggttgagacccattggtttaaataagtrtgtgttttctaagatgaactggaactgcatctacttggaatggtttggaatttctcaagatattttgctcgagtgtgatacagaatttagaatttttttttaatctctttctgtgttgctatacgcagccttaaaacgttcttgagttaattagatgagccaaagagatggtgtctgtgggtcgcatgaagtggctggtgcagcctcccctggtgctgatggcgggctctctttggcagcgtactgtaagaactctgtggacggcctctggtactgcttcgatgacagcgatgtgcagcagctgtcagaagatgaggtctgcacgcagacagcatacatcctcttctaccagaggcggacagccatcccgtcatggtcagccaacagctcggtggcaggtgaggtccactcttgttcttgggcagttttttccagagcaaaagattgtaatgaatggtctagaggacctctctggaggctctcatgactcygtcagtttgatcagatgaatccttacgtttccatttaatctggaaactaaaatgactrcagtcaaggaagttggggaggaatgtgacagcacctgtggcccagtggagttcactggggacagtgggttggacctggcgcaaagaaagctcatgatgtgttcttgtggataaatgcatgggtgagctgaaaagcagcgtggcatactacccgctgtcctggggttatcctggagcctgtcccatctgggccacatagcaatcatctataatacaggtgtaataataatgcctacctcatggggtcatcgtaagcatccagttagataaatgtgtgttaaaacattttgtaaagggtaaaggaccattagaaatagtctgcttttccagtgagaagattggactattctgttaggagaaggattgatggctgtgataatattaggtggcttgggtttagccggatgacatccagcctgttgtgtttaataaatgcagggaccagtacccacacacaatatgaatgcagccacacataatccaaacaagtggacacacgtttctgaatgcagagtttgacttcaagagagcgtgacagaggattggaatgtggtgatgtgcaatcaggttaggggctatgaatccttgcttctcttgaagcttgcagggggtgagttcaaagcagtgaaaacaaggcatctctcaagcagaatgacgccctgctgggggccaagcccacccagtgtacagccactcactcagttaacacagcgggaactccagtgctcttccaccagtctcagatgtgctcagaaatgacaccttcttgaggtctacttgagacagtcatgctgcttcatgtactctgtttcaagagcaatttctcttgccctaataaatatttaagggcgtccctggaacagacagggcagattgacatatagctgtgtgtgtgtattattaatattatgaaaatggtgacaaatttccttaaaacaggctgagagaaaaagagtatactgccgcatcctctcttctctttgtgtaagaaatattactgcaattgcttagaacagtgcctggcatgtagatgcttcataaatatttgtagaatgaatgtatgagtgcttgtctattccattctcttgccaattctttagactcagacttacattataaagtattcatccctatccttgcattttattactacaaatttcatgcgtcaggaagtctgccttacatcttttcatcttaactggggatattcggacaggcacgacatgacacagggtctgggaattgatgctgacctcggggtgaggacatcaacgccccccagctcagctcgtaacaccttcatgagggtgtgtgtggctcagggctggccgagggaccccagcctgacctctatgcctgttttcttctctgcaggctccacaagttcttccctgtgtgaacactgggtgagccggctcccgggcagcaagccagccagcgtgacctctgcagcttcctccagacgcacctccctggcgtcgctctctgagtccgtggagatgactggagaaaggagtgaagatgatggtgggtgtgggttttggtgacaaatttccagaatggtaactcacagacacagcagagtccctcgtgtttttcctaggagctaagtcccaaggagatggtaggagaacccaaagggagctacagggagtggagctgtgtagctgtgagttatgatcctaaaaagcattttgtattaacagagtcatttgcttttcctgtgtcccagtactttctccttccacttcattattttccacttgtaaggtctcttgtggaggctggagctttatataccaatgtatactttttttttttttttcccaaagtgttttaaaaagcaggatagctggaagaggctcagagagattgtgctttgcccaggccacgtggtggggagtcggctccaggcttggcayggaggcccctggctctcttggccccaggagagcctcaccttccaacatgctgctccccagggaggaagctgtggaatgttctttttagtacagaagcatctaaaacaaaagctgttgttgcctttgcatagagatagtaaaaagtccgataaaaattgaactcttttttttttttttctttttaaactttcactttctgcttgggtaatggcaggatagacsttagtttcgacagggacccaggtggtgtgggaaggaccgggcagccacagtactgggagctggaargagtgagtgcagcttctataatgagcatagtgactcaatctgccaacaagtctcagtctgcagccagcatttcgatcactgtaatctgcttctagtggtgatggataattctgagaaaatgaaattgagttaaaattgcaataggctggaagaagaatgccaggtgaagagagctgcaccatagctctagctctgccacctcttctggcttgttgcctcttcctctttatttgtaaaataaaaacattggactgcaattcctaagctccttccggctcctcacatcttatggaaaactgactggtgaacctttgcttgtttaggcagaggttattttcagtactgcctttaaacttagaattcactgtcattttaacgataagcctcaataaggtttgcctcagtctatttttaagcagtgcagttggtgaaatcagtatccttttaagcatcatcattgtataatggtgctgggtggtgcccacagaatagagcctgtttcttaggctctataaagacagaattttgtaaatatcacaactgtagtatcattgtgtagaaaatttaatttagaatattttcttaggacgttttgagccacaccaaataggagtatgtggttctgattatgagtatttttttttttttttaaacggagtctgtctctgtctcccggctggagtgtagtggcgcgatctcggctcactgcaagctccgcctaccaggttcacgccattctcctgcctcagcctccccagcagctgggactacaggcacctgccaccacacctggctaatttttttgtatttttagtagagacggggtttcaccatgttagccagaatggtctcgatctcctgacatcgtgatctgcccacctcagcctcccaaagtgctgggattacaggcrtgagccaccacgcctggcctctgattatgaatatttttttggaagttttaagttactggatttaggagtatatgatatccaagtctttttagctctttgcgttgatccacatctgtagtcaacaatgacaggccagcttacatgtggaattgagtggtgcgggaaggggttctgggttctggtattagctcttcctttaatgagttgtgtaatcttggtcaaggacttcatttctgtgagccccagatcaccttcaggaaggtaatgaagctgggtcaatacctcacagcatctatggaatgccaggtgctctgttgggcacaggacttgtaaggttgtatttaatcgtcacacttgccctgtgagttagaccagaggtcagcaaactgtagccccataggccaaatacagcccactgcctttctttgtaaacatttttggaacgcagtcagacacgttttcttacgtgtcacctgtggctgctttcatgcagcagtgacagagttgaatgtttggcctgcaaagcctaacatctgctgtctaggccttcacaggaaaagttataccgagccctgatgtagggcaaggaggcgaatagaagtttgctgtgttagaatgatcctgagttagaatgtccctattttatacataaggaaactgggctcagaaaagtcaaagccacacagggactccttgatcccagatgggctggctctgaaggtcatgctcctttcatcccatgaggcttaccttcgtttcaccttcagtgtcttacagtgttgtyagaatgtcttcattggcttaacttaacagtattctctttactgtgttcaggaggcttttcaactcgaccatttgtgagaagtgtccagcgtcagagtttgtcatccagatcttctgtcaccagccccttggccgtcaatgaaaattgcatgagaccttcatggtccctgtctgctaagctgcagatgcgctccaattctccatcccgattttcaggggattcgccaattcacagctctgcttccaccttggagaagattggggaggcagcagatgacaaggtctccatctcttgctttggtagcttgcggaacctttctagcagttaccaggaaccaagcgacagtcatagtckccgtgagcacaaggctgtgggccgggcccctctggctgtcatggaaggcrtgttcaaagacgaatcggacacccgcagattgaactccagtgtcgtagatacacagagcaaacattcagcacaaggggaccgcctgcccccgctctctggtccatttgataacaataatcagatcgcttatgtggatcagagcgactccgtagacagctctccagtcaaagaggtgaaagcccccagccacccaggctcactcgcaaagaaaccagagagcacaactaagagatcccccagttccaaaggcacttctgagccagagaaaagcttgcggaaggggagaccagccttggcaagccaggagtcatccctttcaagtacatccccttcttctcctcttcctgtaaaagtctctctaaagccctcccgctcccgcagcaaagcagattcttcttccaggggcagtggacggcattcatcccctgcccctgcccaacccaaaaaggagtcatccccgaaatctcaggactccgtgtcatctccttcgccacagaagcagaagtcagcctcggccctcacctacactgcttcctccacatctgccaaaaaggcctcgggccctgccacaaggagccctttcccacctgggaagagcaggacttcagaccacagcttgagtagagagggctccagacaaagcttgggttctgacagagccagcgccacctccacctccaaacccaattcccctcgggtgagccaggcccgagcaggggagggcaggggggccgggaagcacgtgcggagctcctccatggccagcctgcgctcccccagcacaagcatcaagtctggtttgaagagggacagcaagtctgaggacaaggggctgtccttcttcaaatcagccttgagacagaaggaaacccggcgctcgacggatcttggcaagacagccttgctctctaaaaaggctggtgggagctctgttaagtctgtctgtaagaacaccggggacracgaggcagagagaggccaccagcctccagcttcccagcagccaaatgcaaatacaacgggaaaagagcagcttgtcaccaaggaccctgcttctgccaaacattccctgctgtccgctygcaaatccaagtcttcccaactagactctggagttccctcgtctccgggtggcaggcagtctgcagagaaatcctcaaaaaagttatcttctagcatgcaaacctctgcacggccttctcaaaaacctcagtgatatttctgcaatcraagtgttttatctgtaaagatgtttrtttatttagaacccctgccctcccaccaaagcctcctgtgcttttgttttgtacttttttgagtcacgtgcccgackgtgtgtgtgtgtgtgagtgtatgcgtgtgtgtgtctaattcaattgcaaattgttcaaagcgtcgccttattctgccattgaaccaaataacagccataggcaaaacattgacaccaagctaactggaataattgtagacgatacccaggacggtccctttagcaattgtacatatttctttctagagaactctaatgactttctttggatatgagggttttgaaacctgtgaaccagaaaagctaccattagtgcgtaraaggaggaaggagctgactcgtgtttcttctgagcaggacttgtccttactgtggattgtgggtggcaccaggagctctaaaaactgtgactctaacaacgaaacaaatcgagggaaaaactcttgctttctgcactttcgccccatctaccagtctttgtaaagggcaatattttaacactaatgtttctcargtatatactcagctagtctaggatggttgcacaccagtaaatggattaaagaggaaggtgccatgtgggtgactgtgtcatttctcctactgccacagatagacattttcgaggtagaaatgaagcctttcaccaccttcctatctgtggtgacatgtgcaccaaaacctgtcttgactcttgggataggtcctaggaagtggcagattggatagccagaaagccagtcactcgtttaattttttttccttctgaaattactagctaaggctcttggaattttgcactgtagtagagcagttaacacctttgacagattcctggaaaaaacttctagattctaaactgggtgaaagactggacatcattttccttgtcaggtgttgcatttttccgttagaggtggraagctccacgatgccctgtgtctgtgggctcatgttccctcatcttgtagcttggagaggaaagaagttgccttctgccaaaagccaatggtggtatgttgaagcgttgtgtgatcaagtgttacatatgcacttcagatcctgtctgtcagtctctgttagggctgcctttcagtaactcatttattatttcttctttgttcttaagatttcatctcatgcccagaactcacaagcaggttttggagtgtgttccatctggccgtgtcagtgcaaattgcatttcttacaaaggagaacctcaccaaaaaaaacctcacagataagcaaagtatatagttttgcaagctttttcaaggtctcctggcaatactttcctgctcaatttttagcttttcttttttttttaaatgtcaagagagtgaaggtcttgattctctctgaatagcatttgtcactttgccagtaaatacagcatgctaagtttatgtgcttttaaatattagcgtttttcgtcagactcttcaagttcttcttgaacccttggtgcacagatccatatataacctcccttttcagtattgctgtgtgtgaattaactacaacacatatgcatgcatagctgtgaattctgcactacyttttttttcttttttccccccaagaatatctcttgggaaaagtttttagtacgttacttaactttattttgctgctaatttgcgcattagccggtaacttgcaagtctggagaccacttactgttgagggtagctggaattttagacccttggcagtatttaagatttagacatttagccttgtgaaagttaccacagtgctccatgtgattcattgactgtgagcctgttgtccattgcactcagccctgtactcacttcttyactcgctgtcctggttttactgttcagattttggtgggttctcaaagcagtaccactctcatctgctcagtacatctgcggcaactggctgccttcgatgctgtcattgcgttcagcccagcacatcacagcyccatcagtgtgtagccaccgctctcgtttttctgtatcgcttttatctcctgaaaaagatgcaccaaataagagatcatctatatcaggaattgaatgtctaactcaaacctctcatttttgtttartaggtagatctcatttgaagtctcctatctgaatctctgaaacaattatagtttgattagacaaaggtttttaataacacttcttttttgctgtagtcaagcattaatagaaactagtttaattttcacagtggtaaatatttttattcttgagttatctaggaatggattttccacgatgtctagtgacttaaaaaaaaaaaggaaaaacgtttctacaaatccctttggttttccatgggatctggaataaaatgtcagtgtctataaactgtatgtcatggagtttagtccttgtttcaggtttaatagaaaaaatcaggaagtatcatggcattgtctagacatcatgaagctattttatttccatagttggtaaacagtgaaaatttcattatctccaactactaggtacaactttaggccacaggaaaggttatttggcccgaaagtttggaggtgctccttgaggtgggaagtatcttgtgggaaagtagttacttgattcaatttagttcattggtagggttggggacttggtgttggtttctttctttcttttctttttttttttttttttaattttcccagcaatatttagcacaatgagcgtgtatgtgctttggggttaaaaattatctgctagggatgataggcctgggtttctcgttgacatctagatgggcctgattagagcagtcatctcctggtaggcacaaaataatcaccaacagtaatgttgtatctgtaatgtttgtttgctttttaaagttttattcttgatttcttgtaaacatccattgcactgaggccrtatcattccttaagacagccctacatcttgccttggtaatcccttagataatgtggaaactcaaaccgttaggctccagtcatcttagaccatttcccatccgttttgtattttctcktcctgaaagcagctgaactgaaagtaagtaataatatgctggaccagtgggaacggatgtgggagtatttgtggtgtgctaaaatactgtaattatctgtgaggctgcctgacacgcttytgcaatcttgttttcatcattcattctgcaaacgtttatggagggccttctttgagcacagaggcaaaactgaaagcttcagggatttgctgtagctgaggagccctgggagcacagcccatcaagcaagggatgtgatggtgtcctaaatggagtgacagttctcctgggaaaagagatcacgtggattccggtcaaatcggctaaggcttgtggttctcttgagcaagtctgttccttctggaaaccaaaagtgcccttcatctttagagacattttactcttccatccaccttttcagactgagctgtctctactatttaggggttgaaaatccattacacagtcactttacgttaacattgggtcatcttatgtttgtatgagacggatgtgggatttgaggggaacattgtcattcccttaaaataactatcatgaaaaaaatagcaacagtatgtaaagggaccaagagtggcagcytttagggaaaatggagcagagaagagctgtgaacaaagctcatttatttgaaataagcgtgctttatttcacatagaggggcatcagacgttacatttcattcggacaaattactgaacagccgaagtgattgtttccaatgtaggttattataattattggatacaaagatttaactagtgtttctgggttggatttttgaaatagtatgcaagtcataagcacagtttcaataaaacacgtattctggaggtgcgtggaactttgtattatttgtagttgagaaaggcaaactttgctgacaaaccagtacctatcacaaacgaacacaaaaagtagctgttactgtgcaggctgtctttaactttcatttcataaagggtacattattgttaaactctactacatggtttggggagaaatccagtggttttatttaaatgaacactctcacactgccttttgatcaactttcaaagtattttgcagatgcattttgagcatgaccatttttttccccaagtaaaaacaattgtgcgtggcctccatataactcagaaagcaygctcttactacctatgcaagcaaacaataaaacatatagacatgaaatgttaagtcttaaaaaaaaaaggcaacaattatggagctctatttttaaatttgtgattttcaaaatatggcttactcatcattgtgtagaagagcatgaatgcgatttcttgttttgctctgcatatatttctctgctgtttttctgatcattggcgagattgtaaagtattttgcaagcagaagtggaattggatatgttgaacacacatcattggtgtacatactgtatttagcctgaagactttcctaaagtgttttgttctaaaaataacctgccattttctatagattttaattttttatatcttcaagggttctattttggtcacaaggaaagaatgtggcttctaatagtgctaagaattaaaagatgcttttatagagacttagagctattttgaaaagctttggggcttcccagccactgatcacaattagactaagcccatggaatttctgggagtgttgtgcagtggattcggttctagatccatcttacatttgtttagtgtttcccaatttttgggagaaggggtgcacagcaaatttgagagacttttttgaatctcacacatgtattttcctcaagattcttttaagcctcttctgaatgacttgtctgagatagtgaagacccacattaactagaatcagctggggaactttaaaaaatacagtgcctgggtcccagtccctagcttttgatctaattcatgtaggggtgggatccaggaattaccatgtattttaaaagcttctgggtgtttctaatttgcagacagattgagaaccactatgatacgtcatccctttactgagaattatggcgagaatcactgccatttgaattactcaggagtgactgattcctcagttgtgtaggagaagcagaaaaaataagaataaaaagaattgagagatactgatatcaaactcccatttgaaatacaagggcccttctgattcaaggcccagttggggagcttggaccatgttgtgaatggcctagcactcgccagtctggtggaaattggtggtcttagttgctggagcaggctgagtgtccccgcggggtttgcatctgtccccagaaccttttccccaggcccgtgggggaatagggaagtcactctgagctagaaattgtcgaagaagaaaagaaacaaccttcctagccttggaaagcctgtccctgcttttgatagaattattgcctttttgtaggaattacagtagcaaaccccaggctgccgctgaatttcctacttttgctcattctctaggatagttcttatccagaatgtggtttcaggaattcttttttttagtttgaaaatgaatgtgaaacattttctttggtgtctttttttaaaaaaaaaaaaacccttattgctattttttcgtgtttttgttttgttttgttttttgtttgttttaccattaagtaatacacatcccagaatttggcactctgtgttaactgtggaggcaaataaaatttagttttaatctgtggtgagctgaatgcactacaacaccttccaagtaatctgatggtttcattctgtcgagcctcatgctgcctacaaaacaccacaatttacctggtgttttcaacattttaaggaatgaagatacaagtagacatgcaagttggaaatgtttctttagaaaggccatccagaataatgatatctgttgcagtcgtccaaatgcaatatgaaatttcctaggtgctattataaacggtgtggtgtcataccaaatgcaaaagcagttacagtatttccgaagttggagttctctttgtaggcctttcaaatacgtgtttgcattccatagaggtctgctcaccaactgtgcctctcaccactggttaaaattgaatttaagcctcattgacataagtcgtttcttgattgaactcttcagtttttacactggaatttctgtagttgtcttgaaagctgcatgtcacatcactgtacacaaagtgctttggtattactcatgcaccgtggatagtgatttctgtgtcgttttcattttcagttgtacagtaatatggaaggcaggatgtctttcctagaggctggaagaaaagtgtatcgtacattttaaatttattttagaacaagtgcatgagatgtgtcactgatttctgttatttatttgtatgttttattattcaaagtgtatgcacttttaagaagcagaatttatatttttacgtttgaaacrttttatttctgaaacagcgttgattatatagtatacagttggaattaagagaaaagtggaaaatgtaacaaaatacaataaatttattacaagatgtcctcttcaagccacatttctcctttctcccccttgccaactgatatctttttggtgttgactataataataattgtactgcatcagtctttacaaaatgccttaaaattgcagtgtttaaaacacaagttacagaaagatgtatacatatgttttctgtgtaaaagtttaaaacaaaaaatcacatccatgcttgtataattttcacaatcagggatggttcttcccatttcctccatgacggattagagacagtttgtcctgggccatggaactggacaaaaactcacattctggttcaatccaacagattttcaacatttcgcattattttccccctcttaccaaacttttatgatgggaagaaatagcagtataaaaggggccattcttcctgcgctgtctcataccctagatatttaatatttttgatacaaacaacatttttccagctgtctttcccacccttcaggacagaactccctactgaggatgtcacatcacctatggccacgtgggggcactaaagatctcttatgcattttagaagtccagcctgcaggtggttagcctctgagtgtggaaatgtttattcagtatgagttggggaatacggtatcagtgaacaggggtttctgtttaggggagtgccaccagccatcatttgttcccggaaagtgttgagtacagatcaggacagatcttgtttccctaaagcacagcattatggtttagggttggggtggggggagttgatgttcctgacaagtgtgaaccacatgccgtgctaggtacagcacttctaaagctctctaatttgaaatggtaagatttcgcttaggttctgttagagagtttaaccatgtagtacgctgattattcaagaggcttcattatgccacaaagtgttcacatgtcataaaatatgtagatttaatagttatgcagatatttaaggatcattttgcctgtctccttaggatttggaagattatctttcaatacttgaatggtcaacgtctctctgaatacttttcgggtccctgtaaatcttcctgaagaaagcaaaggtgtgataacaccccttgcccagagctgcatgttcctgtgtgttaaactgccccgtgggtgattctaggccactctgactccgtgggatgtagcttgaggtcctcccccaccccagtatcccctttctcccagctgggttctgtgtcatatgttctaattctgtgtacatcatctaacataacgttgaacggttaatcacttcgatttactaatacattcactttccattgctcttcactccttcctgggttctcccagatggatgcttcaggtttcctctctgcgaccctgttcctttctcaggcttctccacgagggtcatctggtagatttcaccttgctgggtgggttgggtctaccttctgcaaacccctctggaattcggtcttggtttggtctggtcttagctacgtttttcaccctctgccaacacctgctatacacagaggacagggctgtcctctcccttggtggtgcatttttgcatgccatataacccaatggccttgcactcgtttcttagagctttcagggatttgatatcagtttgacttgctctttggatgtcttaacagctccatttttcttgtgaaacgtgagaagatggtgcaaatgagactgcagtgcctagttggaatcaggcctccctgcccccggtggggtctcagggatcttgcattccagcacaccacccctgtgccttccctttgtttaggaggactccagagaggcccacagtgcacagatccagttccagagacacagggaaaagggtgtaatacgtctttcctctccgagagtctggagtggacagtgtgtggggattgtgcactggggactgaggatgaatggcaccagcctcagggttccaagtccacaaaagttgtggtgaggaaggtgcccctttactgtttcactcagaatcggagtccaggttccttcatttagtaatgtcttctgtgtgcccagctgctggggttatgaccacacttggaggggctcacctgccagtcaggaggtcaggttggccaacagataacgtttcagcaagtttgccacttattccctgctctttctcaaggcatcgtccctagaatgctcttctccgagatgccagcctggctcattccctcatctcctccacatctttactcacatatcaccttattgaggccttcccttactacctttttagaacactgcaacctgcttcacacgctgtccgtactccctattttattttctgcatatcacttatcacaactaccataggtcatatgtgagctgatgggtgagcttacatgagagcggggaggtttgcctgttctattcactgctctttttctcagcatctaagagggtgccaagcttatagcagttacttagtaaatacatactagctgaattagtaatctgcctgagtctttctatccagaagatggaggatactggtacttgcatcatagagtggtgagagttagatgggaatgatgcctataaagccttcagcacagtgcctggcacagagaaagcgctggctgaatggagccatttgtaatgataacaatagtgatgaggaggaggggccgaccctcctggggtcagaggagggggcagtgggccataactcacactttccaggcaggggaaactgcttgcactctctggaaaccctgagtccagtcttcctggaatgtagggcaggaaggcaagaagcgttggatgaagggggcgggagatcccatctagggggaccttttatgaactgctccatttgtcctgtagtaaatgaaaatccaggaagagattttaatttaggggagaggagatccagtttgcaccttcgcatggtcaccatgacaagatgtgtcatgagagagccggttcggagctggttgcaggagtctgggtagagtgtgcggaagggctgaccgaaagcagtgctgggtggctggagaacagggagacgcttggaaaggcaccgtgctcagggtccaggagcaggctgcggggttcgaatcttgctagctggacaatcttgggcggattactcaacagctcaaattcttcacacctgtaaaatgtggataacggtgtctacatgatcatcacgaggcttaactggaatgcctggtttatttacatttaatataatcactaatgtatttggttttttggtactatcttaactttcttggatatttgtcctgcttattttatatttattctt
